United States Patent 10,407,724 (METHODS AND COMPOSITIONS FOR SCREENING AND TREATING DEVELOPMENTAL DISORDERS) - sequence listing, part 72

SEQ ID NO: 1872 - DNA, 639024 bp, Homo sapiens
cagtactgaaattaagcagcatccaacacaggcctactcttacgacatgtgactttactgttttccgtttttgttgaaagagtcattaacagttaggagttgatggcagtttcaataacaggtcattgccgagaaaaggtaagttttaactttatattgtacatgaaatttaaacttgaacatgttcggcagagtttcctacattttggtgtgaacatataaacatttctacaaaatatgacgcttttacctgtgattaaaacattggctggtttcctttgatgtagaaaagaatgttcttttcatatttgcagctgtcaaattccaatgtcttttactaaaatgttataataataagatgatttgctaagattttgtactaaaatgttaaagacagaataagttataaagttttagtttgaagtgcatttaaaaataactactagaaataatgtgagactttgcacctttaaccaactgttttataaaaatatgtattgttcaacatccagataaggaaagagaaaagggtataacaatgagaaatagcttgaatttcagtgtgaaagatactcactttaaagcattgtattaatgttagcactaaaaacccttaaaaaggttactatgtagctaattaaaaagcaaggagcttttaaaatgtaaaggaatactgtctatcatgacacttgaaattttttttctaaatttcatttaagatatagggtgaaatgagtgtaagtttctaattcataagcaaacttttatatttaaaaaagaagtcacagctgatttcattgaaggttactctgagaggagaggcaaattagaggtatacttttgttatttatgtaattatataattttccttctttgaaatattccaaaataataaaccttagaaatgaaaaggatttgttagtcctaaactgacatgtaattttcttttatattgacttcttgcttttacagaatgtctttgtgtgctgtaacatatgtgcagaaaacatcaaaatattgctaatctcagagacaaatacctaaaataaatctgactgtagatttttgaaagaattttaataacagcccaagatatgatccattcttccctaatattatttttattgtgctgctggatgggagaagtgatggcccccacaacacctattttttgtgttattaaaaaatggttacagggttgataagtggcaacaattttcttttcttttattgtcttctattgaaagacacacataaatgttttttgacatggtcaatttagtaggaaattattaggcatagtagtacactccattttaagacctcttcaattgtcaatactgaagctagctacttgttgactattaaaatgatcacagaaaaatagagattaggacttggtgttcaatacattttttattgttagcatgtaagaagaccctggtaatatatatttgctttgatattgtgattagattttcaatttgttgcatttcctcacaatggaaagcattatttaaatctgtcttcaatatcgtggttctgaacctctgcatctatagaagctgtataattctgataattttggttgatatgttattactttctttcattttattataaaagaatatcaaatgaataaacacatgcaatacttacaccttagcaagaatgaatatgcagataaacatctggcattgaggaaaagtccatgaaaattttttaaattgtttaatgcttttaaaaaagaaattcactgtaaaaatgagtgtttcttgcagaaactgttaaattaaaatacacatattttatggaatatgtgtaaaattaagaatgaattgaagagagcttgatatgaatttagaaagatcaatgagtaaagatgataggtaaattaaaataccttcagaattgtttgtaaagagcagtaaggtacaaaccaaattttaagacagttaattgcaaataagttactatagaattctattactttatatgttttaagtggatgagtcagaaacaagttttgatgaaatgaaaataatacggaagattttatttggaaagtcatattaaagctaatttgctcaaagaatgtcgtgcttttccacttagggccagcattcagtaagattcagaaaggagaaactctttccttgatattcctcctgttgctcctttttattattctcttctggagcggcctgctctgctcctaatttagagtcccatagacttggtacctagaaagatagacccttccattcactggctccttccattcaactgaacttttaaaatgtactcatcccattttccagcacttagggaatctaataaaaataatccacgcttataggagaaggctacagagctttgacttcctagccaggcctccctttctccccccagtggaattttaatatgtttcctcagcagacagggcccaaaggattagctaaatgttggatctcaagtgaggagactgatgccatggtaaatggttgggggaagactttagagggagagtgttttgttaaccattggtcctgcctgtggcatttaaacacagaatttctggaagtgtctcatatgaaggatccatcccagtgatgtatccatttctttaagatagtcctgaagaaataaacacctttcttgcagcaggtaaaaaaaaaaaaatattgcactacattttcaggcaattttgatattcccatacacttagaaattatttaacataattagtttttaatagatgtattttaaaagtcattgaacactctgaatttaattctttggatactaaaagcatattttttacactgtacaataaatgctacataattagactttaaaatgcccttgtaagtattctaaatttgagcttagagtgtgcaaaacttctttgttggcaaacgatagaaaatgagttcaaactagcctaggcaaaagagatattcttttatgtgtgaaaagtctaaggatagcaaagtcaggaatggctggatccaggagctcacacaggattatcaggagtaggtctcatttttttcattcctcagctcttcttttcactatgctgtaagcagtctctagtggaagctctcacgaaattgtcaagctcctactgagttgatcctttcagcaaactgtggggaaagaatgcttttccccagtcaccacagcaaagtgtcagatttagatctgatgggactgaattggatcacatgaccatagctgaacaattactgaacttgggtgcagacagcatgcgtgaccatgcctagctcacaggcccactcctgcactgggggcagctacagctgcagcacttgggctctctgctaaaaagaggggtctcctgatgtagaaattaaaatgctttccccagaagaaaggacaaaagcctcaaaattctactacggagtcacgtatggtcacattttaaacagtcattatttcccaacttcttcaaattccataattgtacaaaaatacagttttaattgaaaggcggatctgattgaaacatgagtttgaattaaactaaattttaaaatatttttcaacagctactgtatgtttgacaactcctcacaacatttgccttctaaaagcttataatccagagtgactattattttaataattatgatgcaaatacaatttgtcaagtaccataagaagatacagagaatgctctattagagttcagaaattcatccagcatttttgcattcctgttatttgccgagccataaactagagaattttgtaagtgttgtatcatctgatcacatactttcagggagttctggacagttttggaggaaagttttgtggtagttttcagggaaatctagcactgggaagatgagaaacattgcaagggacaggaaggaaatatgtcaaggcacaaaaacacggcgtgtcagagaattccaaagtagtgtgaattctccagttttgttagacagaagtatagtaataagaggtaggccagaaagatagtgtgagatcataaatagagtagacctggatataagtaacagcagggtttttgagcaggggagatacgtaattggatgtccacacttttacatcttgatgggttgtctgtctagggtcaggatgtatttgtttcttccatttatctcactgtgaagtgacattttctttgcagaagagtttgaagtcagtggagatatttctgtaaggacaggcactgacttacctgttcaggtgcctgaggttcttattcaagttatggttataacaatcttttttttcatttgatgaaggccttttgtttgttttgtttgcttttaatttaagaatagatgatatagtgagatggttcaaaatcaatataaaaccaaaacacaatgtttttagataagctatttcttatatttttatttctatctatcccatttatccccatcttaatccaacgtaaccacttttcatgtttaatatatatatttatacttcacagtttatgtaaaaaccatatatatatgcacatctatgtgtgtatgtatataacataactgcacgcacctctccactttgctttttttcttttagaaatatagattagagatattttataacaaaactaaggaactaattctcttttttacagctgtatactattccactatatggaaatatcatacttaatttaaccagcctcctgtaaaaagagtgatggatgttttcaagtttttctaattcaatgaatgtccatgtaattgtttctatttgaaaatctatctatctatctatctatctatctatctatctatctatctatctacctatctatctatcatctatctatctatcatctatctatctacctatctatctatcacacatttccagaaataacatttatgagacaaaggataaaataattttgatagttgttgccaaactatccttcatgttatttgtaactttttgaacttccaccagcacttaatgagaatgcttgcagaagcttcattgctttttcaagggattgtgttgccaagctttgcaggttttgccagtctctaacaactgcatctcaacacagttttattgatatttctgctattatggttaaaattgatcttctttttaaaagattaaaggtcgatttgctttccttgtaagaaaatgtattctttctcagctgtataactaaagaccaaaacattagtgactttagtgacactcaagccttggagtgagatgtcaaaggaagcaaagaactagagatagcatatatgaaatgctgtattccttttcttttttttttttttttttttgagacggagtctcactctgtcacccaagctggagtgcagtggtgcaatctcggctcactgcaagctcggcctcccgggttcatgccagtctcctgcctcagcctcctgagtagctgggactacaggtgcctgccaccaagcccagctaatttttttttgtatttttagtagagtcggggtttcacggtgttagccaggatggtgtcgatctcctgacctcgtgatctgcccaccttgacctcccaaagtgctgggattacaggcgtgagagcgcgcccagcctaaatgctgtattccttttctaaagcttgaaatagacagtagcttaaaagggggataaaatatgaatgttcaagtgaaggaggagaaaaggaatgaaaataaaggaacccaacaaggtctcagaggagactaagacagatgggtataatcactggctcaagtagatgaattaaccttaaacagaagagagagcactttaatgagcgtgaatgcagatgaattggatataagtaagattcagtgaggagaggaatttgagggaatacatgcttcatagtttctatctttgcctaaatggtgggaaagttcatctgatgaaagcattttctgcatgtcaaaaactagacagaatatcttattttaaaacttatccttgtcagtaacacacaatacaattgtggattttgcaacttattttttatcttttgctggttattagtccaattccattcaactccataaataattttgaactctaagtatactatgttgtcctaaggattgctggagatacaaagaaatagatatgctacttagccaatgaaaactgtttagtaggtaagaggtacacaaagataagtatctaaatatcaattatacatataagtccagtgccatagaaatattatagaatataccattgacagaatcccaaaggtcttcattttgccaaatctaatagccatttatgtatctttatattattcactgtctgagctgcatttgatgctatcgaaccctccttccctcttgaaactctcttttcatttgacttctggaatacttttttcttccagttttcctccaaactacctgaatgctctttctgtatcctttgctaacactttctcatcatctagctctctaaatgttggaatgtcctgagatcagtctttggatttctacttgtcttctaggtttattcctttgcggttttatttagtttcatgaccttaaatgttatctatatactaattatatttcaagaccaaatcttttctcttagcagtaaaactataaatccaattgcccattcatcatctccacttgagtgtctcatagagacatcaaagtgagtatacagtactcaaagcaaatctcctaattactgcccacctgtcccccaacccagcctgcttctttcctttttgcctccaccttagttaatgacaccatattaatctctcttttcaggacaagagtctaagaattatccttgattctactctttccctactacttcctacccaaagtttcatctagtttatcagcaataagtagagcctgtaaaatataaacttacttttcattatactgttcacgtgacttttctcaataatggcccttaaggtgttatatcttttttttttcagtctaatacttcttttattttttatttttttggttgtcaatacaatgacttttctaaaaaaatcttgccaagtgaatacagcacaacatgacacttggatgaacatcaaactttagataaaacacacacaccaatttactctctgctttcaagttagaataacaagaagcatatgaaacaatgttgatttgtacatgtttgaattaattcaagaaggttgaagaggtggcaatgtttacaaccttttagtcagactttttgttgggcccccggctccaggtgactcctgtgctgtaatttgttattaagtatactttgagggcatgaaaaccgttaagtctcccaatccttaaaaatattactgaagaaaaagatatggaaagagaaaatgtaataaataaaaactccttttatattacattttgtttacaatttgtcttctttcaaattgttgctattatgtacttgaatccttttttgaggttctattgatatacttttatacttataagtgatgattggaaatcttaggctcttattgaataactttgtatttcacgggaatgaattagatattaagcaagaggtataggtacatcagaatatcttgaattcaatcacttctttccacttccactgctgttattgcagaattctcctgactctcctccctgcttctatcttccccacaatagtcattgtccaaggagtagacagagtggccattttaagagttcaaccatgcaaactcttttaatataatattccaaatgactattatacttcaaattagattcaatctcctttcatgatttgcaaggacctcgttatctcattactctgcttttgttttccttcatattagtttggctatggaatttattatttatttttcagtgtttagtggctattttcaccttagaatgtgtggtccatgggagtattgacctcgcctgtctttttactgctaaatacctagaacctagaacaaatggtaggtgtatgataatatcaataaatatttgtttagtgaaaggataaatgccataaagattgactttgggctgtagaatcaaggaagacaatctggagatgtgtgaattttcctggtctaaaatatagggtaatttaggagaagagaagctagaaatatatttcaaataaaagacactatatgtactatatatatggtacagttttagtaagttggcagtgatgaaaggttgggtttgaattctgtatccattatatgcttctgaaaaatggaacaaataacccaccagctgaaaacatattgccataaactgatgagaaagagcaactacctctaagtatttaaattttaagcaattttactaaaaccatggtattaaaattgactaattttatgttcactttaaatccatttcctaaaagagtcaaaacagaacatctctttaaaagagctatggaaggtagaatgctcaggaaattggatgctgagtcaagggaaacttccgtttctgttcatttatctttctgctttagttaatttcatgttagaattttaaagactagaaactgagcaatggaacccaaattcagctctctgctaaatgcactggggaaatcaagtaatctgagcttctgtataatatcacctattcatactttgatggttctcctaaagtagaacattaaaggaaaaaatgtatggtgattacctcagtggtgtctcaagcactgtggtaagtactatagttgttaccaaaactagacaatattaacttattctcaagatgtttacagttgcttgagaaattcatcaatataaattattagagtgagattcttaataattatcatcatagctatgacttactctgtgtagattatgggacaagaattttgcatgcataattgcatttggtatccacaaaaatcatgtaaaggaatttgtatccccattttaaagataaggaagctaaggttaagagattaaatatgcaaatttacaaagcttctcggtaggctgggtcatgagttgtacatagatctgggtaatgcaaagtccatgttattttcagtatgccatgcgataattttgaagcctgttaagtgttagcagttaagcaatgctgaactttattcatgaggccctagagtctaaaaggctctaaaagaatcctactttgtttgatgtctaaagcaatgccatctgtaggaaacctgttgtttcttctctgcaaatattgcctatgcagaagtgttgtaaaacttgtgaggaagaaaacgttcttttgccttggtttttgccatactgcaggtgtctttcctctttctctttttctggtctcctctggattctatgtctccccctggctcttaattctcaaaaattccttcttagatccacctatccaatacggtagcaactagcacaagtgactattgagcacttgaagaagggctagtatgaattaagtgtaaaataaacaccagattttgaagacatagtacaaataacgaaaatgtaaaataattaatattttggcatttaatcatgctccattgattatatttcgaagtattgggttaaataaaattattaaaattaatttcacttatctcatttaacttttccaatgtggctacaggaaatttttaaactacatgtgtgtggctcatattatatttctaatggatgccacggctctaaaccatcttctttttggtctctcttttgacgttcttataatttcaatttcattcctcaaatacggtccttaaatttctatctttagccttggtgtctctgtcaaaattgttccttatttctaattgtcacttgatacttcctctatgatatcccatcagcaggttaaactgattatgtcccacattaaatccatggcctctcccaagggttatttttgccttccttccaatttcgattacatctctactcctgaagtcatattattaagggacatgatatcatccatatcatgtattccataccacttattccatacatccaatcaattgccatactcaagcagcatttattcctttctttccgtttgcacgtatcatcatggtcactattggtcatctattgagtcttgtctagattatggcaaaagagtctcaggcttttatattgctatttctcttgcctctttattttgcttcttataaatgtattttaaggctttagggtgatagttgggtttgagttaactaatgcaagtaataatgtctatcatctatttatattctatttagaattttaaaagtcgttttgcatatgttattttacttggtaattctagaaagccagtgacaaagtgggagcttttagtagacttcgtagaaaaaggcagtgaagcatggagaaattgaattgcgggaggacacagaagggctaggacacatttcaggtataaccattaaaacatactttttctcaaattttagtacggaacttttttctttcttacagagatagtagtggtattaaaagcacaagctgggaagtcagaaaaaataaaactcaactctgggccctaccacttgctagatcctgtatgatattttgggcaagttacttaatctttctgagtctgcattggctcatctgtaaaatggtgagtttcctcccaaggaaaaaatataaaatgatgtatgtaaagatgtttaccctgcatgaggcacatagtaaatcactttaaaaaggttaaacgcggtggtaagagtagcagtagtaattgttttatcaggtcttgaatcaaagagtgacttttttttcttcactatgatgtaaaaatcatgctatgataattttggtttatttcaattctaagtattatgataaaattatgaaactcatcaaaagcaatttcttgctattagtttcattttctcaatacagctgtgtgggggagtatagtatagctgtgtgggcaaagggaagaagagataactcttttcttgtttgtttaccaatttttagttgatatggtagttttccttcaagcagctcaagatgtaccctcaccaaaaataccctttaattatgaagaattaatatttatcacataaaacaattcaaaaacaggtaggcagccactgactcttatgcctgaaattaaaatgaagcaaagaaaaacagcaaacacgaggagagaaaagaaagtagaattctcttcatgcacttttattttaaatctaaatttttgcatggagtggtaaggtagtaaggtagatagtccacaagacagatctactagggtcctagaaaaataattctgagaagggaacatataaaaggaaactaggaagtcctgagagtatagattgctaacccagtaaagaagtcttttgtctttttttttcttcctttcttttgtttaattttcctttgaggaaaccaactcaggattctatatatgtaggttgaatgaatatcccaactcagtcctaattttgaaagcaattggtgttagcgcatccacttaatgagaacaaggtgcagcagaggggaacccacgtgctgacaaaatgctgggaagacaaccagctatggtgctgtccacagaaagcttgctgtatcctatggccagctggcattgagctttaggtttgaagtctggcattagcaaaggggattagcaagtgggcagtaggttcagggtgggaaaccagcttgacaaaaaacctggagaccagtcagcatggcagatgtgtagagcatacacaccctggagcagggatgggggaaggtgaaatgcagtgatctgacttctcctgaccatgatgagctgtatggtgcatacatttggcagctttagatgtggagaggtatgcaggaaacacaggaatccaacaacacttgggatttggagtcacagtcattctaatcttggtggcaaacttgaacatgctggaaatgctcatggcctgggggagttcaagacaggggatttcagacagtgctgaatgaatataccaatttcagtactaattctgaaaccagttggtattagggcattgaattaatgagagcaaggcatgggaccaagtgtctataatgtcctaagtacaatacagagcaacaacactgacaaatacagtgtctgactttaaggagcccacagtcaatttgggcagaagagacacacagctcaaatagagaacagaaaccaatataaggcaggatataattatctgccaaaatataatagaaacagtagaggaggcagagaaaagagagggaggaaaaggggaacttgcttagcaagagcaaagagcacagcacaatatcctactcgttgtaactaagatcatgttgagaaaattgtaagaataaatgaagtaatgtgaatgtctgacgatcctctttctaaagcagtagtacaaatgcaaatgcaaatgcagtctcctggttctgctcttcatttgcgatcttaccagcttagatttaaaaataatgaaatactgaaaataatattgacttaataggcagcacaatcaccattcaacccatacatcagaggagcaatgttcctaggggtgattgacactacgagccacagtcgggaatgcctgcaggccagttgggatatctatacaagataagtgggtaggagaggacctgtagacaagagaacgtctatatgatgccttgtctataggatgtagaagctgtccacccgcagctgtctcttaccatacacacctggatcagtttgccacattttatgaattttcaagagaagacatatagacatacttttctgtttttttttaaaagtaacaaccctcatttttcaattggaaattgattcaaaacattccaaaacattgttcaggcccaacaacatatgtctgtgggttgaatttggttggcagtctgccgattttccacctcttcttgaatttatagctgctcctaaaaaagcaggagcagagggtaatgattagagagaactggagtcctccaaataacttctgtatatgcaataaatcccaataaatgtttagagactgactggagcattagattattctgtgaaaaaagcatccatttatgtatagcttcttcatttaggtccttgttgtgtctgtctagcttgcatgactgggctcattttcctaaattgaaagaacaaactttcttctgctgccaaccctccccaaagcatttttttaaaaaaaatcattaaaagatgtctctaaaagtttaacttgactaagtcataacaaatacatttgtctttgcatcaactgttatttttgaatcgcatgatgtaggtagggtatggatcagaatgtgtggaagtactgttgtaagggagatgaaagagaggtttgcataccttgtgttgtgatagtaacagtggcaaccatttaaatacacatacatgtgtgcatgctcacacacacacaaaaacacacacaagaaccccaccagtaagtgcacaagatggggaaatgtagctggggcttggttgcataacccatttcatcacgttttctcctttaatagattagattctctgtctcagacgtagttataacaaaggatataagtaaataaaacaagacagagaagaaaaatgttcaatgatttttaaattaaatggataattctcccaactatttaatactctaaatatttatgcattttttactttaatgtgtccaagcaaaaatcctatatttcactttgtgaagcacctaaatttagacagaaatttggctacactaattcaaattacagtagcactcaattaactggaacctattagttatatcacatatgtaaccatctcctcctctgcctctcaccttgaggggagaagcctgggaactatactttgaggaagaaaaagcaaactaaacttgtttaagtggagtatctagtcccccagatagctcctatattaagattcctgaaaaggcagttgaatcacttcaagagactaaaggcatcaagagaaccttcagttattcatcctagaaagaagaggatacattttaaggtgtacatatacaatatacaattaacatagtatattgtatctcttatcttcaaagaaaaggattgaaaaactcagtaaaaaatttcagtttaagtaatgtgaactggcaaatattttttcactattttgatcatctgggcttcttgaaaggaagcctgaggatacataattttgtggatttttttttctcacaccaaacttcctttggtctttatcaaggagagctattttctttcttttttttttttttgtccctcagacaattacttgaaccacctcagggctaaatcatccaccgctggaacaagaaatagaaaaccatcaagacactgggaccaacttcacagtaataagagtacatgctaagccattctatccagaacctactgcaaaagcaatggaactgaaattggatgggcattcccatacacttttttttttttaactttaagttcagggatatatgtgaagatttgttacctagataaacttgtgtcatgggggtttgttgtacagattatttaatcgcccaggtattaagcctagtacccattagttatttttccttatcctctccctcttcccaccctccaaactccagtaggccccaatatgtattgttctcctctatgtgtccatgacttctcatcatttagctcccacttataagtgagaacatgcagtatttggttttctgttcctgtgttagtttgctaaagataatggcctccagttccatccatgaacctgcaaaggacatgatctcattcttgttatgactgtatagtattccatagtgtatatgtaccacattttcttatccagtctattgttgatgggcatttagattaactctatgtctttgatactgtgaatagttgcctcaatgaatatacacatgcataaagggatgatttatattcctttgggtatatacctagtaatgggattgctgggtcaaatggtatttctgtccttagttctttgagaaatctccatactgtcttttacaatggttaaactaatttgtactcccaccaacagtgtacaagcattccttttatgaactattttttaagtgttgaaattgatgttattttactcacacttaccaagttcatgatataaataagcaaagaaaaagtaaaaagcactcttgcactcaaagttgtgtatagacccagattgcctaggagctctttggggatttcttttatgcaaaagaatttattttccagcaatatttatgactggatgttggtctggttgacaaagtaccatattttaattagtcttaagtagaatatttacagcatcattttcatgcacctatgtgtctatttatctatttacttacctgcttagctacctactcatttatctctcactattttcaactattgcccatacccctacccctcaccagcatattctaaagtgaactttcattcccaggaaaattaattagagcagtaatatgaacaaaatgaagatagcagcaatgggctgtaaaataagaagacaccatagtaacaagtaactatttcacaataatgcgcgtataaaattaaagaataacttacataaacctttataaaaataactttttacaaaagggtgcagctgaatcccttaggggttatgaccaaatatgcaatttctcagcctctccctcattctccttaaatgggaatatctgtggaaggttcagctaagtctgcatatttaataagctccacacattgaccattgagaattactactttatagctctctttctctttactaccagaagcatgtgcacatctggaactggttatttctgacccttactctcaggtgaaacattaacttaatacagacaatctttaattctagtggaatggggttttgtggattcaacaataaattataatgagtgatctcatcttttggtctgggcttgtgatgtacaaatcaagtgcattcccaccttatttacaagtcccagcacttcagtgggtcacctcttcctcactggacatttgctttctccttgaccgcaacttcctttgctggtaacctggtcattcattgcctcactctcttgctagggttgaggttctacctttctattgccaatctcctttgtggataattgagctagacctgaacaaatagccggaattgagaactgtgccacctagcaaaaaacctcctagttgataacaatctgcaaatctgaacttctcagtattccccaccctgtcagattatcaatgactgtttctgctcacttgttgtataactcttcctattcaacttgtatccccagttgccaatatttacctagattgtgaccacagatctatgtaattgcttgacactgtcagcatctttcaaactgaacctttcgtcaccacgtgtggctaggagagctctccagaaactggtcacttcagatgaaaagccagttcccggttctttcaggagagataacaggtccttccaatttatatatgtataggggtgtgtgtgtgtgtgtgtgtgtgtgtgtgtgtgtgtgtgtataatatatatataatatatatgtaactttatttccatatggaatatatatatatctcacaccaaacacaaacattatttccagatgaatcatagttctaaaaataaataaagttgaaacaactcatttagaggaaatcatgggaatagtctttgttgccttgaaattaagcaagggtctcttaagagggcaataaaagcactaatcgtaaaaggatataaataataagttaaacaatattaaaattaaggacctcttcattaaaacatgccattaagagagtgaaaaagcaacccacaagtgggaaatgataactattgcaacatatatattaaaaatagacttgtggttataatacataaataactcctataaatcagtaagaaaaagacaaacaatctgatcttaaaaacaagcaaaagtattgcacaggcacttcacaaaagaatattgcatagcaatcatctttacaaataaaagtttgagtgaaataagcccatcaagaaaaaatagaccctttaggttttcattgatataaagttcagaaataggcaaaacttagaagacagaagaatgattagctttagtggggtgaggtgggtagtgagtggaacagagctgtgcggggattctggagtgctgataatattgtgtttcttggtttggctgtaattacaagaatgtgttcagtttgtgacagttcattgaactttatatgcaaacataggcatgcacacacacacacatacacacaagctatttaaaatgtattttactcataaataattgagcaagagagaactgatttttaaatgcattaaaggagatactctgaaaacttttattttaatgatatagttattgtccttcacaacaatagactatgacattagtgtcccatcattagacatgcccttttggcactgaaattcaatctaataaattcagagtttggagatgagcattagggaaagactaatagatacaacagcaaatttgctaaataaaacaaatgtcaaccatatctgactgttgtcaattactgattactgttaattactgtcaagtactaattatgcaatatgcaacttccacatatttgaaccctgggcaggccaagatagtgatagcctggcataactgcaaccaatgggtgattagatttaatctgcctgataaaaagactttgcgactgggtcaagcactttaagaaggaaagacagtagaacaagaaatcccaggaaactgagacaatcgcaggttaaaatttcctttttgcacttgatactctcccaacaaagattagagaagtagcctgtcccagtgagggtctgagactccatttgtttccccagtgttttctaacgctgtggctgctgagcaacttgttctagagctgatgttttctctttaagtgacatttcatcatcaatgccctaagatagtcaccctgttttcccttaattgatagttgtacgcaagaggcggaaaatcgctcagcatttcttgctagattaggtcaaaactgacagaggaaacagagagaagattgcattacttatgccccttatggctctcatctgtatctaagaagattgccattttataaaatttcttatgctccctaaatgtaattacaatggcgcaggcattttcttcctatttgcttttcaattttttactacctgcctgatcatcagagggaaattcagaagcagttccactaatcttaactttattttccttatgtctctttaattagatgcaattgcaccctaggaaccttttcttcaaatgctttatttagttattccttttaagtctttacctttcttttcatttgattgttgaccagaagcattgaacatgtacctagatgttcagagtgaagtacctaaaattctggaatattttttccgtatcacagggtgcccttttcataagattaatgtttacaaatagatactgtaatatttattctgttttaaagttaattaagaagcatcccacgagcatgttatatatttattttgtggcctcaggggtcaaggattcttacttgtggatttcttttcatcaagtatcttagaaaggggttataccttaaacaaaatcatcaatttccccaggatctataagacaaaatcccaattctttaataaaaataaccaggttctcctaaggcagccttaatcaaccatagctttcccacttagccaccaacactgtatcatcttgtgtggatgttcactcccctttccttaaatcttgtgatctcagcctgcactgctcttgatatcccctctctgcctttcagagtcctgtttatcatacagcatccaggcctcacatcacctccaccctaaaatcatctccagtcccattctccactgcactctaatcagacttcatggtaggcaagcctgcttgtgcttaactccactgcagggtgcttaataactttgcagaacctgtgggatgtggcaaagtctatgtctcagagtagaggctcaataaatatttgaagtgtaaaatgagctgctttgctcccaacaggatggagtttgaaaggttaagagctaagaaagatcatggttgcctaccacacacttattctacttttaaaaaatattttacttgacattttcaccatttaagatggccatgtgcagtgataataactgtattacaatttaccatgctgcagacttgtcagactttgtcagcaaatgcagcaaatactccagattccctgctataagttaaataaatgcaaaaacttattatcacatttcctatatataacacctgcccaaagacaatgttacccaatggggtggctatggtcacattcctttactgtgatcttcctttctcattatatttgacatttttgaaactgagttttattgcactctctcagcttacagagtggtcggggaaattagacttaatagagatgtaaaagccacagggagaaaacaaaaggaaagtgaaatggaaggaaactgaaattaaaatgctattttggtaaatggctgctgtggtggagacaacaaacaattgcaatgcgagttaattactgacctgtcaggaaagtgtgacgcgaaggttgtggcacacattactggagctaccaggaccacaactcatttccacaggggaacagacttgttctaccacagatcaacataagatctttccaggggatagaaatgaatttctcggagaaatactatttatctgtggagttgtcatgagctcttagcagacctggagaaacagctcctctaatacatgtagagcagggaatggggttgtgtcaccagagaaagtttgtgcatgtttaggcagaggggaccttcgctcctcgtggtggaccttcgctcctcgtggtggatgtgctaaatatacagctcccttgccatggagtgaaaactcaggctaacactcatgaaatgggaattccctgggtgtatggccatttcttgcctctgagattttactcacaaaactctcagtggcaacctatgtcttccagaagcatccttcttttagggaaaaatatcaagtacctatccaaatctgaaactcaaggaagactattctcaaagcaaaaatccctgaaaattctaagattgtgataaatttgatctttttttaatgagaagaagatacagggcttttgggaaatagaaatatgatatttttaaccctaaaatattatatgaatctccaagcatactttaatattagcctcagaacacagaagaaacattgttttctttctgcctctaacttataataaaatatccatagtttatttactctaagaaatattagcaaaggtgagttacacatttttaaagtaagaaaattggtcaaagacattttcttctttgccaggctacatacactggcataaactaggttccatatttgtttttcatttatacattcaacaaacatttaagtctctattgttttgtcaggaagcagaggaacatttataaatgattaaacagaaagacttgcatgatacatacctaacgtggctacactatgatcattttatctgccagattttctttacatttcttgttaccttttctttccatacacaatgtccacttgatttgtgggtctatggcgaaatcaaggatgctggggggtgtgggccctgagtgccatcctagagttattctgaacagaatgtgacaccaggggatggtgttcagtatacccaagcctacattttctctactcagcagcataaagattatatcatagtgcctatccagtttttcccagctcaaaaattacttaatatatttttacttttaatgctgttgatgtgaaagagatgtcaaaaatacacattctaactcaaaagggcaggctgctgagctttagtgtagttaacagaatgcaacaaataattgggagagcagctatgaaatttatgattagatgaaatatcatgttcactcctatttgcagtatgagtaggaaaatcaagcccagaagcccaggacaccatcgaaccacgtagtttgagcagagccaaagttcgtgttgctcttatgaagtgcattctcattactgcttcctgtttttaaacaggattgaaaggagaactagtgcaatatcacaaggtattcttgctcttctgttggtacacgtaaaatcaggaagtctagagaatagtgaagccagtcttaagtgatttacatttcaatttctaactcagggatatttatttggagagtttagtaaaatcaatggatatctcaaacacatgcaaaatgagccagttcttcaatattttcattagtcattcaccagtgctctgtatgcctcctgtaagaacataaaaacacaaggcatcaaagttttctctaacaaaatttaatagtaacaataatgatgatgacatgagtgggtaacgtgttctaggaagaacaaggggaatactgaagaggcacatagatcaagcaaaacctaaacttaatatgatttgaagttaataagcctgatattactaaattacatagaaataagcataagcaaatattattgattttacaatctaccaaatctagaaaattgaaggtcagtgaggaatgaaaacatgggtggaacaacagaatataatttaagattcctgtgaatatttttggaataataatgcagaaagactcacaaaactggagttcctcgttctctttgagagaacaccctgaaattaatacagatattcctggaagaacaaccactcctaggttctggaagccaagtcaagttggactctggggtatgagggtttcttttgagtcgatgttgagcaggctttgcaatggagtttcttccctagaaccttatttcataaaggctaaaaaataagaccaccatggaagggatattgcatcatacagctctaggaggcaccattttccagaatgcaatgttaatgtcccatccccagtcacaaatcctaccacctctgaatttatgtaagggcataaatagagtggactgatcaatgctcttctactctaagatagttctttcatgtagccagaagagtttccagtttgagattcagttaaatgcttccttgagagttaagggaaagtctgactgatataacattgtgttagctagtctaatcatacccctcccatatacatctaagtgattcagaggtaagaaagaatggatgatggaaatttttataaattttgacactgtagttagattaagcctaagtgaatgctgcagtgggtgctctggcagctgaaatatgaaaaggattatagggtgtctactagagaaaaaactgttgggatgtaggcagggggaaactggggagttgaaagggaataaagaaagggctctaagtgggaccccaaaacaacttgcaaaatatggcctagaaacagccctgtctaattggaatgagaggttcctaacgggatgaatcagaggaaatcgtctctgaacccacaggtacagcagtcacaggtcccacagccactggcacagctgtcatcatcctgttagatttccatcctcaactgtcctccttctgtccggcagcagggctctgcttccctctcaattcatctccattctcaattcatccacaaaaaaacattgtgtgttatgtacatccaggacaacacacattctcttcctcagagtgtctagaataccagcccctctggtactggttgggttagaagggatgggactctcagtcaatcattcagccagatgaaagataagcgagatgatcagatatccccacagagaggtcaaatgctaccttctctatgaaatccattgtttctttctttcttcgaacttccctggtactttatgtcccttcatgacatatgtcaatacctaccttataatatcccaggtatctgcacacctttgcattgccaaatcctttgccagaaatgtccaacctgcactgacttagctctgatgtaatctgatcttctcttgcagacttcctctctctccacctcccacttccacctgagtttaatgccattgctcctctccccacctgggcactgccctattctcagttaattattgattgtttctctattgccctcaccaaactctggggcacttgataaagattatctctagtctctaaaatggtgcctgccacttaggagaatctcagtaaaggtcgaaggggtatatgtatgttttctgttgatagaaatctttaagacgaggttttgtgtcatttttctctatcttcccagagcaatatagtggtctgcaaaattagaaatccccaaatatttaacaatagaagaacaattatgaaatagcatcaagtcaatgaccttgcagagcaaagtacgtgggaagcagaataaagagaacaaacttagtggagggggtgtcaacaaaatgtaacaacagggtgagatggaaaaggaagtgagggctggaggagagacagtgagcaaattgagagaaataacattaacattgtggtagagagagagatccgcctgatggaaagatctaagaaagcaaaatcttgaaagtattttctgcagcttgtccccatgaaaacagaggtggggaagccagataaaaggctttgtaatgaatccagccttttgacagtagcatatcactaggcaaattatggtttgattgtgaaatcaatataggaatgcaaattttgatttgacactgaaatttgtccagcttctgaggaagcaacatgtcctataaatggtgtacggttgggctatgtaaacaccgtggctagatgctcttggccagaagagagtggcttcagcctgagtgatttcatccaccaatattacaaacacactgtccttagagtttgaatctattgaataatgtgggaaatcaacccttgaaggcactcagaggagaaaatatttttctagaaaaatatatgattttcttcttaatacatacttcaaatttttatttcatacttattgaaaaaaactcttgcattctcaattagataattttgaataatacattactcatgtaagcatataaaaaggaaaataagagcaaaataaattggctaagcaattgctaaaacaacttttctataaacatcttcgtgatttattactgaagaatcataaagtgcaagtgtttaaagtatacaatttgttcatttttaacatgtgtaaatgcctatgaaaccaacaccacaatcaaggtaacagacatacccatcattgccaaaactttgctcaatgtgatccatacttgcctctatcctttccctaaggaattactgatcagctttctgttagcataccttagttggcatttttgagaatattatataaatgaaattatataataaatcttcttcttcttcttcttcttcttcttcttcttcttcttcttcttcttcttcttcttcttcttcttcctcctcctcctcctcctcctcctcctcttcctcctcctcctcctcctcctcctcctattcctcttctttttttttcggtttctttcactcagcggaatagatttgcaattcatctatgtggttttatgcatcaatagtctgttcctttttatggtttattgttttcattgcataaattaaaatgtgtctatctgttcacctgttgatagacatatgggtcttcttttgggaataaaatacctgctcctccacctctttctgcctgcctgttttactggaaaaattatgagtctctctgatcctcatttttttcttataaaaatatgggtttaatggctattttataggagttttttgagaatcaaccattgagcacattgcttagcacatagtagatactaagtattagcttcttttctaatttgtcatttaattgccttactggtatttattgtaaagtaacaattttcctcctatcaaaatatttccttttctgttcgtcttagtgtctgcctgcttggccattagaatgaatgattctagcctcattgtccaacaaacattggggtggctatacacttgcctccttaaaacatgattcttcttttggattatattcgctcccataactgactagtcacagttttgttcactgtacacagtgctcggagcccgctataggatgtctattaggttagacttggagacaagaatcagacaagaagagggctgtttccagaaaatgagaagatgtgtttgtattgcaaccattctgtttgtaatgaggtgctgtgttcacttgaggaacttttggggagggacatttgaagaggattatggatgaggggctcagctaaagctctaccagtccaccctctggtgctgccacagtttagttctctttgttttcttcctccaaattctattttttctcattgctgctcctttaaagtgtgtccatactaaattttcttgcctaaatcagactccttctattaaaataaatggtgctgatttttttcttcatattctttataaatacgatgtccaactaagctagcaaatctagttcagttggcagatggcagtggatgaaggaattttaatttccccctgtgagtattgtgagtgggggtaggggctctggggtctgttttgctctgacaccaattttactcacttaaatttgtctttattcatagagatttttgttcaccaagaatgggtgctgatggtagcatgtaggggtaaagtgggtaatagaccagtgaagttgtggattaaaaagcatatatcctcaagacagttggtgggcaacaccatttctatataaggaaaactgtatctcattactgttaggagtttgttaatggaattaagaaacacagtctatcgttgtgctacctataaacttctgaagtcctctgttatgtatagtgctatccacatgtaaaggtcccaactgacaaaataacttacaaaggaactacttttttcttcactagtcagagaggtgaagactcttgtttatcaacttttaatatcctaatgattactagggacactccatcaagagttttcatggaaaattgtatgtttagaataacataatacattttatattttatcaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctgtaagtcaaataccccaaatatcccaagttccttgtcatacagaattttgtaaaaggaaaaaaaaaagctaattagtcttgttttatttgttttcctaatgtgcatgagaaaactgtttttgtaatgcattttatcttgcatacttacagtcatgataatatccccagttgcaagagaagagctgggcttaatccagagtgataaagtggatttggagctagactgaagagcacctttgactcattttaagggcctctactatcatgcttcagtgtcataaaaataatgaggttatgctagcatgtggtgtttgtacttccaaatacagtacatcactttgaaaagccagaggctaaaattagctaagaatgaattgagaaaaaaaaaaatctcaaaaaaaaaaatgtgaaaatctcttccttaaaatctcccaataatatacgatactggaaattatgatttgatttggagtgggcttaaaggattgaaatgctgtggctatttaaggtttggagaggaagccattttgtctcgataatgtgtcattaggaagatttgaaataaaatagttagagatgaactctactgccaattgtgtcgctggccctgcacgcatcctgagccactaaacccactgattgcgatgagtctcctctggttaattttcttccataatggtggtaacttgcagctgaggccataggatgttacaaaattatttatgcaatgttagccactcttttggaccccagatctattttgtttctcacagtgagagcaagagggaggagaaataggttagctggggacaggctgagttccagtcaccctgcagaaacatgtgagctattaattgagtgttctgttaatatcataggggcctatgaaatattcagcttcctaactgagttattaaatgagataaacttgctgagtagcatgttaccaattgtatttattccccatttttcactcaaaaaattaacccacagcaatctcaggaacatgagaaatatgtgattttaatcattctttcctcaggtgttgtagacaaatttagcatgaggaagccagtgattatatttggagagtgagaactacatccttagataaagtaactaatgagatatgcatttttctttatttactttctcatttaaaagtattgtctcctgggaggtacaacactgccagcctgactttgcttttaaaccagctaaaatgttcatcaactatgaacttgagacagtggttagagtaaattattggaatctctataatgtattatcagtaagaactgtacctttgaaaaagtttaaaagttaagtatatttaatgatgcctaacatattttattggctgtgtttaacaaaaggcactatgccgcagttgtttttgacaagcatgaaaacatcacagcatgagactgcaaaaggaattatggagagaaattacaagtgatccatctctcaatgaattatccacctcaatagcctgcagaactcagctaccaattaacacctactttattacatgttgggatgtacttaataactttcatgtgtttatgcactattaccttgactgatgcctcttgtacaattaggcataattggcatatcaatatgcaaaagttaaaaggattaaccctcttaaaactaatgagcatttctgtatccagctgctaaatgagacaaaattagcatttttcacttttgggcaggattttatcatgcagtttctcattgttgatattaccttgttacataactttagtttggggggttgtatgctggactgctagagaataagagttttccaaagttaaattagctataattatcccagcttttgtttccgcattcttagcctgggcaatatgtattcctcgataaggaacaaaaataaaagttacttttggttatgtgtgctcagtgcataattatataaaaggggtattttagtgaggatgtgtcatttcaccgagaaaacttggctcagagatactgtattgaaagcttgccatggcactaattttctttctgtctcagttcttttcatctcttttttccatgcacaattttctgactagatactgacagaatgtaaagtattttggcatatttattcaaacaagcctgttaaagttatctgctcaagctaaactaagaacttgatttttcagaagttgggtggtggggtgaggtcaagggggagattttgaatttagaggtgggaagagatgggtactaaaaatgtgggcacatattcaaatgcagtagggtttgttgtaacagaggcacatacatgtagtctgtacagaaaaaaatcaaaagtatttagagatcatacatatgtcatgcatcctacttaatatatatggcatatgcatactacttgttcactagtataacaattatgcaaatccagtatgacttactggactatataataacacaaggatctgatattacattcatcatgacttaattcattacaaaaatgataaaatattctagagtcaaaccaattctgtaattttctcacaaattcataaattcctctcgtaaattttgttcaattaaaatgtttttaatatgactcttaacttagaacacaatacaaaattctcctgtatatgtcgtaaaagctttgattcttagttatcttaaatgaggaatgctatgaaatgccaatataaacatttatccaaccctcagctatgcaaacgtaggtgaatttacttgctaagttagaaattttgataacctaaatgttgcaggaaagcatctcagtaaaacagatatgaatcctccattagtattttattggtgatgtgcatcgttttctttagacatcaaataatcattctaaaatttggttaataaaatcaatgccttttcaaaattcaaagaagttactttttgacgtgggaaatgttggagaggtgggcagtttcgagagggggaagtggtttgcaagaaaatcgcccatctgtaagagagatctggagagctccctttggtggggaaagaacagtctttggtctcagtgatttgttgtcccgtcctgagcaccagagtgagacctcttaaaggtagacagcttatttaccagaatgtgctaaacagaaaatcagacagctgagggccaatagatgggggcaagtgaactgtgcctgtttaagggctaaaaagaccaatgtgcattgcagcaaatagctattgcaaaaggtttaatgtggctttgatgttatttataagagagatgctcctgcctaatacacagtttagaatagatattaatgaggagtttaaatagcccgaatcaggaaactgcagacatatgatttgcaggcaagagtagtttcggcatttaatgctggtgtcttaagcaacaacgtgtatgaatattcaccgtttccatcttgtaaacgccacagaacggcattacttcattcatggccatcatgaacaggaaaatattttttattggtgttcagataaagacttaggtggagccatttttaaacattaacatacaagattccttttacttccattaacagattgtttgttcagtttttaaatatattatcagaaaaaagaggaaacaattttcttttgtttcttacttctgtgattataggatacttgccaaagttgtggctagccaaaaaggcagacataaaaattgctactaaaaatataaaccttctgtttagtagagtttttaagaaatattatgagattgtagggcttgtccatgtttacttcaaatcaagcttatagttaggtttgaggctttgtttgtataaattgtcctgaagtggatcctgatatttaattaaaatgacactaaatcacattgaattgataagacttggcatctcaaacaaaggtaattgcccgtattggttttgtgcaaaaatagcgctgcttggaaaatgtgcagccaacacagactgtcaactccatttatagatcaatatgtgaaaaccattgatcaggcaggcatgtgtaacagtaacactttgcatttatttgttgtttttataccacattaaggcttacaggattataggattcctaaatattttgacttcctcataaatatatgatctgttgcatgttaattaaatgagagtctgcagccatttctaaaattgtttttagtttgatgatttccttttattgctgtggatcgtatgatctgaaaatggattagtttccttctgcataaagattattaaagcttattttaatgtgtcctatttagtgtaagatgtgtctgtatttttgctttgaaaaacatagatacagacaattattttctcgtagcgagtggctgatcttttttcattaactgggcattctcagcgctcagggtagaattatttcctgacatattttgcacaccctgtagataacgggtcttcttgacttccctgatagaatttgttttctttcttttccttttatctagctctgtagtacaggcatctgaccaaacattatgtagaaaataaactgatcatctcaattaaattctagacacacacaaatataatttaaattctatttttctgattcaagaacaagccttatgaactgttcttatacactgcattcttcagttaaatctctcttatctcatcaatgtaaggacagtgttttgttcctaatctttattggactattgtggatgacatttgtaagccattttggtttataaggaaaagctggaggacagtggagtgagactctccaaagatccaggcctctgatatgactacacaataatgtgtcttccactgcaattttctttaccactgggagggcaattttgttgagattttttaatattttctatatacattaggagtgctgctttcaagacagtgctttctatacaatattaaaataataaaagaaacaagattttaaaaacagcaacaaacaaataagcatgaaattcgaaggtttcctaaggtattttgcagacatgctgtagaacagatgaaaaagtttgttagctagaattttgacttttacacaatatgcccctgggagaagaagattcaaaaaccactggagatttctttccttgtccatgccaccctttgccatctcatgctgtgaaaatctttaactctatttaccaagcacaaattggacttgccaaaaggttcagaaagtttatgacgacagtgaagagtccatacttcaaagaaagagctagggctctcacaaccacatatgtggctgcaccgtttccatcttaacctgagcatagctaaatttgtttataatctcctactgatagaacatggtgctgaatgtacatgagatacatttttttaaaagttagtcctctgattactaatttgaatccaaaactctaaccttgttagcatctggacttatttccataataacaaccccttcagaacctacaaagtaatgaataattgacaacaaatgaaatgttttgatagttgtcggcacaaagcatgtttaatgttttgtgttgcttcctagctaattatgtagatgacacatttgtcagaccttgactgccattagaaacgtgtttccagaggggagaaaaacaggctattcatagagtaattagctagaatgctcaatgacctgtgagagattcaaatcgctgccagttcagacattgttttgttacagagcagaggggtaattaaaattccaaattacagtcctatgatggagcatttgtttgttgacagtatactcttactctagtttgttaatttttttttaaattgcttctaatccattttatagctttaggagttccgtctttgaatttgctgacaactaatattatggtaaattgtacttcagctgagtactgcgtgcctcacaatttcaagggaccacaaggttggtgggataaaatagctccttctcaagactgacagatcaggtgctgtcagcgagaatgcctctaacatggaacatcttgtcaaatactgcttccaattctatatgagggggaaatgaactagtggaaaatacaaaggtagagaggaaagcaacaatgaacaactagaacggagcaagaagctgttctcccaataagaaatgattgattaagtgttctgttaccgagtaggagagaagagtgagagctgaggatgatttgggaaatggtgttgagattgtggtgctgagttcaaggcagaagatgcggccgtctgtaggagggctcacctagatcacccaaaggatggcatgtttcacagtaacacctttcatctcaggtcaataacaaaccatggaatgacagatatcattcatgagatgtttcaaggaaatattgggatagtttacaaatctagagggctaaaatagtctaaaaaattcagttccagtggaacatgtatttaggttgctgaaagtgagaatatagttttattaaaaagatctgacagaagtcacacggtgtttgatgcaggcgaactgacagaggcatccagtgagcgctgattatcccgaagtcactgtcagctaggattgattttcactttctccgtttatgtaacggttcctgtaatacagctgaccccgaatcacgttaccttgtcatttctctgcatggatcaagaagagatgagctgaaaatagctagacactgaccttgaacttaccagaaaagtgagaagtgacagtggggtttttctgtagttcatgtacagagacgaaggcacactgttcctctgtcgagttcactgcagcagcacaagggggcagagcagtactagagattacaggtaacacagcttctgcaacagcatggaaagactctgaaatacggagttagagccagaggtctcatttttacatcttagtttagacataaaggagaattactgatgaatcaaaatctcaggtcccctgatgttcataatcagtaatctaaaagtgtaccttctaattaaaaaaggttacctaatacgctgtgtgccagcaactatgcttttccactaaatttttgcagcatctcttatttaattcttataatactcttcactcttaaaataactttggaaccatagtcaatattattaagagaggtttaatttatggcaaactcccaaggtgatatgtgtcactttacatacaattgtatcagcagatgggaatattctttacatatttaccagatgttaacacccaaaaattaaaactggagagtgtttaatggcagtgtgcactcacgaacaggtaaaaggcaagctagaaaatggtgtttaccatttaatttacatttatttatgcctgtatgtcttcccattttaatatctgcctcaattttcaaaaatgtattttaatagatcatcattataaccttgattaacctaaaacacagtatgtcaaatattatcctttgcttgctagcacttagttaagctaaatcattgctgtactgatgctgaatgtttctgataaatggcactttaaaatcttggcaagtgaagcagagaactgaagcaggttgagaaacagaacagcaaacactgactcaattatcccccaggttgtaagtgccttatgtaatggcacggtagcatctttgcttgtgtgatggcacaataacatttttgcaggcctccataataactagactcttccttgtatacagtagattctatgtatgtgtacaggtagtatatgtatatatacacacacatttctttatttatatagatatatagaatatatacatatctatatacagatatatagaaatatatggagagatgtatttgtatataatttatatttggacctatttttatgttccaggagaaaataataacatatatatttacaagctgaaatatcaagattgcctcaaggttcttcttctgtaaatataactcaggacaagctgacaataagatcagagaaacaagtagacttccaatatgtttcaaggacagaataaataagagatcattctattgccaagaatgtggcagaaaatattcagaatatctgtgtcatcacagaaatctatagtacctagtttttgccctttggcagaagaaaagcacaagtcctctgacttagaaagatttgctatttggaggaggcgatataagtgggggcggcggtgtgtttatagctataaaatttgtgtgtctaaaaatgacaccttcgaaggcaagcctgaggaacagatgcattccttgagaatcacacaattactttgcctttctgctcctcagagagtgcaggagacctcttgcatggcctctcctaggtggaaggaaacccatccctaaacggttgattagcctctgcttcggaggtcaaggcagacataaaggtgttgtctgctaatacacttccccagagttttattttttgtttcattctttttctttccactgccttcagtgtgcaaggcttttaataagggacttcagtccctgatgtgttcagattcggtttattgttaccatctgtttaattatcctctcaggtttgtgttaggaagcattaaagtattttatccagcctttgaatccccatgttcctaaagagatgtgggtaaagtacgtgtcagttttcaaagagcatattaaaaactgataagcagaaccatctccaaacaataacatgtaaggcaaatacattttttttacattaatgcatgttacaactaattagcaaatgtacagcaatgtggcaatctcacggaaatgatgccatcttctctatatgaaatctcatatgcttctcctttgaggtgatggatttttatgattcctattcacttccaatgcactgacaataggtttattgggggaagagatatggaatttgatttgcaataggacatatagttgtcatatgtcaagcagatttatggatgtgctgaagttaaagataaatcacatacccagagaaaaaggacagaatgtttggggaaaaatgaaaaaacccaggggaaattcagttacttgatttttttctcctcttcctcttgaatttcctcctcattattattattagatttcatgtcatcattattattactacattgcatgcttttttttttctggagaaaaagcagcatgttgcttccagtaagcactatagtcactgttatatctggtgcagttttccatgtgcaaaaaccattgataacaaaaattacatgggctgacacagacgtgttatcagtttatgtccaaattattttatatatcactattttagtgaaatttttggaaattataaaacaaaattaagtataaatgtgtaagtatcaaaatgttttagatgtcagaaaccctgaaaatcaaacggaaataaatcatgcttttacttcctaaatcaaggaagccaaatgattaatcattattcttttttatgtatcccttacgaggtgatttcaataaactttttttctgagattccaagatgttattagatttaaaatgtatttgaaagtgttgagaaatggtagttttgttttgtgtaagtacctttccacagtaccataaacataaatgaccaaagtactgatctctttttattcctttgtgaagaaaccagtgctgttcttgccttatgctcttacattatctctgtgaaggaagaatagtgatgacaccaactttcctccactacttttggacactaaacctgctttctttcccacagggtaaaataaagctgctgtcttcatatttccaatgagaagggacatgtgtctccttgcattgaattgtcttagatcatatcatgtagcacaaagtgacccaatataggaagacaggaaaacaaagtgacagttttgtttgctctaatgtaaacgccaacatcaaaacatggggcaaatcctagaggcccactgccagaacacacaaattaaatagcaagagctgatattctgtacttaaaaaaatgtattcaagggatattctgtaatcagcagtgaaaggttaatgaacaaataagcttagctcaggttagacaaactgagtgtaactaccactgtttttaaagccatgagaaagtgaatctggctgatacttgataatacatcacacactgtggtcttacctattgattacaggctgacaatgggtaacctttcatggcaacttcctcttttaccatgaattattgacagtattaatgccaataacacatcatcaaataggaaagaaatttacattcctggatgtactatccttaacctccatgcctttaacgtcaagaaagaaaagaaaagaagaaagaaagaaagagagaaagaaagaaagaaagaaagaaagaaagaaagaaagaaagaaggaaggaaggaaaaaaagaaagaaaacaaaggaagaaaaagaaagaaagaaagaaagaaaaaaaatatcttctttcttgtcttgaaaatgctaatgaattacctttgacttttagacaggttattcatgtgacatcccgattattctcatccacaacacaatctgggtaacacagccctacatttaagggaatcttgctgttgttattttcaccctagtgtcctctaatagtttatagatcctaggaaattttactctagtggtgtgtcctaaggtctctgcattaataattcctgctcgttgagtggtcaccatctcaatcctgcccctgtgtgtgtccctctaagagtccccaaagtgggaaataggagaacacgtttcatctattcatttcatctatttatttatttatttgtacatttttattggcactaacagtatgtcagagactcctttgaaggctggggacataaaccaaaaagtttctctgtcctctaggaggttacattcaagtgaggtagaatctttacctggaatagcccagactctgctgttagctacctagacatcctcattgccactgccaccaccacctcttcaaactagtattagtgtcaagtacgttgcattttaccacaaatactttacactatgcttaaaaatggcctgtaaaaaagagacgttcacctcctgtaggatgaatttctgtgtgttgtatatctcaaatgacaagctttgattttttaaaacttcaaattataagaattccacctgattttaacctactttaaactcccttgcgcactttgacctatttcctatgtcttgtgtttggtgtacccaagctattgaagtactttctttggtaacaagtcaagctgctagtattcttatctggttagatttataatgcctcttttattcatcattctttctttttccttcttccttagtcttttttgaatttatgataaacttttcactgatgttgaaataataatttttatgaatacgaatgaaagtgttaatatatttgatgtctataactatttttgtttcaacacgaaaactgaacacagacataatttaaacttctacagagcattcaaaattttcaagttcttgacttaaaaattttactttgatctttgctactagggtctgactgagcattgtccttcaagtagccataatttatggggttgattgtggtttgtacatgatctaattataacttgccaaagcagtttttatcattagtgttattcttatctattctttattcttatcatgccattgtagcctttaaagtacttgctggccattttactaacgtgcaccccatcaaagcaaaggtaattacattaaccaggagacaaaataggctctactgagacctcacaattccttatttttcttacatatggataatgggacagcagtcttgctatgagaatggcccaggaaacccagattggattcagtatgcatttaagaccatggtttctcactttttgactgttaacctgagcttgccaccactcatgctgccctttctaactctgagccccctatctcccatctgactgctttgatgaaaccttgttccccaaggtcaccaacatgtacctagaaccctggttgctttttttcacctatgcttcagaggcctgtttcagacttttcctcatcaaaaacaatgacaacttcatgtttagtattcacactctagggtgaaaatgatgggtctaaacaggggttaccatcaagtggtggctccacccaggcaatatgaccagaggtactttttatttggttggaatggtgtttttaatagtttgaatttgaaagcctttcattagagttgtggtgttttcctgcaggttgcattacctgcttggccctaaggacatttgacttggtattcttaaagctgttctattgactggctgttcacagatgaggacataatgtggtaagtcagaaaataacaactgttggtcataaatttgaaaacttagaagttgacagccataaagcataaacttagaagtgtagtctttatcacatttcactggtagtgaaagtagcttatattacatagctaaacaggaattttgttattcagattttctcatttggacttaatttcaattatttatgtatttattattttagagacaggttctggctgtgttgcttgggctggagggtagtggtgcagtggcatgtttgtagctcactgcagccttgaactcctgggtgcaagtgcaagcaatcctcctgtttcagcctccccagtagctaggactacaggtgcacaccatcaatcctggctgtttttcaagtttttttgtagaaacggggtcttgctgtgttgctcagggtagtctagaactcccagcctcaagcaatcctcccaccttggccttccaaagtgctgggattacaggcctcagccaccatgactggtcctaatttcaattttagtctcttaaattattataaattaagaaacatcttgctgcctttcaagtaacactaaaaagtaaccatggttttctgtggaaaaggtgttctcttgtcatcaagttttaaatactctgtttattctgggttatctaagatttaactttaatcattctgaaaacttgaagagacgctactttgtatttaagtgaagccgtgcacttgtaaatcttatcataaagaatcacacaaggcccttacaatattatacaaaatttaaatcaacttcgatttaactagtcatctaattatcatcatttactttacattctcactaattaatttggagacttttaaactttgttagaatttttatttccttttccattgacatgtaacatccattaagaaatgaaacaacataaaatgaactctacaaacagtctccactcacttcttcatagccaaaatgtcttttttgggagcatctctgctttaccaaatagaagccttaatggatagagaagcaggttcacatgaggaagataatgctacatggccaagggcctctttagaatttctcgacttgcaactggcatgttgaattccacctaaagatgtattttattttgcctagacagtgctttctcctctttgctttctaattgagctgacatattgacattctgagatttcacatgaaaatttgtatttgtgacatgtctcaaaaaatcagaaattctggcatctggggctggttccccaagaagcaggcaataactagctgaagctaagtatctcttgcctcctctagatggggcaaattctccctagttcaaaacagtccagccaggcccccttcatggggtgtttttacctatctggcatttgagttggtgatgctggctttagcatatctattccaactttatttgtatgtcccctgaggaccataagaaactgagttgtcatgcagataactgcaaaactcctgtctcctttcagtataacttttccgagttgcctcctaggtaggaagaagcttttgaaataggagaaaatagttatttcatgtattcaggtggttatttgcataaatgaaactttggaacacattatcctttgctgattcccaaagacactaatgcccctgggacacacccagggcactgatttgaattgccaatgacaaatcaaagtgtcagtcatgggtagatatggaaagcatttgtgggccctccaggttcaatcagaactgtcagtggccctccaggttcaatcagaactgaagtgggccctccaggttcaatcagaactatcagtggccagtgtcgtagaggtagtaatgcttttgtttgttagttatgagcatgatacaggttcaataatctgaccagtaacattgcactctagccaggattagaaatatttttaggaagtcaaagccagatgtaaattatcccctcaagtaaatcttcatgatgcagattctataaaaattgtagaaaattgctattatcattatgccacctgtttgtataaagtccttttgtcaggcctggctctgtaccttcgagctgctctgtgtgcctcactctgccatttgaccatcacttttcagcaaatgagcttccaacacccacctacattctgaaccattatattttaaaccaccctgaactcttattcaacctgttcttgattgattgcagcttctgattcttagggaaaatcacctctgcgttttattattcttcctgtaacaatgtctgctgacttccatcctcagctacaattcacagtgagctcttacattacaataatacaaatgtttaccatgtggggacatctatatgtactcggcattatgctaagtgctataacttgatgagagactactttgtatttaagtgaagcagtgcacctgtaaagaagatttggttaatcccacaccactgccaccaacaaatacatgattggactgagatgtgactttaaagatacctgataccaaccaaaactcaagctttcgacatgctggggcacactctgtgttactgaccctaagccctgaaactctccctactgcatgcatttgtggatacattctgccatgttcaatgtggctaagagaatgagtgggaatcagatgtgtattctccgttatgcctattaaaattctattcaacttcagagagccaactaaaactcaaccccctgcctagttttctctgactgacctttctctcatctgaactcctataataattattcctttgattgattctgtaattgttcaccttgcacaactttagtgcatttctttctgctttattttaaaaacttatttatcctcattattattagtcagcattttatgtgttcatattatagatcccctgttacaatgaagactccgtgaagtcagacactttctctaacctcaacagaaccttgatgaaaataagcatttaatttttttcaacctaaggtactttaaaaggtttagaatattaggtggctagtaacatctaataatattctaatttctggagaaaacattcctgaagacacagagagggcaaaaacacaagaatagcaacaacaaaaaaatagaatttagagatacctcatagtcataaagctaaaggagctgaattaaagaagaaaaataatagttcagctatgcttcacctcatgaacatggagtgacctcaggatatcactattgtattcattgaggctgaaattggcagcttatcttttctactgcctgccttgtggttcagagtttatgatgtgcaaacccaccaaatactaggcaagcatccctgtgctacacaggtgttgttttctaaaatagccagaattctgttgctcttcgtctttgctcctctttctatatccatttagagactggaagtcacaggaaacaacacggcaggaagagtgggggactggcagtaaaataaggcatcctggagagtatagtaaccacaattatattgctaaagatggagctggagttacagaaagcaccagtagaaaggcaggctggggatttaattttttatgtatactaactacacccttacatcgacaaccaggctgggaaagttggagatgattccacctgtgtctagcaaaactatgctagtagtcttgttgatgaaaaatttgataaagaataatgcttatcaaactgcctcaagctgtacctaaccctaagaaaggaatccgtccacccctatgaataatgaattcagtccaggaatggtcacatgaccttctgtaaccattaaaggttccatttggctctatgtagcagaaaagtggacatagtgatttaaataaataaatctgtagtgggtttttttctctttttctttttaaatgtttgtataacaataattcagagcagttgctgtgcttggctaaacacattatcaaagacacaggtttatcatttttctccactcaccatctttagaatgtagttttttttttcctattgcctctcttctcatggccagcagatggctgctttatccttagcatttcagctacattccaggcaggaaagaagacaagcattaagggaagaaggcatgtgcaagatgaacctgctctcttttaaatagcttccatggaaagcccattcagcaatctctacttacatctcgttgttcaaaagggtatcaaatgttcacgtttagcttcaaggaagactgggagatgtgatttttaatcaggacacttcgctgctgcaaacaaaataacactggatagagattaaggctaatataagatcagagtgaattaagagtgaggtgagagtagggacactcctcagatcacacagggctttgcagtcgactacaaggagtttagattttattatttgatgcacaatcagaggccacgaaaggattttaagcacataagtctctctgttgggtaaagcataggttaggagaggaagagagaaaatggggacactattaaggagcctgtccatcctattctctattcaataaatcgtggtggcttgtgctagattggttgagtgggtatagatggaacaaaacaattaaaggacattgtcaatatagaactgaaaagagttgcagaggggttcgatgtaggtagaaagaaagtaggagtcttctgagagtcaagatggagaaactgggtggatgatagtgccaatcactgagacaggaagaaccaaatatcacagggatctggtgaggtgagatgtcaagtgggtcatattcggttgtgagaagcttgagatttcagtgcacaccgaagtgaaagtgtcatagggacaatcaattacgtgagtttggagctcagagaatagatatgccttggagatataattttgatgtcaacaaccaacagatggtatttaatgctacagaaatagccaagatcccattgagacaaagcgtagaaatataagagggctcgaacctttaaggagcctacaaagaagttaaaagactgattggaaaagggggagtgaaccagacgatgtcagttgacatccatgaatttcaataaagaaggggtgcccaagaagactcaaataaaaaatatatatacatacacacaaacacttaggtaactatggattcagtttctttgaagacaaaaatacttcaaaggaattgaaaatgagtcaaaactagtagatgtaaatattggtatatatgacctaaaaatattttaaaaaacccgagatgtttgtttcatgtacaagtattttggatataatttataatcatatacaaatatgcacagttatacaagtagtatttataattatatatttaaatgtatgttttgataaaaactaagcaattttagagattgttatatattgtaaatgttttttcgtctcctataaaagaaaaactgaaaatttattttgtacttttaactttcccataaacatatcaatcctggttcaagggagggaatatctcattgcaacatcagaaaggataggaaaatgtctggaaaatgataactggcttcaacatgcaaaataaatgttcaaagatagaatcaaagggcaaacatcaaggtaaatataaagaagctacacacagataataaagataatccacaaaacttaaaaaaaacctctaattttatctggagtaaattgagtggatattttgaactttatttttcatttacagtttgccccaggataaaatgataagctctattaatcagaaaaggttaatggcatattatatctttggtagattgataacagtctctggaccaagttgtttgtaacttctgttcaagagtacaatagtacctcagcagcaaatcacatgaaaatgtcaaccgtatgttagattttacccacttaaagaaaaaaatcccacaagaaacgttataggataatggaatgtgcaaaattaatcgcttttcaaggggtcgttccgagttttattctccttggttgaattccctccccaatttgcccctcagatatgcattctcttattgaacgatgtgattgtggcgactgtactggtgcccactttgagtcaacgtcgcatttatcaaacagttccctctcacccaaatattcccagtgtagtcactgctagcaatcctcctttatttgtactctccgtttgtacctggtggattatatattatattaattcataataccagctctgccaggctccctacagttacaattattaaagctgtaactgaaacgttatctctcatattgatcttcaaccagaagttcttgtcccgaagcttttgtttcacattaagacactaatgatcaccttcaccaaatgagcagcttaatagtcacaaaaagctaaatgaaaagactttgatcaccacctttgagagcactgtgttccaacatctctcccatccataattggcaaacactaactgagcttttaattttttttaaaaaaagaaacatacaaaatactctaaagaaacttattttttcagaaaaattttctccttttttgttgtgtttgccaagtatgcttagccctacctattctatttgttttccaggtcatataaagcatctgtgtgcctataggttatttctttatatgtgatttttaacaatttattcattttcttttcataagaactgagatgagttatgaattcagttgaagtgatagaaattatgcagcacttttgagtgcctatttgatttacttgttaaaagaattggtacagattaatcagtatggtctcccccatatctggagggacaatggagctactcaatggttctttcatattcacatttcctcctggaaaaagtagaataatgactctataatgaagtctttatacaaacacaatgtatcccgaaaaaatattaacaatatttttgtaattgatcaaatgggaagaaaattctctttgggtattaattagacatatcaacgttattcactccactgctaaaaaagtaacaacactacagagactttttatatccaagttttaaatcaactttatattgtagactattaattttcccaatgaacctgcagatgcataatctgaaagtggacactctgtagtggtggactatgcatacatagaaagaaaaccacagagggttaaaaaatagcaagcctgagtttttatgggtcattagctctttaatgcacctcaagggctcctaaaccaatgaactgagagtcttgggaagactctagcctgacccgagtgaaagaaatgaggaagagcacaagtattagcagtgctcgatgctattaaaatattaaccaaagactaatttgaaaatgtattaaccacatagtaagttaaggcccatcacagatcaaatgctaagttttgggacaggaagaaattggcgtaagtaactggcaaatattcagggtggaaagattggaagggagaaaagctatcatggaaaatgacctgatagccttttgaggccttgtggttgtcagagatccctgtgataatgatctgcatccattggtgcttcttccctgaggaggcaaatgcctgaaaaacagaagctccaatatttctatgggtgtggagcaggtatccgcatagcacagtgaagaaaagtagtggggatactcaccactctcattctcagccacagatcttggggtgactaacgctctctgaagtcatcttcagaagccactataactcttttaaagttgcttccttgaacttagaaatgggtgcaatattttgggggaggcctctctaactgctgcaaaccaccaatatctctaaggctattaatgatgatcatcttgaaaacccaacctagtagcagatgtggtttcaatggaaaaagaaagagtcaaatccatgtcagagaatcagaagagacagtggatgttgtctatttgagtaatataaaaaataaagtgatataattgaatagtataatatacataatacttgaaagaaattagtatgttatacattgaaaataaaatacgtatgtctgtctagagactatttttttaaagacggacagatttcaagggaatcattccacggttatgcttgaacacaaatgagttactatatcttcaaagattccttcagatcaacaattggtcatgtgaggaagagagatgacttaattcccttaagcaaaatacttcaggaggcttttgtcacatggttctaaggatttacaaaaattatttaatattgatggaaaatattaaatgagcaattatataagaaaacttttatattattcacctatatcaatgaaacattttactcagttttagttgcagttttcaaaaacaattgagaaaagtatttaataagaaaataaatctaactactttgttaatttaggttatttgcatcatgttattaaaaaagtggaattgatattcatatgcagaagacatgctatgaataaattaataattatatatcctaaataagcttgagttttgggcagctagttaaattattacatgatagcagaggatgtatcttctttcttttgtcttctctgtcatttaatattaagtagtaaaaaaaaactagtaaataagactaagaataatcatgtactgctcaggtcttttttggttgtaaacgtagaaaccccatttgaactagtttagaaaagaaaaaagagtatttgcttttataacacatattcatgatctactgataaaccatccccaactgtgtatttaacttacaaatctgcagtttgggcaggattcacaaggcaaggctcatctcattggctggggcagctccacttaggcctgaaagatttactttgaagacagttctctcacatgattgaaagctaatgctattgtttcctgaaagctcagctggggccgagggttgcagattggagggggctctctttccttccacatgggcctttccatggcctccttcagcttccttatggcatagggactacgttccaggagccagtgttccaagaggaccagaaagaagttgtataaccctttatgtacaagttttggaagtcttaaggagtcactttcttggcagttacagccctgccatatctaagggaaaggaacatagattctcacagtgaggagtattgtgaatgacttggaaaataaaatatgcgacataactgaaatttagatatgctcttttctctatctgtgcacctttgcctctcttttatatgctgtcttctttttcctctgttaagacagtctttctccattaagtgggtaagatgagagccggctgttcacatgcttagagtactctgtcgtagaattaaaaggaattcttctccatcagcttgagggggaataagggcttaaaaggcaaagttagaatttggacagtactcgtcagaaacataattaggaaaaatagtccccactctcaccaagtatgggttacattcaggtcagacaacataaagaacatccactaaaagttttgacaacagaaaagggtcttttgcattttgctgcctacctttcactttcgattgcatactcatttgtttattcactcaagtatctgtacttacactctctgacagggagtgttctacatcagtgattctcaaagggtgatctagggatcccttggggttcctcatcctttcagggggtccaagaggtcaaatctattttcataataattctaacatatgatttgcttttttcactctgatttttataagggtgtacagtgaagccttccagagcctacatgacatgtatcacaatagtgaagagatttcctgctgtcttctcttaagccagacattaaagacatttgcaaaaacacaaaccattgcctctcttgtcactgaatttttctttattttagaaaatagttattttattaaaaatatgctatttgtgttaataagcaatgcatttatttactgtatctacttaatatgtgttattaaaattactcaaatttagtttctaacaagctaaatgttgatagttgtaacccacattaacaaggtctttaaggaattaaaaaaatttttaagaatataatgtcctgtgaaaaatgtttgagaacctgtgtgtaacttgaaatgtgatatccaacaaagcaaacgaagcctctgctttctgagtacagaagagatgccagcctacttcaaggaggattacaagatttattatgccgcaccataattatctatcaatggtcaaggtcctccacaaaactctaagtttctagagggcagagactatatattattttcagaaaaaacttcaaaaattatagttattttttcaatgagaaatacaaaagtattcaattttaggcattcatgaactccattgaaggatgaaatttttcttattaatttacttctaaggtggcaataaaaattgagaagttatcagttttaaagaactcattaaaatctaaggcttatcagaaattgatattggctaaatagtatctaaagtgacatataaatgttcatgatgtctgtattgaagaattcacgctaaataaaatggtattatgttaagtgcattttactgatttggggttgttataaacctacaaacaaaatgttggctatttttcttcttttaatttttaaattttttattactattattttttgtagagatgtgtctcgctgtgttgccctggctggtctcaaacacctggcctcaagcaatcctcccgcctcagcctcccatagcactgggattataggcataagccactgcgtcaggcccatttttctgatcttgtgttaattttcctgctactgagcatacatagtacatgcttcatacattttgagtttgattgttttagattagatgcagattgtaatatagaaatgcaatatagaattgcttgagcaccgcttttcatcgccagtctggaatcaccaatttattttctttggctatgattttggagtctttagaaagcaacactaaaatcctagaggtaaagccttaggctcatttagaatgagaaatgctcatttgctgccatgctaaggtgcatgcaattatccagggtacctggcaattaacacccttctctagtgcagtgattacctaatttggctaagaatcattagagggctttttaaaaatacagattcctgcacctaacctagaccttacaaatcagaatccagcttctactatttactgagtgtcaaatgtttgatatctcaaagctaaacaaacaaacaaaatctaggaagagtccctatatttgcctgtctctgttttgaaactcagcctatgaaacaaagagcactatatcatagaagtcatcttgcattcaaaagctacaaatatccaccttatatcctgcctataagtctccaacttcctcttatgtcttaagaaaagtctagacatagctcaactgtgtctaagcaaatctgtgcaagcaaacttcagatatattgcaggtttggttccagactaccaaaataaacaaatattgcaataaagcaagtcatacaaaaattttgatttcacagagcaaataaaagttatgtttatactattctatagtctattaagagagcaatatcattttgtataaaaaacaatatgagccaagcgtgatggctcatgtctgtaatcccaacactttgggagactgaagcaggaggatcacttgagccttgggattcaagaccaaccttgcccatgcagtgagaccctgtctctacaaaaaattaaaaacaaaattaatcgggcgtgcttttccatgcctgtagtcccacctacttgggaggctgaggtgggaagattgcttgagccctgaaggtggaggttgcagtaagccatgattgcaccactgcgctccagcctgggagataaagtgagacattgtctcaaaaaaaaaaaatgcataccttaatttaaagaaatattattgctaaaaaatgctaacaatcatctgagccttcaaagagtcatatcctttttgctggtggaaggtcttgccttgatgttgatggctgctgactgatcagggtggtgatttctgaagggcaaagtggctgtggcaatgttttgaaataagtccacagtgaagtttaccacattggttgcctctttcttttgtgaaagatttctctgtagcatgtgttgctgtttgacagcattttacctacagtagaatttctttcaaaattggaggcaatcctttcaaactctgctgctgttttataaactgagtttatggaatattccaaattttgtcgttccagcgacattcacggcctcttcactggggtacattccatctcaagtacattctttgctcatctgtaagaagcaccttctcattaaaattttatcatgagattgcagcaatttagttacatcctcaggctccacttcttattctagttgtcctgttatttttaccacatctacagttacattctgcattgaagtcctgaacccctcaaagtcattcataaggattggaatacacttctttcaaactcacattaatgttgatattttgaccttctctcatgaatcatgaatgttcttagtgacatctagaatggtaaatcctttttagaaggttttcaaattacttcgtccagatccatcagcggaatcactgcctatgcagctatagtcttattaaatatatttcttttttttattatttttttgagacggagtctcactctgttgcccaggctggatggagtacagtggcgtgatctcggctaactgcaagctctgcctcccgggttcactgcattgtcctgcctcagcctcccgagtagctgggactacaggcgcccaccaacacgccaggctaattttttgtatttttagtagagacggggtttcaccgtgttagccagaatggtctcgatctcctgacctcgtgatccgtcgcctcggcctcccaaagtgctgggattacaggtgtgagccactgtacccggccttaaatatatttcttaaataacaaaactctaaagccaaatttactacttgatccatgagctgcagaatggatgttagcaagcatgagaacaacattattgtccttgtacatctccatcagagctcttgagtgactagctgcattgtcaatgaatagtaatattttgaaaggaatctttttttttgagcagtaggtctcaacaatgggcttaaaatattcagttaagtcatgctgtaaactgatgtgctgtcatccaggctttgttgttccatttataaaatacaggcaaagtatatttagtatcatttttaagggccctaatatttttggaagggcaaatgagcactggcttcaacttaaagacactgataactagagaatcagcctgtcctttgaagctttgaaaccaggcattgacttttcctcttgagctatggaaatcctagatgacatatttcatataaaggtatttcatctacattgaaaatgtgttgtttagtgtagctagcttcatcaataattttagctggatcttctagataacttgctgcagcttctacaacagcactttcagcttcaccttgtacttttatgttatggagatgacatctgtccttaaacctcatgaactaacctctgctgccttcagacttttcttctgcagtttttccacctctctcagccttcaaggaattgaagagggttagggccttgccctcaattaggtgttagctcttaagggaaagttgtggctgctttgatcttctatccagaccactcaaactttcttcatagcaacaagaagtttgttttactttcttatcattcctgtgttcactgtaggggcacttttaatttccttcaataacttttcctttgcattcacaacttgactggcacataaagcctagatttcagcttaacttggtttttgacatgctttcctcactaaacttaataatttctagcttttgattttttttttttttgagacagaatctccctctgttgccctggctgggtgcagtggtgtgatcttggctcactgaaacccctgcctcccgggttcaagtgattctccagcctcagtctcctgtctcagatactcccagatacagagtatctgggattacaggtactcagcaccatgcccacctaatttttgtattttagtagcaatggggttttgccatgttggccaggctggtctcaaactcctgaccttgggtgatctgcccacctcggtctcccaaattgctggaattaagtgagagatatgcaactcttcttttcacttaagcacttacaggccattgtagggttattcattggcctaattttaatactgtggtatctcagagaatagggaggcagaggagagggaaagagacaggggaactgccagttggtggggcagtcagaacacacacaatgaagcttaataaggtgaagcacaataaaatgaagtatgtctgtacttatattttccttctccacaaaacatttccctaaggggtgtgcatgtgtgaaagatgggtggtggggaggaaaagaggagagagaatattgagttattgcaggatcaactttgctccatgaactttgtaggggcttttacttacttacccttgctgccgttcaccagcaaatctcagtttctagaaggttgagaattaatacagttttgaggactggccctagtaaggcaaatgtttgagggtgaaagaaactcagagacatttgaggcaatcacgtgcaacagctggactaggtgcctggcagtagaaagctcacaaggacttaggtgagatggcgttatgtaataagagatctgactgtatgtaacagggcacctactaagtagcagggatactaacaacataacctaccaggaaagagaatgagcaggacctcaggggagaaagcccttcaagcagcagagtggttcagggtaaatattcctcatcactggaaggatcaggagaccaaaggccagctgccaggaatagaagattaaacttaacagattaagccagtactagaagcaggtaaaggagagagggaagggctacaagaatgcttacattagacctagcacttcggcctaactggcagcaaagattcaaagtgggatactcactgactttgagacttgagaggctcactgaatatgtattctctcaagatagtagaagagaagggcctgactgtattctggcttctgttaactggttctgtagctaaactaagcctgttagaagagctggtcttcagataagcaacagtaggagaaagtcagcttggctgtgaggtgttgtcaggtattgtaatttattcataacaaatacactgatttttcatgaccaatgactaattagcatcagcctaaagaggtctgtattgttgaaattatagagacttaaggtgtctttcagatgtaagccatgttttttctgggtagtgggaacaacaatcaatcaggaaagtgaaaacagcatcagtgggcaccatcagaggctacaattttttttgtactgattcaaacatatcttttaaaaatgattaagtatataaaagtatctaaaaaggataagataagaaatacgagctcacaaagggggaataaaagtgtagaacagccgaaagggtccctcagtttcaggccgagtgtgagaataggacactctaaaacactttaaaaatctctaaatacccagagatttctttgttttggattgtatttttcttttcttttttttttttttaaagctaaagatgaaatgctgtcatattacaattttgtttactggaagcaaaattgaccaaaagaaactgtccttaaactgaagtttaaagttggaacctcatgaaaagacagtctttataaatgatcaagttggcatgtcagggtaaaagacaggaatgtaagattaggcaaaccagaattttctctgctgtgattgcccttgctcttgagagctcgttctttctctttgactattagcccatggcagttgactcaactagggaggtcagcttctcagccgcccaagtcccaggaagaaaagacagaaacacgtaacctgaaatgacacagccgctgatgcagcttgttgctctgcttgcttatattttgaagtatatcatgtaagctgaattgcaaagaatagcattcgacagggtgaagggttgcatacactgaagaaaaggcaagattcttggtgaggcaaaagtctgaaggacaagtgcctttagcatcaactgaaagtcttactgtataatatgacctcaacaaaattggacagtgctgcatagtcaagaaagggatagcaaactgaaagaactgatttagtggtattgccatctagctagcttacttaggaattatttctgatgactttaatttcaataaggcaggactaattcctttatccacatttccatctatatctttgttggatgtttggggatggaagagtccaatagtaaaagggaagtagattcttatgtggcctcaaggaaacattgtgtattagtatgggactggataactagttatctaatatctagttactttatatatttgagcataaatttaacaattaatgatactgatttaagagactgattttgtcaatcaaatgacattttggaggtaggtaaaaaaaaaaactaaaaataatcccgcctagctaatacagtccttttcttgctgttgttgttgttttaagacaagttcttattctgttgcccagactggagtacagtggcgtgtttatagctcaccacagccttgaactcctgggctcaaacactcctcttgccttgaggtaggcaggactacaggtacaccacgatgcccagcttttttttcttttttctttttttttttgtagagacaaagtctcactatgtggctcagactggtctcacacatctgacctcaatcaatcttccctcgttggtttcccaaagtgttgggaatacaggctcagccaacacagtatttaacacagtattttgcctacagaaattactcaagaaatactcgtttaaactgtagctcaatttcctcattttccaaatgaatgtaataatttcctctatataatatagtgctctgctttcacaaaatgagtttaatatatgtaaaacaattttgaaaaatgaaatgaaacatttttattaatacgttccgattgagtttaatatttatcccatgcctgctatgtaccaagtgctctgctcatctgtttactagaatggtgtggatatggtctctacttaaaagaaaaataatctttttctctttaatttacttcgtccctattgaagttttcattgtcccattgatttaaactattgacacatagattgaagcttgtatactttgaacttatcttgtatttttctttgcttcaaacttttggttctctgattggtttttaatctctgattgtgctgggaccaggtcataatcacatggaagtttccttcaaactgcagtctcctctaagattctgcaatatcccctaggagtgctaccccaatcctataattactgcaatatgagtggctgtcatttccagatgtgtttccttcaggtgtgtttgagggtggtcaaaataatagagatcctcattcccgatagatccttgtttcatggttagaatgcacttcaccttcatcatgtactatggtatcaatcattaactgctatcataggaaatctatttattctttgccagcaccattagaaagacttcataaaccaggtaaaagtgctttctcttaagcagaaattttaaatgatgttttgtagcataaagtgacaatatatatatttaaaaattttctaacccccaaattcattagtttcaccaagtgcttccagcctccatcttagtccttttcttctttaactttagaccccaaattaacttctccagagctccctacaacgtatcttgtttcttgagggggaaaaataaacccccaccaaattcctgtaaaggatacttaataaatagtcattacattccttcaataactttaccattaagcttctgttgagtttgtggctaacatttcaaaaataatctcaactttttcttcttattgctgctgagttgggtgtgtctttcattgtggctagatgagggacataaaattagtggtaaagccacaaataaccagagaaatttgataatatgaaataggaatacaatcatattttctttgtttatgaataaaatttaggaatctctatttaaataatctcgacttatgaagagcaaaaatgtttgccttttgcactatgaaaattttactttaaaggttattctgttaaagttttctgttttaaagtttagctatacagtttttgttttaagagtttataattcttgttcttggggggaaaagagttagtattacaaaattcgtttatattaaacatgtcctttttgcatgtgaccaaaatcattggttcctaggtatgttttgcacctgttcatgtcctgtgattttagttctccattcctcatctttgaattgccactgatttcaaatccctgtctccaaaacaatataatgaccattctctgttagtctatcttcaaaacattcccacttggtcctatattttatcagccttcacatttccctgaaaatatcccctaaatgaaccacagaggattctgtgctaaatgcccaggaccacaatttgggaatcattactctatgtgactgatttctcccgaaacaaacactttgatcatttaaaaatgatggctcttgctgagagtactaatgagcaaattcgtgctttgtggtttatacacaatggaggattaaaaatgggttcagaattggactccctctttagtcttccaaggggaacattagtgagagagttatttttaaaaaattaatcctattttggcagcttcccttgatttgaatatgaaatggtgttaagtaggtgaccagtgaaatgactttctcttttctttgtagatgtctgtaaacagtggaaatacgaaaatgtttctgtggactttctagatccaaggatctagtggcccctcacccgctaataacagccaagagattattttgcagctcctttcacttagtgtctagaaagataaacatagagttagataatagcatgaatttttttttctgatatggtgcgaaagcaaatgtaagcatttcactagttgactatttcttggggaagactcatttgtctgtgtaaaatgccttcaaagaccaagaggaagccaaggccacagggaattagagaagggctagagtccccacattcctttgccttctcctttaaccccgactatgtttacagcccttagaaagtgcattagggagtgagtcttcaatctgaagccttaagagcagaagggtatggcctctactttaaaaaggtattgtttggataaagaatgcaggggttccttcgatgataatactagctaacatcattgagcacttatttcacactgcccttgaagtcacttcagaagtattaatccatttgatcactccacaactctaggaaataggagctattattgcctccatcttgtagatgaggagactgagacacagagacgttaaacgaattgccctaagccacaaagatgagaggtgcatgcagtctttgaatctactagttgctaccattgtaattttgcgaaaattattctctgctgaatcatacttataattctttttgtattccacttatattgaaggatctgataaggaagtgggacttttcatgatgtaaattgatgggtgagagctctcatttatccaattaggtgggagaatagcctggtccctttctctttctttcaaccttttgaagaaaaagtttctttttaaaatgatacattacattgtaatcaatatttatgtttattaaagttatacatgaagttaagactttagtctagaaaacttttgattcaacatagcatttctctgacttctctacctgtctattcatcagttccccttcctagaggcaactgccttcaacagctttgtttttttgttgtttcttttttgtattaaccttcttttctttttaaatattacgcatatactgttttccctgatttatctgttctaggcattatgcactttccgttactatagtttaatatctcatttacacctcacagcttcttcccttccctctattgtttcatcatagtttttcacaatttttagttcaattactaattgacattattattttctaaatttttccaactatgtcaataattatataaacataaatttctttgtattcaattttcttggatggagtaaatgattgcctaaattttaattttacttatattttatcataactatagctatttttccaaaaatatcaacaaaattgccaaatatctatcttttggccaaacactgaattattaaataatgtagtgcctccttttaaaaaatttcctcccattgttctccatctgcttgcttaacacatcttgaactaaaggctctattggcctaacacgcagtgcagaacatgtaacttcttgttgccatgttcctatgttcctgtgttcctgtgccttattattttgtcattattattattattattattattattattattattattatttgtctcccaagctagagtgcaatggtatgatctcagctcactgcaacctctgcctcccaggttcaagctattctcttgcctcagcctcctgagtagctgggattacaggtgtgtgccaccatgcccggctaattatttttttgtatctttagtagagatggggtttcatcatattggccagactggtctcgaacccctgaccttgtgatccacctgcctcggcctcccaaagtgctgggattacaggcatgagccaccgtgccggcccctatgccttatttctaacgatttttttttttcccttggtcaaatccttcattttgcctaaacacttcccctagttgcttccaaacaagaatatagtggaaataaacacatttagtccttccatatcaggaaatgtctttacttaatgctatcatttgattgataatttaacagattatttaattataggtggacaatattttctcctcaaattttgaaagcattcttctagcctccagtcagttttagaagagtccagtacgattctgattaccaactttttgttgtaagtgattgttcccccttcctctctcttccacatacactatttttggaagattttacaatcttttcttagccccagtgttctgtaactatatggtccttcttgttcatttattgtacagggcacttggtaagctctttcagtcagaggctcatatcgtaaaatttggagacattctcttgtacttcatgttaaattctttttccagctattaaaaaaaaattgttcttttggatttttctattaggtagatgttgaacttcctactttattctctgatcttttctttctttcttttttttttttttgggagacagtctcattcctcattgcaacctcccctctcaggttcaagcgactctcatgcctcagcctcccaaatagctgggattacaggcatgggccaacacacctggctaatttttgtatttttagttaggatggggtttcaccatgttggccaggctggtatcgaactcctgacctcaagtgatccacccacctcagcctcccaaagtgctgggattacaggcgtgagccaccgcacccggacttgatcttttctttctactcgtgtgttcgcttttcctgatatttttgggttagctattttttcctccagaaatttacttgatttaaaaaatatatttatatttttactttcctaatgccactctcatttattatttctgtttttatgaatcttatatattttcttattttaattacagtgctaatagtttttgttcgcttgtttccatctgtttcttgtattatttctgcttactttgggtttctttctgtttgcttattttgatattcttatttcatttcacaattttttctaaagattgtaagcttcatgagaacagagagtgttttatttagcacttgaaacagtatattgcacatattattcaatgttattattcatacaataaatatttccttaattattagttgtaagttagtaagtagttaatttatagtaactcatatctgcctattcacatttttaaaagaggcatttaaaatgctgattaaaatttccttgtgtttggagcaggggcactggacttcttgactgacagtcttctctaaatcaatcacattatgaagctgacttttcattgcggatatccaaattttagtgtctgcaggacctgggagccattcacttctgctagagaagactcctccaattttctggatgaagggatatatttttgcctctgacatatctgggaggttgactgaggatggggactaaaagtcttgttgctaatgaggtagattttaatcccctagtttgcagtctcacactcacctcttccctctgcaatgccaagtgaccttgagtctagactctagaagcttccttgtttaattttgtctcatgaaggtctgggagccgtcagctgactatttgcaatgggtgagtaagcctgggagtctagcctttctgaatgatggctgttgcaggcagtcttgaccatatcttcatggtaccaggcactaccaagtgatcagcctcttggatattctgtagcgaaaggcaaatttgttaacttctttgtaattaataccttcatccccacaactgcaccccgggagtgcaggggtgcaatctcggctcactgcaacctccgcctcccgggttcaagcgattctcctgcctcagcctcctgagtagctgagactacaggcgtgcgtcaccatgcccagctgatttttgtatttttagcagagacagggtttcaccatgttggccaggatggtctccatcttttgacctcatgatccgcccgcctgggcctcccaaagtgctgggattacaggcgtgagccaccgcacccggcccacctatctatattattatttcttctccaagaaacatttccaatcaaaaggtcaggtttttttctttagaaaaggaacataaaccccaagtattatatatgctacgcaggtcgaggaactagtatccaaagtatgatcagttatttcaattaaagactcattgtcgggggtcattttgaaaattctatcttatttcagtaagagtagatgtcaaagctcctaagagaaattatggaagtccacctggaaaaggcttgcaactgacttggttcgtattttaaaaagaatgatgtatatgtttctaacaaggtatcttagggtaaagctattgaagtttgtggtgaattcaaataaataataggtcacatgtataaagaggtacaatataaaggttgaaaggccaattccaatatagtgttatacactatgctaagtattgcagatttaaagatgaataaaacatgccccttgccctcaagagtcccttgataggacatctgcttttcttcattttcaagaaattagttgtatgtgattcttactgttataatcttgggatgtgacaagttgtgagagaaatgatttatcagggaactttgatagctaaatcataccacagcaatcagattaatgagttttggatcaatctagtcattcttttttctattttcaccagaaactcctaactcccaatttagcttcaaataatattttttcaactataccgatttacctcttctttgactagttctcttttagaatacatctaagtaagtggtactaacctggaggtaaatgaaggacccatcttttataaaaatgtgctgccttgaagaatttttttgacagaaaaaaatggcagactttctcttataaaccgtatgttcttacatttctgatatctggaatcaacagcttgccagaaacatttccaatcaaaagccagactaacccataaaggtgtccaaagaagtctgttctgattactgaagatgttgaactagtcttgacttcaaacagtagatatttctacactttagtggtatatgacagctctattcattccacaatgtcaaattctttggttttggccattgggtatttatgcacttctggctagggaagcagagaagcctaatttgattctggagccaaaagtttttaggccctgttcctttggaacttggactggagaatgttggcactgtataaagactaggacagatcaagtagtcacacataactaactgactcaacagagcatattcagagagaaagatcatgcctacacatggataaccattctccaaggcagactaacaacaccctgaattcaatcacccctaaataaacacacaaggaaagcacagctttaacataccttccggcacagctctccaatgctgcctgattggttttagtgccataggccaggctgcagatgcagccattactgttgttcttacttatgtctgtctgctgtctgctaacaagcattcatatgctttggatcattaaagtcacaacctcctatgccaatctattcctctccacgggtttgctgtagatttgaaagagagatgctatttctgtttctttttctttccattaagacctccagtcagggttatttctgaggtctgaatatcctagcttgtacccttgccctcattgaacatataaattgtgttccattaagtttgttctttttgcctgatttatttcccttgctgttgtatgtgcctttttaatgcaaggcaaatgatttgtgctggaactgcaacagacaaaagtgctgtaacttaagctgcttcctgatgccactgctatctatgagaggtctgctgtacttacacccatggtaaatatcttctgacagactccaggtggtcaggattttcacaatccaacccatttcagtgttagcacttgtcatgtggggctctgtgaattcttccctttcatcttactgttggtggcaggttggatacatttggacatacctgtacaaggccacatgtgtccacagttataatcgaaggtggagaaacacaagtttctctttcagggaagcacagaggacagatattgtacaaagaaaaaaagaaaaaaaattgtcacttgtagtattatgcaggctgcccatctaaacccatcattgcctggcacctacacactaagggcaagaatccagccaacttgtgagtgggcaccatgccatttgagcagatgggcatggaagtcggcagccagtagaccatgtatgtgcatcaacggtgggtgttgagggcacgattcccagaggagaatgtcctaacagctgtctggcctgagccaacatacttacgaccaaggaaaagtgccatccttcaatcctgctgagttggattaaccttcagaactaaatctgctttttcggcagcagaaggtgagtttagggtctctgaaaatctcaaagaataagtgaagaaaggaaactgggaggatacaattattctctattgactaaagatactgaggacattcaatatgcttattttaaatctttgactgagaacctgttaattcttgaaagaatgttataattgttcaaagcttggcttcccacaaagctgttaaaagtgacctttaaacataggcagaccattttcagtgagttaacacttttccacctttgcattaagaaatagtgatatatgaagaaaggtgtcagtagactactgacagctgactgtgggtagatatctttgtcaaacttgacatatcatggattaaattagatctatcatggatcagagctttcacaaaagagaatttcttcttcagtgatggaacatacacttgaagaagtaagaagtaaacttcctatttcaacgaaagcctttctgggcaatgaaagaaacatttttatttgagactgaaaataaagcctgattctaatttgttaagaatttccagacagttaaacatcattaaattagatagaaattgtttctgccaaacatagccaaatggtgatttgacaatgatttgttttacttggttaggaataggtagataattttaacattcagatccttaattattttctatgttgctttcttatgaggtatttgtgtggtagttcttgctattgttttctgttgtcttaaatctttttattttaaatataacatatgactttagttgtggataaaatatcagtttggttcaagattatccacctacgttttcttaatctactccctaaactatttcattttgtttatatcaagagagtaagtgcttatattattgggagtgaaagagattaataagttattttatctgctaatggtaggaactatagctttggctttgatgaattatataatgtcttagatctaataccattagtaacattatgagtagaataaaatgtttatatgtctattttggccctgagtttctcattatatcaatttagaaattcatggctaaaaaatacgtgattctacagagaaaaaccaagaaaattatattacttaggcatctctgagtttcttggctctggtggttcttatcttaaaagccgatttgaaggctaaaaattgtggtatgtccaggttccatgtgaatgacccctctctgtctgagaaaacagagagaaacgatctagcgaaaatatacaaaaaacataggggaaagctaaagggaatggtattcagcaataagcaagaaaatgtgtgtattatctataactaatttttatttaaatagtaaggtcatgacgcagtttgattttctttgtggaacacatgtgtttgggactaaataaagcagagaaagaatattaaggagttagaatcattttagcaaacgcttccctttggctatctgggatataggaaaatgtggttgaagctgagttaaagtcagctagacttgtgccaggagcgagaggctggtgggcactgcaggtgatgcagatgtttataaaaaaaaatccacacttttttaaaaatctgataaacttttatttgtcctcaagaaggtttttgaatcatttcctttcattttgtgccagggataaaaaagaaaataagagtgtcagatttctgactgacaataataaacaatcaaaagaggcttagggaagagcccccctcccaaaaaaaaaagagagaatatttgcttctgaatgtccactatggcaattgaatgatattgtgggcagatggaggaaagtggaattgtgaaacaatttacttatcatacactaataaggaacaaaacagaaaaattgcatctttctttcgtttatgacattggctcccactaggattatgaaaagatgcatttaggtagtgttagaataattgtgggacatggataaattttacatgtgtccacaaatagttaaaattagaagattaactgtaaagaaaaaaaaagcttcactaactttccttaattcctgattgtaatagctttaagaaatagaatttggcaaaacaaatgaagatttgaatgtaagaattgggatacaccaaaaaaacttttaagagactgtagagataaaaactaaacttaaccacagatttattgctgcttttcatccaagtatccagggacgttgctaatgggaggtacgcctcagaaacgtacatgtctgtgaaaatgttggaacaaactaatgcttttcttcaagtgattttatttcaattctaagccacaagatataaactttcatcaaaaatgggaatctatttaaaagcagagctatgaggaatgtttcatgtttatgtataactttcatagtagaccctcctacacacggaaaataatatgcccaaattctgttatttttacagtatgtaatatatcacatactaatcccacccatcagtttcatatcctttaaatagataaaaatgaaaaagggatggaagaaaaaatgaagacactttgaaaaactgactttttaattcctctttttggagaaaaagatatctgaaaaacttaattatgatccatatcctaataagaacaaagaggaatttgaaggaaaatacgcattatatattcagaatactatcttttttcatttcgctttgcacaattagaaagctaagtacctggggaggggaagaacagaagtagaaagggagagagtggtgggtggtgataaataaggaaaaacacagattttcagtaatactaggttcaaaataatccaagtcagaagaattttatatttcaagttttttcaatggtagttacaaatcattcctatttgcaggacgtgataattcaataggaaatagtgccattgaaaacaagattgcccacacgcagtaaaaagataaggttggactctttttttctccccaaaagaagggttaccatcagttcaaatatttatcaggaaaactcagttgcttaatatgcagaatattgtaataaaaataatttaagacataattatgccaccttgaatgaaactcttaataaacagatcagagaaacagaattgtcagggccccttttctttttctaaaatattgcaagtaaattaagagtaggaattcacaaaatttttcaagtgggaattttagcatgatattgaaaccaacattccatcatttataaatataagaactagcaaaataaatgaggctgtgaacatttaattatgcaatagacatatatacatgttctattctgtttagaggggggacctatatactatataaaaacatttggaaacaaaataaaagagacatgcataaacataatacattaaagcttctcagaagctttacagaaatgcttctgtttttaagagaaaataatttattgaaataaagttgtatcaagctactgctaatattattcttctattcaagttttcaaaattcaataattaatgaacaattctagcaaaagcaaaaaggattgaagatcaaatgttggaaccctcctttgtcagcattctgaaacttaatctaagcaacttgaagaataaaatgtagggtttttatatcagatacattttaaaagttctgagattgttgaggaagaatttaaactactgtttaaaatgaaattctctctgcaatactggtagtagagattttataacacaaacaaacaagtatattttgatcacttactattagaaattactgacatatggatgtactaaatgtgaaatgttttctgggtataaataaatggttcataaggacatctaatgttttaagctggaatatttgtcaagagcatgtcccataataatttgtaaaattgtcagataataataataagctattaatcgatatctatataagtactataacattttctgttatttatactatggcttaggagagacttttttcccttcaaacttacttgataagattttggttgacccaagttttctttataattattatttcaattaagtatattatgtaaaaacaacctgaaatattctaatttttgctgatatccatgcaaaacaattaagccattttggatccagaatttcctaagtcataagtctcagtcaacataatctgatttggagtgatcacatatttctttgtctaatgctttactgagaacaacattaaagcaaaagacaggtgatgaaagctctcttttttcaacatcttcataacctggttgaaaatgatagattggctagtttattgatttaggaatgatcagcaatattacttcccctaaaggagtattaagatgattcacaacaaatttgaacctgatttctagcatcctgtataaatgtgtacaaattcataagtctgactctaaattctaccttagaaatatctttttatgcacgtggaggctctcaactttgtagttccccaagaatgtagtgactgcctacacacacacacacacacacacacacatacacttatattgctggagaaacaataaagtgtcatagttgagcttattcctagatctaggttaaaatactacctatgcctttcattagctatggattttcaaagttacttaaactgtgtttacacttcgatacttataaaaatggttaatattattaaccttttaaggtttgggtgagaattaaacatgctaataaatgaaaaacatagagaaccatgcctggcagataataagtactcaatatatgttagcatacaatattatctttgtataaatttctcaatttgcattcttatttgtaccatggactcaatgggcccctttaagggtgaaataagtatgtgcccagtttctattttgagtcttcttatttagatttgtttcccaaacttcaatcattcacttgctatgtttgtgagttttttccatatttcataccataaattacttatttaattatattatttaaacttaaatagctttattttaaaataaaatatattcataccactagtaaatggttttggtgtgatacatttttctatgaaaccttaggattttataaatcattacaatgaaaacactcatcagctaaaataatctcttatgctcctaataatatgtacaccacacatttccaaacactgctttaaataaaagctttctataggtgattggaaaggaatattaagaggcaagtgggtctgtatgcccataagaatttagtagtggtcagatgaaagagggcatggagctagccatagaagaaatggtgcaactgacatagttaaaggccaagtgcccactcatcaatattgtggagacatttacttgctacttctctaacacttaagacttgagtttctttactttccaggagaattacttttgtcctaagaatgggaatctagttgggttttaaggaaatagaacaggaaaactccttccatcttggaactcttccactcttgaaagttaaatataagacgtatgtatgaaattttcagtggagagtataaatcttagtataatgagtagtaattaagagtagtacattctaaatgtatagcaagataaaataaatttctgtttttaaagaggtttagataccaaatgcatatattctttcactcctgagaagaagctgaagtatcagtggataattaataagtgtgaattttgggtttctacgatcactcccattaactaagtattctgccctcagtttcctcatgcatagacctttcatttagacgttaattgagcatcaactatgggtaacatatttaaggtaatgctagcagctgtaaaatcctctaaaatagatgatggttccaaaaaatagaagcttatttctcacttatgtaacagttagatggaagttttcttcaggaactccctctgcaacttttctcttaagtataaaattattccacaataaaaatttagcaaagaaaacaaagtgagctttactggcctatgtatggtttccccacatggtgattcagcgcccaaactccttccatcttgcaacttcatccctccgtagggccttgttcattgttttcccagccagggtgtaaggaaagagaggacatggaggggaaacactccctggttaatagccttagccagggagtggctggcattgtttctgctcacatcccttgatctgaactagtcacatggccactcctaactgcaaggtaggctgagaaatgtagcatctagaaaagaggatacaattttggtgaacggccatacccttcaccatatagccgtttacaccatccatccacctccccaatggacacagcctaaagttccatccagttacagcatcaagctcaaatttcagaatctctggtgataaacagctctctccataaagctcaggttttacgggaggggtggggagacagcccaggtaagtgatttagagcttgagatataagctctgtcccactttccctaccacgtccaatggacaacaatggagcaagaacttggtacctgggaaaaacaaacaaaaacctttctcatttgtcaaaggaaaaataggtaaacagccaacagtcactggaccaaaacaataattgaatcctgctggccagtctctgtgagacaacttccctcaaagtcaagacagtccccggctctcctttctgaaattccccatggccactgttctccagggtttctggccctgctttctggagtctgttccttctcaattatcttccataggacacctgtgaagcgaacattggggaaaattatctccttggatttttactttcttcataacccagttttcctagagcaaatgtggggttccaggttgtatagagtcgtggaattttttaggccaggattctgattttttttttttttggtagaacaattctctcaaaatcttcacagacattgatctaattccttcagtcagttgtatgtgccagtaaccagaaccaaaaacaataaagtcctttcctagacatagtactcaggtctgctttatttctttaatttcttacacttatctctctttctctctctttctctctctctctcatcctcctcatgccccttcttccctccttctttctctccaagtaaatatgaaacaatattaatgggagtttctgtttaaattacaaaacagtgtaagattttattataaattctctttctctttatgttttattgtagaatctgtctattatgcttcttcaggaaaaagaacattaagatttattttaatttgttctaaaagtacataagaaagtgtgatttttgagtatttaagcacatctggttactaatagaagacaagagacttaatagaatgttgatcctgtaaaagctgagctcacatcatcaacaaaaaaaaatttcaatatgaaatattttgtcctagtaacaaatcaccttgaaacatagaggtgtgaaacaatgtttttgtcatgcttagagtatgtccaaaaatttagatgaagcacaacaggaatagcttgtttctaccccacgatatatttgagttctcttctgggacgtttgaagtttaggggaaactcaatggccaaaaggcaatcatcgggagttctttttttttaatttttatttttttttagagtggggtctcactctgttgcccaggctggagtgcagttgtgtgatcatagcttactgcagcctcaaaatcctggctcaagtgattctcccacttgagcctctggggtagctggggactgactgactataggtgtgtgccaccatgcctagctaattaaaaaaaaattttttttgtagagttggagtctcactatgttgcccaggctagggctctttttaaatttaatgttccatttttaattattaggggtacataatgggcatatatatgtacggggtagtgtgatgttttaacacacgtctacaatgtataataatcaaatcagggtaattggggtattcactaacccgagcatttatcatttcttatttcacgtgttctcactcatttgggggcgctgtaaaacaattgatctcatagagatagggaatagaatgatgattaccagagcctgggaaggatagaggacttctttatactcacaagcttggtggttgatgctggctgtctgctggaacctcagcctttctatcaatcggaaacctataaggctttccttgtgcttactctgtgggtgtgatttgggtttcctccaacatattttccaagagtgaaggttctcagaggacacaggagaatgtatgacatttttgtgttccaatctttgaagtcatagagtggaacttctgctgtacttttttattgaagcaggcataaggtctgcccaggttcacatgagagaacacagacttcaacatttgaagaaaggggtgtcaaggttacatggtaagaagagaattgggtttgagatatgcttgcagccagccatctttgagtacgtattttatttaaattagtcaatgtccaaaacatttacttctcattttatatctacttaattcacatgcttgaataacactgaattggttattttatgtgtattcttactaaactctatcaagaaaaattatgtaataatatccaatgtcaatatatttgcagatatccagacacagaaggaatcattcacagcatatcttgaaagatgtcattcctccattggaacaactggtgagtgtttaagtcattatattcttcatctactgatacaaaataaattgccacaaaactcagcaacttagaacagcttaagttattatctcatttttctgtgggtcaggaatcagggcaccacttagtagagggatctagcttggagtctctcaaaacgttgcaacaaaagcatcagccagaattgggatctcatttgaaggcttgactggggaaggtctgctttcaagctcacttatgtggttgttggctgggttcagttcttccaggaatgttggccaaaggctgcccttatttccttgccacaaagatttctccaaaataacagcttgctttttcaaagcatccaagatgagaaggcaagagggagagtttgctagcaagatggaagtcaaaaatctcttgtaacctaattgtaaaagcaatacgccatcagctttgccacattcttttggttaaaattaagtcattaagtctagttcacacaaggggagaggattacataaggatgtgaataataggaaccagagactacagagggcttattgtaaatgttgatagttttttttgttattgttgttgttgtcttcaaaaaaaaattaatcgactcaacatccgtaagaatggcacttttttccatgtttttgtgtattgttatatcctagtgacaaaaagagtacctgaaatattgtaaataacatgaatgaataaagtattatatatatcttaaaaacacgtaagaccaacctttctgatatgttctgatacttctttcttttaatgacctcttttttgataaatacaatgtgcttttcctctatgctcattcaacttgtctttcctgctatatttcatattggtcaatatgcttccagtcttattggcttacaggatattgcactatgattactgcattcctgtctatctctagctatttcatccctgttatctttgggatgtcccatccttagcaccaacaataatttctttttttgcttcagtgttcctgttttctattgcttttcatgttccagatcccacatccccactccagctatttctccttactctgctttactttaggataagaatttctccaaataattgtctacctttgctgtttccaatttctgccctccctttgtctcttgaactaactctgtttaggcttttatctcaatcattcacctcttatccaggtcactgattgcctccatgttgttaaatccatcagtaacttctcagttgtctcttcagtaggtctatctgagcatttaacccaattgatagctctcttcttgaatcaattgcctagtgggtacaatgctcactgtttgggtagtgggtacactagaagcccaacaaccaccagtatgcagtatatccatgtaacaaataagcacatatatcccctgaatctaaattttttattaaaaagaaacattttcctcacatgactaccagtaaccactttctcatggctctccaattagctggagagccacctcttttcaaccccctttactggtccctcttcattttggagctcagtttttattttttattttttctgtctgtaggaatttcctagggcatctcattcagtgttgtagctttagaccatgtaacactagccagttctaaatttctatttccagcatggaccacagctttgaacttcagtactataaattctggcatttttacacacagttctaatatacatcctaaacttagcatatctgaaactgatcccgatttttgcccaaacccgttctccatttcacaagtcttctccatttcacaagatggagaagcacctccaggtgcttcagtcaaaacactaaaagtcatcttcccttgtttcagtcgtaacataaatgaacaccaaagaacccagtttgctctgtcttcaaaatatacccagaatcagttcatttctcaccaccattactatcatctgtcacccagtttattgaaatagtctccctgtttacccactttcgctttctactgtttattttcaacacaacagtgggagtgatcctgttaaaatgtaaattagattttgtttcttatcttagtcagtctgttactacaacagataccacaaacaaggcggcttttaaacaacagaaatttatttctcataggtctagaggctggaagtccaagatcagcattccattctggtcaggatctggtgagggccctcttctgggttgcaaacagctgacttctccttgtatcctcacacggcaaaaagagggcaagagaactggggtcccttttaaaaaggcattaatcctattcatgagagctccacctttatgacctaattacctcctagtaacattacattggagtttaggatttcaacatatgagttttaaggggaaacaaacattcggtccatctcacatcactccttgactcaaaatcctccctggcttttagtctaccccaggtaaatgctaagaaacatccaatggttcactaggccctagaagactcatcgacttccccagtctcacctctccctttcttctcctgtctccttctgctccaatgaagctgatacctcttcctctgcccggccatcccacctgcttttgcctctatctcttacaaaataatatatttggtgcccagaaatttggatatctcatatgttcctctgctttacatctctgctctaatatcacctttttaaataggtcttccctaatctctcttaaaaaaaaaatgaaacaaaaacaaacaaacaaaacccatagtggccaggtgtggtggctcatgcctgtaatctcagcactttgggaggctgaggagggggctcactttaggttgggagttcaagaccagcctggccaacatggtaaaaccccatctttactaaaaattagtaaatttttaaaattttaaaattacaaaattagccacgtgtggtggcactcatctgtagtcccagctacttgttaggctgaggcaggagaatcacttgaacatttggggtggaggttgcagtgagccaagattgtgcagagagagataaaaaaaaaaaaaaaaagaaacagaaaggaacctacaaatgaacaaacaagaaaccacaccatttccatgtacacttctgttaccttaatttactctatagaccttaccaccagatggcatactacagcatttatttttgttaagtttgtcactccattagaattttagttctatgagggcaaggacactgtctcctgtgttcattacttcattcccatgactacaataattgctggaacatgttagggactcagtaaatatttgttgaatgaaggcataatgaaaatttaatggcttttgttttcacttccaagcttgtgatacacaggtctatgcttgtaacctttctctcctgtgaattagtcatttgttctaggatgtcatctctatcatcacagaaatgaaatccctcaagttgaacccttcatcagtgccttctcaaactgattccctctttccattgagcccatctctattagtagcaaacatatatctaggatgagaacacattttctttatattctttattttctccctggccctttggataagtcatcattttctgatgaaacgtctcaatggttgtggtgcccatatgcttctccttgtgcacccccaaaccctcacccaagccttgaaatgcttctgaccttatcataccctatcatcccccccactgatcctaggcagcaattccagaacagccttctttcaatagtactttcattatttcattttcaaattttctacagcatcatggtccccaatttacgttatttattatcctctctcaaacacataccctcaagccaggagtagtaacatgattaagacatggctcttaccctgaaggagcttggatttcctgtagcaattacagtcctttcatcccagcacatgttcatgtgttgttttgtgttgctcactcttatttcataggtaatagacttgttccatggctggattgtaaatgtcttgaagttagaggccatgacttgtattttctttattatatcgtacttctacttagattgcttttggcactagtacttgttcaggaaagacatgcttgtgaattgatgtaataagaaattaaaagtttattaaaacaatgttgctagttgcagacattaataaatatatgcctaacatttgtagtgaaagccaatttttcaatataattagatatactaatatattgttttcaaaattaattacgtggatctcaacttagcattttctctaggaaggatttctctaattccttaaatttgaattagatagcccttctttgatctgtctctcaatagcagctgggtcttgactctattccagccccatcacactaaaattgcctatttcctttattgctcttactgagctataagctatttgaagggaggactatgtcttatttattgttttactattaaaacttcgtataaaggctggcacactgtagttctccaataaataggaaaataaatgctttatttgtttggttttattttaaataaatttggattacacagaaaataaagtacaaaaataattatgaagagctggattattttgtaaaaataacacataaaaagtttgctctgaagtagtcgatgaaacatggcaaaagttaggctgaaaatggagctcagtaaatgtctgtgtttgtgtgtgtgtctgtatgtttatacataaaatatatatgcacatatattttaacagtgcctaaaggtgccccaaagttttttacataaaaaattataatatatataaaatccaaattatagttatttaaaaaattaatttttatataatttttaattgtgtattttctatgccactatatcaagcataagctaatatcagaagaaccattagaatattcagaaatagttttcaaaatttacctgcctactcttaaggctatttgttgatttacttgcatatagtagggtttctctgcagcctcagttctaaataaatgaaactcactttgaatatcactaattatagataatatagtaatagataatagatctatttgcccaatactctattttagccccaatgaccttggaaaagtaacatcgagaagtcctgctaaacagaagcaaaaacaataatttttaagttttttaccttgcaatttatctcttttttgctgcatacccgaatatttttctgttttctctttttccttccttctctccctctcccattgacacacacacacacataaacacacacacacacacacacacacacacagtgccatgagttctaaaaacttttggaactaccaatcagcttacttcctagtcttgacttgggttttcctggatcatctctctgaacgcttatcttgctgtgtcttgtgaacatggataacattcaacttttatccatcaatctctacttgaattgaatttcttacttactgttattttaaaggcagaaacattatcttcatcccaaattcttatttatgaattatctatattgatgaacaatgccccaataatcacccattcccccagacagaaaatctgattgattatagaccattcattatcgttcacattgacacttgaattatttttcagaacctatgaagttttctttacatctgattaatctaatgctgtgttctttttaccaggactcacatactctttctgcactctggtatgttccctactttcatctctccaactctcctcacctccaccatgccttagggtggcttccagagtcatccaggagtcctggcagtagtttccttggctgtacctaccaggatgagctatcatatatgaaataatatacaggaaaatacttctgagaattaatgacattctttcctttggagttattatccatcatctctactgtatggatcttcaggcttatttatttctaaaatgttgggatatataaatctcaattcctttatatctcatattgagataactctactgaacattctccaggaaacacgagagacattggcttttggccaaatttatcaaagtgtcctattaggtccaccatgttgtaggacaattattcactttataaaatgaaatctgccattttggatgctctcatagaggctaacaccctttgggaatcatgctccctctcttaatgttccttttaagaaaatagattgtaaacagcatggttaaacagaacaaagcatttatttcttttgaatattggccaaaatacattcctaatctgaatctaaaatttcagagtggaaactacccagttcactgacagatgatgttatttatgccacatgtatgtaaatccatagggtttcggtagaagagacggaaatcatttcctgagaatcggtgtggttgcttagaaagtgctataatatcacaacagttttgtacatgaatcatcaaatatatcaatatgcatttgtttcctgatcttgtatattctatattataactgttcatgagacctaattattttcagggtactttttcttttccccttaaagaaacattcaagaaaaagaaccctgtttataacatgttaaatctttatcttgtttatttttatcaacagagtgtaagacatgtctatggaaaaccctgcaggagtcaaaagcctgtggcaggtttttacagaatcatctgctacctcctgagctaggaggattttgaggacagagctcaggaagttgctatggcttgggggcaaagcaggcttttgcagataaaccttaagtcacagattctaccttttagagccagatatcattttgtggattaattaatagtagtgagggctttgagcatgaaagacattgtgagaatacagtgttttcttgttttaaaacgaaggacatagactttgggggaatagttctattgatcaagctgggctttccttaaactgctgaaaaactctaaaagctctttagtctttcaaaattctacctgggtaagacaaaattaggttttctgaaatatccttccagatcttcaggctgttaataataagttatgtaacaataataagttatataatttaataatgctaatagaaaccatctctaagttttcattatttcatgtgcccttccttttctcaagtaagagcatgtatattaattcaagtatttgttgaggccatcactgtgctaggcttggaatatgtgataatatgctaactggccatgtccctttctagagaagcgttcagtctagggatgaacagaagtgttaaataaaggaaggcataattctataagtccaaattacaaaatgtgctatgataaaaaaaaaacaagtttctgtgagaacctacactggattaagtagtcacacatggattctttgaaatggccagttaacttgagattttgcaagattgatggagtttgccaagcaaagaactggaagaagaatgttgaagcagaaagaaacaagtgcaagggtcgccaggtcagaacaaagttgttacatctgaaaaactgcaaaaattccacagcagccagaatattatgaacaagggaaaagagtcacgggttttgaggagagagaggcagtgcccagattgcaaagggccttgaagtgatggtaagaagttcagaagccattgaaacacagaaacaaatgacaatacctctcccatccagctccacatttgaaatccatttaactctagagtagagaaaaagaacacacagaacagcaacaataaaggctattaatattgagcaatcctttcttccccactgcctagactgaaattaagttataacgcagaaattgaattacactaataagttgcccagacagtaaccaggaaggccattctcattgaagtccagtgacaggcaaagaacgaggaacatatttacatcaaagacacaaataaatagaattcagggaagaagagaaagcaatggtgggtggaagttgggtggtgcatgagggagggagaggtgagctatagtaaaagcctccagaagactgaagaaatttcttgagatacaaaaagggtgccttcctcagcctgtttcccaaacagaacctggattccttggtggtgaccaaatgaacacaccggttgccagatgaaaggttcagaaaaaaagtcgtatgggggttcttaaacatcaaataataacattttcaaaatgacattttgatgagttaggggtgaataaatcagagacatacagataaaatttcccttgaaatacacagaggtttaacatgatggggaaaagcacttggcaaaacataatatgtgctttgccaaacctaatatttgaaaaatggtttaagacattcagcataaccccaaagctggacatgttgtcttatcctaagtgagagaaagtaagggagggaggctacccatgaaaacattgctcaacaaacttattaaagaatataaataagttgaaatgagtaaaccatgcctaaatctgaaatcaaatttcatgctgaaatcaaacacgcttatcaaggacctctttgagaattcttggtgacctctttctatcaccacttatgtatgacccagaaccattctttgcttttcttctactcttcttcacatgcaatcattgcatccaactttagatatttggtttaccacttcttaaaaatgtgcacacacagtaaatgatgtatttacatcagacaaaaacatcatactgaatctatgtctaaaggcataatatttcattcttgagctatatttaaggcagttctaaaattaagacttttaaaaatgtttaaaaactattagtactttatatgatgtacagataagctggagttttaaggtattttttctgtttttgattctgttcttaatggattatgtccacagtgagttcgccggtaatgagcaaatcaaatatagcatgaatagcagagacagtatgggaataagtgaatattgagaagaaaatgtaagcaatgagttccaaagagaaagagtgcaacctaaaaacaaaggcaaaataaataaataaataaaagcaatagaaaaaagaaagacagataaggtagatatttctatgaatagtggagaagtaaaaaatggcgggcgtgggtggggggcgggaatttaagaaggaaagtgaagcatcatttgggggtaaaataatgtaaccaaatgtgtcctcattctgtgctctttaatagaaatcattgaaacagacaagattaacagcaaagtactatgatctattaaaagttcagagaaagtatagcagctgcctcgttattaaataggaaaataattaaatgctaaatctgcttgataattatagtggcccagggttgtagttatagagagatgatgcagagttcttttagagagaggtcagtcagtcacacagaaggtttcatagggtgatgctactttaaagggatcatctcagtttagagctggggcctgtctcagcattgtggatccagaaaactcatatttatcatcattattagtgtttactgagatgaagatcccttgagtctatctcacagtacataatagggaatattctgatactatttaagtcacccgctttctacatcaaagaacctaggaagctgaactaggattcagatggctgccaatgagcacattatcagaacaaaggggaagagaacaataacttaaatacatcagcagagaaaacgttatgaggcataaggaccatgtggttctggtgttaaaagccaaacccttctcatcaaaatctggtaaaagttgcagattaagtttatttccatttataaacagaaagggttattttaacagaaccctttggtggaatggtgtagatgaaaatctattatttgcaattgtatctgagaacaacatgaagccttctcataaaaaaaaatgcagtgtgtgtatgtacagttaacacactagtctttctgccatgattgttaccattaatcaaaggttgtcttctgctcccctgtcttgtctgtcgcctccaacgtaggttgataaacaggtgctatctgggtatcccactgccattcattcttctcatctgtatctcagcatggctgtgtctgccgagcacttcctcagtgcttgcagactggctggcatccagtatgaacaaattgctgatctttccagccatttaatgttaaatagggcttctaaggaacattggacaaatagctcaagaagccagatttagcatctaaagattggttgacatttcttaagtatacttagttcagggactgctacttctttaaagaacttcaatttggcctagaatttggcaagtagtatcctaaacttagacctagagctgtaagtaattttgtaaattactggagacaagaccatctgagctctagatgactagcacgctcaactggaatttatagatcattgtcccttcaaaccatgggattaacattgagtaggaataattattagagaaactaataaggtaccatatataaacccacatgcaaaatgcatagcaatcttttgcttgccctaatacttctttcggcacactatgaggctcccagaataactgattcctggtgtctgaaacatggtgacgtatttcaaactatcatgacaaagaatagtaaagtaattaatcctacctcgtggaaacttcacttgccagcatgagaccctttacaatgcagtgctttcagtgcagaaagcataattggaattttctacccaggctaaaagatggcctgagtctgtgagatgacttaagcagggcatggtatcccgtccccccagaaaaggagcaggaatatcttgaatatgaactcccaggagtttaagcctcaagaggattacaattgtcctattaatctttccagttctgttgtaagcagagaagctggcatttagaggaaagaagtgttattaattaaaaatgtgttgaaaagaatgaataagtgtacatcaagtattaaaaagacaatgaaagggccgggtgcggtggctcatgcctgtaatcccagcactttgggaggccgaggtgggtggatcacctgaggtcgagagttcaagaccagcctgaccaacatggagaaacactgtctctattaaaaatacaaaattagctggtcatggtggcacatgcctgtaatcccagctactcgggaggctgaggcaggagaatcactttaacccaggaagcagagattgcggtgagccgagattgcgccattgcactccagcccacgcaacaaaagcaaaactccgtctcaaaaataaaataaaataaagaagatgaaggaaaataaacacctgatctcagaagtgagaatgtgtgcacagtggtaggacatagatatactacgtgtagaaatctgcatgtaaacatttaacaaatatgcatggtggtagcaagtgtagtaggtaatagaacatagcagaagcgttattagcttcttctaatgacctggaaggcagcctgactttggaaaatgatataagagaagataactaacttgctattcagtccgtcctcatttttcctgggacctctgtatgatcattcctgaaaagtctattgcattgatccaagaccatggaactggctcagccactgatgacaatgatgtcacatttattgagtcttaacttgagaaatccagcccttggcatcaatctcaagtattctgggaaaagtcctgcagtgtctggggaaatgttacttatgtattcaaagaaagagaattctatgatgtacaccttaaacctgtttatgttgatttctccctataagagtattagctttttcctttcacatttcctatctcttttagaaaaattttcatcaataatttatctttgtgggtagcaaatgtctaccgagggatcttttgtgaatttttggaaaaaacaattggggctatatttttagcagagaacgcatgcatcaatttttatgatgggttgataggtttttgtagtttttttggtagataaatccaggttttgggtaactgttaatcagaagaaaacttaaataaaacaataaattttttctacggttacacaacaaaatttctcagtatacattcctaaagaaaggaacctcctttgtggtggtaattgctattgaaaacatctttcttccaaacatttgtggataccagtgatacacagagttaaacactaaatttattatatgggttttacgaggtagaaaaataaaattcctggcaccaagaaaaagggacagtatacatagaataaaatgtggaaaaagcaaatgaatagatgtatccaaatacaaaacaaaaaggcaccagtgaataccatggttctcaaaattatccaagaaatcttccttagatgctgtagagttgtggagaacatggtgaagtaaaagaaactttctggatatggagataagtaaaaaacactttgctatcattttcataagtcatcattattattatctctatcattatttatttagtcaaaaatgtattcatcaaatgcattttaaaactaagtcccgtgctatgtattaggaataaaacaaggcagaaaaactctcacctatatcagagcagacatttaaccagtgagattttagttatttggaacaactcctttacctctaaatatctcttcctttcacttgtagtattgaagataaatttcttggcttgcccagtttactataaatatttaaataaacatttaaatagccattcatttacttatttgttcaaacagttttattattttgactattggcactaccaaaatattccagaagctaggaatccaggtgtgaaaggtacagttttttgcctttgatggactcatagcacattatttgcctgcaggcacagataaataaaatgacatttacaacatgatctgatatgtgctgtcacagtgacaatggcaaactgaaaatggagattcaggatggtgcacctaaaagagatggcagagaaatcatggaaagaccctctaataaaaagacgtgcacattaaaatttggttttcttcttattttttgagatggggttcttgctattctgcccaggctggtgtcaaactcctaggaccaacagattctcccaccccaacctcccacacagctgtgattatagacacttgccacctcactgggttttactaatttaattttgaagtagattaaatatacttaagacttttgtgagatgaagacatggtcatggtggactatttcagctagggggataacatgggatggcactgagggagtgtggtcctctgatactaggcagctcagggagaagggtgtgggcaattcactaagagtgaaagatgaaggctaacgacttgggatggggcatgtgaggcagacacaggagggtagaaataggatgctaagaaattaaaacacctagtacagactttgcagggagtcaacccatcacaatttgcattgtgcatttattttgccaaaacctccgcaaacacttctgcggagttataatgacttgttgaatttcctttaagaaacttgcagctctattagaaatgaaagccaatacagtatatgcaaataggaaaaggaagcaatcctacatcatggaagaagataatgagatactgctactacagggtatcttggcaattgaccaaaatatatgaaatgttgctattttaaatgcccttccatgattcaactagctcagttacctggtcccattgaagtcttcctttatcccggcttcggaaggtacatggggaggcttgaaaagaagaacttttctaaggatacttggtaaaataaaggaaggcattcaatttgtctttcttttaccatttgcaatcaattttttaaacaagtgacttcaacgcccagaaagaaaagtcaataaaggtgtatcactatctaacaaatcattcacattcctcttcatagtctgtcttttagatatttaacagcttgtaatgactatgattttgcaggcacttcccataagctatatatgcattattaataaagttctatgactgaaaacttccgtcactgcaatgactcttgaaaagcataggtttattcaaatcaacaatgcatagtagtttgtcacggttttaacatatgcattcttcttgcagatggttgaaaaagaaggttatctgcaaaaagctaaaattgcagatggaggaaagaaactaaggtaataaaattctttaattcacttttatataactatgctggttcttcatatgctaaacttgtgccactgttattgtttgggatgcaagtccctatggtaccagactagaacagtctcctctgctactgctatgatcaacattatttttaatggaactacagtttttaaagaaaggcactacattctatattgtcgaacagaacacataaatgagatgctttttgtcctccttggacttgaactcataaaacactgaaaataaataagacaatggattgtgatttctgtgattgaaagattagagaatgaatgcattcatctgcaatacagaaaagtctctatacaataccttgtgagaataatttcttgaaggatggaagatttgaaccacttttgtagctcaaaatagaaattgataaaataaaagtaacatcatattcagaggtgagagaaatttgaaaagggaataagaaccttcagagaacaataacaacaaaaatcttgaagaaaaaaagtaaggttgataggacggtaaagaaagatgataattgtgtggtatataccgtatgtttagaaataatcacctccattttagaatttttgctatttctcgtattggttctgttacatatttagctttgtgctgggtgatatgcaagttaccaaatttgtagaaaatgctcaagttgagagacaaggcatttactcttaaatgtattactaacaattaaaattaataggataaatgtactaattagctacacaatgggacacatgttagttgtataatacaattcattactagaatgacactctgggtcaacaccagagaataaagtctgcttttgtttgatggttataatgaattaatatatttatttaaacaaagtaaaatttggaggggggtggagaaatcatccacaatttcactacttaaaatagctatttcagttgtaaataacaagctctattttctctccatattgtgtcttattctgggatagtgaacaaggccttaaatctttgcctggactgtttttctggagtggccctgcagccaccttcccttgaagagttcaggagagagatgcacaggagacaagatcaaatgcaaggttgctttaagagatgtggctagtcccttccccagtggtgaattgggcttagagaattgggttctgaaggaacaacaggaggaagtctttgagtagcccagcccgagtgctctcctttcccctaaaccttatcatgaccttatcaactcaggaaggagtgtggagggtacaatgatgcctctccccaagatgagtaagtcatgaccctttcttccctcagcagccatgtggaataaagagtttcttcaaaattatctaagttagccagttcagccctccactagagctgagtaggagaatagaggtgacagcattggtcagttccaccctccagcctcatgcaaggaagtaggggagatcctaaatgaaataatttcaagaaagcagaaggaggttctactgtgtggttttgtaaagtatccttgtccataacccctctgtaaaccaaccttataacatacagaaggcagtgtcaagaggaagcagagaagaacaggtcccttcccccagccaactcacatgaatatgtttttaggtagttttattcaatttgtatactattgtgtttttgttttatttgctgttactttcctgttttccgtgttacagttaaattaatataaacatttgtttgtactctgttttattatttcactttgcataccattatgcattctttcagccttttccacttaaagttatatgttttagttttccttttttttttttttttttttttgttgctgctgttgttgttaccccaggtgcacagaattgagctgattatatccttcggtttgtggccttgtgctattatcattctgggcaagagccctagctggttttattttattatcagtctccaatccttgcttcaatcccttgtagaccttcattttaatgtatttaatgtgtgtttatcaaactcattctccatatatatctatatttagctgtatatgtggcattcaaaaaagaatgtatagttgtgtatgtgtgaatgtgttctatatagcataaacatttttgtatcataaaccttattatgtttcttactactttcattcaatgttagctcttgggcagctttctatggtgctatagagacatgcgtctcttaatgatgggcatatgtcctgagagatgcatccttaggtgatttaatcatcatgtgagcatcatagagtatacttacacaagcctagatggtatgtgatatagcctattgctcctaggctacaaacatttacagtatgttgctgtgctgaatactgtaggtgattgtaacataatggtatttgtgtatctaaacatacctgaacatggaaacgataatgcattgcgctatgatgttatgaagactaccatgtcgctaggcaataggaatttttcagcttcattacagtctcataggactactatctatatgtcgtccattgtggattaaaacgtttttatgcagtgcatgaacgtctttaaatctagttcatttcttccaattgctggccactttgccatcgtttatgtgtagtcatgtgccacatggtggcattttgatcagtgatggacagcatatacagctgtggtcccataagattataaaactgatgcctactgtaccttttctatggttagatgtgtttagatatacaaatacttaccactgtgttacaattgcctacagtattcagtacagtaacatgctgtacaggtttgtagcctaggagcaataggctatgccatatagcctagcgtgtggtaggctttaccatgtagatttgtataagtacactctgtgatgtttgcacagtgacacaatcacctaacgacacacttctcagaatatatcctcatcattaagtgaagcatgactgtatatgaattgttacttatccagtctcccagctgtggacatctaagttgcctctaactcctttcattccaaacaacatttcaataaatcgcacatatatgtttcctttgaacctgttaggaattttctcaggggaatatttccaggagtacaggattgctcagtggtaagtcacatacatttgtaaatctactgactactgttgtcacactttctcctgaatgagtgcaccaattcacaccagttcaatgtgcaatacagaagggattctactttccacagttttatcagcacgtagcatcatccaatctaattatccatagaacattaccttaatgttgcttttatttgtgtttcactgataagtattgaagctgaggatcactttatctgtttagagacattcagattctgcattctgagtctattcataaactttgactattttctattgagtttcctgcttttttattcaataatttgaggaaactcataatatatttgggataataatgctttgtcaattttacatgttgtacatatcccctccaagtttatggggcttgttttgtttttattgtaaatacaaattgaacattgtatatgtaatcaccatgtttaagaacatgataatcccattatgttgataggctataatatgccaaatcatccctacctctttttttacttgatttttaagttgagtctggttttatatttatattaaattatttgtattagaagttatcattgcaatatttctcctgttgcttgtcaatttttcttttatatttttgtctgttttttgagacaggatctcactctgtcacccaggctggagtgcagtgatgccagcctcctccacccccatccatccacccaccttatgcggggataaatgagtagctgggaccacaggtacacaccaccaggcccagctattattttgtatttttagtagagacctgggtctcgccatgttgctcagaatggtttggaacccctgggctcaagagatccactcaccttggcctcacaacgtattgggattacaggcgtgagcaatagcacccagccttcttttatattttctaaagacaaatgctaagcctgcattacttgatcaaatcacacgaccattttaaatgaatcttagtatgcactgccatattgcttacccaaggagtgtatatgcttttatcactagcaacaaaaatggtcagtttagtcataaccttgaaaaattatgtagtttttatcccattgatagtttagtaactaataaataatataacatactataatttatgcttcttatataaaatttgatagccttcatttcatttatcaaggacctttgtatcttttataaattttaatgaattaataagcaatattaatagatgcttactctgtcaagcacttggctgaattctttatcagtaatacttaaatgatactacaatatagactctattattgcttcctattgtataaatggagaaactcagtcaacagtattaacctcttatttctcccaaatcttattttatatatagttagtatcacagaatttagccctgacctctgcttgaaacacgtttgctttatctctcttgctttaagctatttgagactagtgagcaaaaatggtcctcttatttcatgccatcaacagtaccaggtacttcaattgtcacttaataagtattattttattaatttctatcaagttttctacttataaatccataatagatcatcataccttgtattgtcttcttattttccttctttctcttcttttttatgtgtctttatttgtctctttaatgtattttctctttctctcaaagaaaatttaacttatctctgaatataagcaggagatggtaaaaggaaagataaattattggctatatttgacattcataagaggccatacctttagccttattttgaaatgaggttatacacatttccccaacaatacactgacaggcttgaaaacagaatacattcagcattcactttaatttttaattgtgaacactgaaactatgccttagcttatctgatgaaccataggaatttcttcatttggggaattccgtccccaaacctgtaagtaaccctggcttctctgaaactctatgacaccttagtaaaaagttattttcaatgcttacatttacaaaatacacctgacagtatgtttatgaagtctcagcaccacaaactttcttctccctcggcatctaggtcttcccgtcatcagctcctgtgtggctctgcgtatcttaccacaatatagagtcacattcttctctccttagatggacatagaaagatatacttgggggtgaaaatatggccagaagatggctacgaaaagaaatgcagaaaaaagattgtgcagtggttacgtctactagtgcctgctttcatcctagggcccatagctactaggccttcggttgggtttttgtttgtttgttttaacagttgttattcagaatggactttctttggaatgtgagactaaggtgtgcgcctaacgtcatcatattttttctttagtagtttctgctcagtatcgcaataaattcttccaggctgaatctttcttcattttcttgcaatactgacagagatgggtatttttacacctcagtgtctttttgacccaccttttagcagtcataaattacaagatgcttagaatatgagacagaagaagtaagttcctagaccaaccagtttgagaatgagtctgtacgtttaacagtgtctgagtgattttgcggtaaatcaatcagggacattagaataaattactttcactcccatcactggtgtggaatcaagtcaaatccagcatgaccaagttaggtaacaaaggcagatggaccaaataagagaacctgaaatttgtcaaggaacctcacatatattttcttctgactttttggtttgccactctgtcattacctaaagaaggcaaaagaaaggtaagcgtaggatataaagcttttggtgtttagagcaaatgaatgtgttaaacccggagtttaagctaacagattcttataacggtaatgaatattttaagagccatttttcatcaagcattttccagataagctgttacaatcaaagttgctgttattatgtgctgccatccggtgtccattttgtagaatgccaagctgatggctttgttgagtttttgtttttgtttttgttttgggggtgttttgttgttgttgttgttgtttgggctttgattttgtttttgtacttctatttgtctgctagttttttttgcatttttccaacttcacaattcaggatttgctttagggaagttttatgaagtgtttcacttggataaaatgtcccaccaattgcataaatggtacataaatgccctcatagaaatttagttctccctacttcccaattgtagttagcaccccttttccccttagatgtaatttgttttgtatgtcaaaagataagataaatacctgcatttctttttttgttttgttctgttttgagactgagtctcgctctgtcacccaggctggagtgcagtggcgcgaacttggctcactgcagcctctgcctctctagttcaattgattctcctgcctcagcctcccaagtagctgggattacagacacccaccaccatgcccatctaattttctgtttttagtatactgggtttcgccatgttgaccaagttggtctcaaactcctgacctcaagtgatcaacctgcctcagcctcccaaagtgctgggattataggtgtgagccaccgcacctggcccaacacttggcatttcttgccctaggatttgtctcctgcatggaatcactaggatcaaacccttacctgattgttacctgtaaattcctgtggaaactgatggctgtctcccttactcttggcactttggactgtcttactaaagttagatatttcctgaactgtgtgtcttagttacccctttagtctatccaacaccttaatttttgtctctctgtggaaaaaatagaaaactattctctcaaagttatgatgaaatgtggaggcactgattggtcagtgggtgaatttgcctgctgaccatcatgataggggtggaagacagggataaagggctcgcagttcagcattgcaggatggcccaggtcaggctaagacatggctttgctccaaagagaaagagattctagtacttccctgacaagtgttccttatctccccctcttagctcctctcatgaggctctcaactggcatgctcagagtgactacagagagagctgcatgccacctgctgagagaccatggagacactggagtgagcaggggcctgaatcccatctctatggcttgttttcccttggttaggatgcaaccttactgggcttcagttttctcttctgtaatatgggagtatcctaggctcattcagaagacttggtttccatgtttattgtccatcttcttgtagttagaagtacagtttttgaggaatgtcttattttccatctcttttcagcccttagaattgtgtttggcacgtggtaaatgtttaatggagacatgtgaccagcttagtaattaaatcacatagtgcatataaaatgccaggtggcatacctggaacagagcagaagccagtgcaagctcagcgtgggaagccctctggagaaagctcaggtattggacactagaagcataaattaggaaaaaatatcctatatcagaagtgttcgatagttaagaaaaaataatgctaagaataccttaataactactaggaaactaaggaacagagaaaggaaaagaaatttttcagtccttgttaatgacgaacagcaaacataaagcagaaaaaatctcgattttttctgaaatttgaaaggccatatactcttttactcaaaaaatctttaataatcacctactaaatgtcaaacagtatgcccagtactggaaatgctcttaagaggagagaggtggtttctatttctttgtgggagcttggggcatagagggacttcctagtgcaaaaactgtgtttatcctagaaaatagtctatttgcaaagtttcctcagaaactgctggacacacctatcctggctaaggcttttaagcttgtatgagttgcccacttcctgaaatgtcacctaatatattgaataagggtcatatatagtgatttggttgcgtatagaaaatatcaaatccttaagtcaaggtaaaaccttgccaagtgatcctttgcacactccagagctgacaatgccttacgagagagtcactatgttaaagtaattgggtgagaaagctattcccctgatatgctaagaactatgggcaacacaatgggtcagacatggcagccataaaaaaaggatgagttcatgtcctttgcagggacatggatgaagctggataccatcattctcagcaacctaacccaaggacagaaaaccaaacaccgcatgttctcactcataagtgggagttgaacagtatataaaaaagaaattattctttggccattgttgtaaagtcataatgtagttagggctggcttcaccggtgtgcgtccagggccccatgctcagaaggactctgcccttgatttaatgctagattgttactgtcttaaaatacttcataatttttggacacggaatggtgcatttttattccgcactgggctttgcaaattctgtacccaattctgtttttcactggcagataggtgtaaactcatgtctttcagttattcaaaaaaatatgtattgaggccctaaaaagtaaattaaaaaaatttggatttaaaaaaaaacagcggccgggcgcggtggctcactcctgtaatcccagcactttgggaggccgaggcaggcggatcacgaagtcaggagatcgagaccatcctggctaacacggtgaaaccccatctctattaaaagtacaaaaaattagccgggcgtgttggtgggcgcctgtagtcccagctactggggaggctgaggcaggagaatggcatgaacccaggaggcggagatttcagtgagcggagattgcgccactgcactccagtccagcctgggcgacagagcgagactccgtctcaaaaaacaaaacaaaacaaaacaaaacaaaacaaaaaccagacagcataaagtaacgaacagattataggttttggagctagagaaactgggtttaactttaaatctaagtgtaaggccttaagttaccctttgagcctcatttttcatattagtaaatagagatgttagtactttcatcatttttgtgtatgaagctaagcataaactagatgatcaggtttacgctaggtattctaaataatttatgctaattattattttaaaagaatcatgggaaaaaatcgagatgaaagaggacatctaaaaggttgtcagcagcattattattcttcgttttgaaatgaaattcttttcaagcaataacactgagcccatggaaaagctttcacttttattcagagaagatagacagtgtttatagtttataaattcaaaacaaagtagcaccgtacataaggcgtcagagcaagtcatgttgctaaggttttgagacctgcagttcttaccctcttcagttttttcatccaattcacctaacaggcacacagttcacagcagttcaaagtccttataaagaacaatgagataattgcgtttcatgcaacttcagctctaaccagttccatttccaagtttaaggatggggagagtttttgccagcaagttctataaatgatcaacatctgaaacagatccaaatcagagccatttatccaggacttactatagataggatgcaaataaggtatagtgtctccttgtgagaatatgaaatgtatagtgggaaatataataggtaggttaaatatggattcttcgtgtgtgagggtgttctgtactccctgaccacgtatggtcaaaataagggtggtgttaaaagatgcccagactagacttctaataatctttctctttttcctgtttggagtaatctattattatgacctgaatgaagagaaggctattgctgcttcaattcactctgctgctgctggtacctaaaaggcaaaatgggcactagggcagaaggaaacgtctgtgtggttttctttctgggttttgttttttcatcttttcattatttaattgaaaaattgatactcttcatttaaagacaagtgggtccaagaacacagtgtttgtatttggatgttgaaaaatacacattgtgcttcttgtgtgtctgcttattctgttcttttttaacacaatggtgtatcattaagaaagctccaggcatataagagcaacctaattctttttgtaaatattaaccttactgaatcaaagctgtcctttcaatcaagctcttagtttctaaaagacaagtggaaataaattacgcaaagatcttcaatagtcatttaaaaagtattttggtgtggttttctattgacctgaataaagtctttccataaacttaaaaaaaaatcacttttgtgaaatgaattcaactgttttgaagtgaatgttaagctgaagcaaactgcagcaatatgctctaatgggtagaaacttatgtatattaatctccttaatatctttactatctacaaaagagtgccttcatgacatgaacatatatatattctaactatagaagcaatatgtgttcaatgcagaaaacttggtaaacaccaagaaatacaaaggagactcaaaagccgcgattttaccacttgatttaactactgtcatatcaagactttttttccaggccaaagttcagtcattgactcaatacatatgtattttgcgtctattctgtccaaggcaccatgctaagcattgtggatacctttgtaaagatgaactgatttctaccatctcgaggctcatttcttaatggaggatagaggtgaaatttatgaaaaatatttttaaatttatcataagtgttatgagaggaagtcatggaaggcacatatgacaaagcaatgttttgacttctaattaatggaattaataatcagaaggagtgtatgggtgaagaaagtcctaggtaaatagcacagcacggttataaactacgtgtattatggtctgcattaaaaccttcgcacatcagtattcttctacagcatagggttcattattccattatatggacctattatatgcaatttatttaacctatcttttttatattttatgtatggaattaacaagtaatgatgcaattaatttctatgcatacagactcggcaatttgtgagactatttctctagaataaatttaaattcgtagggaatggacatttttagccaaaagatatacacatttttagggatttttaaaaagcacattttcaaattgcactccagaaaggaagcaacagtctgcattcccaccaatagtgtatgagagaatctatttcctacactgtgattatccctagatgttatcagatgttagttcttttattccttgacaatttgatgtacaaagagggaaaaagcatgtcactatttttatttgcatttctttgatttctagtaagattcaacattatgaaaatattttgaattaagcaatgacacatgaggctggttagtttttaagactgaaatacactaaaccaatgaagagaagaaacaatgaaggaaggaataggttctgattcctatttttactttgctatttttggtttgctgtaaaaacataaactttttatgggaaggatgcacatggatacacaaaaaatggatttttggtagttgaaaaagatattaggaggatctataaattaagaaattcttactataaatgctgtacttttaaataattccagaatgtctttattattacccaaattccataccacttatagattttaataaagaggagacttttagcaagactgttaaaaataaagatggtctctactcattccaaatgttgctcatactgtatctataaatgatttcttcaactgataatgctttctttcccttttatttttttgtcctaaggaaaaactggtctacttcctggattgttctttctagtcgaagaattgaattttacaaagaatccaagcaacaggctctgtccaatatggtaagtaattctctgtttctattgttaaatatcttttcagaaatattgtagaattaaaagtttggttttatcagaaatcacactaaaacctccaagctaccaacatctgaaaacagatggagaaaatgactcaataaacttttaatcagatgaagggaaaatagaacttagtgtctgttttattaagtggtgcatttggagaataatcacaaaatgagatgtatggtgagcagctatgtagtaatgcgaaggtaacactttaaattaaggtgccatttataaatgccttattcttatttatgaaatgatcactaaatgcagctacttgctcaaataatgtattataaagtatgttataaaatgcattagtaataaatgcttaacggatgatactatgggaagctgttttaaagaatattataagacgtaaatcatattaaaccatgtatgtgcatctttaatacatgaatttaagttggtatctagcatgctataaagtgcttcagacattaataaataataataaactgtttataaatggcaccttaatatagggtattaccaatgaggaaacactctaaattagccaagtgattttttatcttcgtctaactgtgacgttcactatatccagctaacctttttgaatatttctatgactccatctaatggagctaatacaatttctgtatcctgtagttattacaaagtgaaatttgtagggtttcttccttgtacctggaggagggcctcacatatacctacaaagatttgacagtgataataagtaagagcaattcggagccagttactggggcaattcaagctcaaaaccttgctgcccaaacacaagagctaccacaagatgtaggagacagtgggcaggcaacatatctgacagcctcctgattaggaaggactccgggcaggaactaacctgccacagcccatcggcctgatggatgataaggaaaggggtcgcctggcaggagttacccacaatgaactaatttgtatttgacaggtaataaaacgatgggaagttctttgctctccagccactagttgtgtttgctatgtaatcctctttaaatagaaaatagaaaatcatttgctaggagatttttcttaaaagaagattttagtaagaacaaaaggtagcatttgacttgcttctgataaccgcagtagcctttatccccaagtggcttgctgattttggagtctcagtgctgtccgatctgtaaactaattatgaataaattaaaaatatatctcagtcctttgtatttttaatttaaactgcctcagaaatttgttttagggttttattttgtttttatttttggatacagtaaggttgagataatctttttaaggaaaataaagtacccctaagggccaggcacaaaacaactaccatccacttgcaggtcctttgtcttccctttgaatgagctctaagggggaagtcaggaggggaggaaagtcgctggccttgctgagtttggctgctgaaaagatgatcttcccctgctgagtgagaagaattccattgggaggagagtttatgcgaatgtgtgggataatgggagagataagattccatattttaaagcatttggtttatttttattttattattttaatctctttataccatgagatataattatcagctgttaaattttatacaggtgaaagaaaactccctttttgattgcaggcaaatcttgcaagttagctcactaattgcatgcctctcgttcaaccttcagaactgttgtaagttgacaatagacttgacttgtagaagaaatttgttaacattttcctaggagtccttatttattacttctggccccatttttaatgctcttatggtttctaccaggcactcattgtcttcaaagtcaattcatggcaggaactaactgtgttttgtggtaatgggtaagagaattacagatttatgtttgtgctgcatgaattgacttgctagtcaacttcttggatccatttctaacccagtattaaaggcctagtgggatagcccacgtttaccagttccagtcttagagaaacgatacaacgattgccaggccttgattaaagatgctgtggttttattttgaaagagatttatgctcaagtttctgaatttctcttgcacccccttagaatttttctggtgttgctcattgtgcttctggaaaaaagtctgccctttcctcctaggggtcaagacaagctgcctgagtgagtgcagaatgtgatttaaaagaataaatggtattttagtccttatacaaatgatctttaagtgttaatgcagcagtgagacaaggcaacaaaaccagccagagcagttttgaagttggactctaggggatgtaattcctttttttttttttttttttaccactcattagctgataacattactcacttctttgagcttcagaatccttacctgtgaaatgggcatagtgatacctgccaacagaattagtaaggaatgaaattaattggtaaaaacaaatacataatgaacaaaaaattattgtgctttattatatcatatgctattaaatacagaaatataacatattctatagtacacaatagagagtataattatattattacattagttttgtacttgacctgattcagacatttatagaagagagaatatactaattaattcaagaaactccatcatgcatgacctccaaaagaatgtatccagaagtagcataaaatgctgtctcagagcaatgactaatactgaaaataaagccagccatccatttagggctctagatgttaacctcttgaatgtccatacaaagtttcccggtgcccccatcttcttcctttggctcttacccttactgttttcacatttaatacagcatgttacaaagtattctgcctgaccccacattctgtgtttggttactttcctttctcactgaagttcttccagttcatatctgtcttactcagttaggactgctacatcaaagtaccaatggctgggtggcttaaaccacacacatttatttctcctggttttggaggctgggaagtccacgatcgaggcacaggtgaatctggtgtctgctgaggtcctgcttcctcatttgcatctgtcctgtcttctcactgtatcctcacatggcagagggcagaaagtgagagagcagacgttcgtgtcttttcacataaggccactaatcccattcatgagggctccacctttatgatctaattacctcccaaaggccctacctcctaatggcatcacactggggtttaaggtttcaacataggaattttagagtaacacaaacattcaatccttaaaaatatccaagtcacatttttatcaaaagcagccttactgtgcaaataagcacagaatcactttgcttattttcatagagattcataggtacctcagtgagttagtaaaggagaaggaagaatgacctattctgttcttgttttatgaaaaggacattaaatcgtaactgaccacctactatcatcagcattttataacagaaaggacattataaaatacccaatccaaaaaatagaaaggataaaattatcagaataaaagacaccctttaccaaaaagaaaactgtcccccttatttgcctaacatactctctcttttgctcatcaagacaggtggatcgggactggctggtcctccagtgaggaggaaaaccactcgtgtccctagatccagatttcctgaattatgaaggaaaggatggtgttcatattctcatatttttaatgtatttttatttataactcacttaaaatattataaaataatacagaaaccattttaagtaaaatgtataaaacatctatgtgtatttttaataggtatcaatcaatcacctgcataagcactacccaggatgagttatagaccctgccagcccttcagaagccccaacccctatcagttgtccctttgtcatcatagcctcttcccttctctggagttagccaagaacctgcgttttagtcattatttcattgcctttcattattttcaaacctatagctatataccttaaaaatataatttaggtgttttttaattcatataaatggaatcctagtgtatgtttcttttgtttcttgcttctttcactaagtatttcttgctttttctgtcctttaatattttatcattccatttttttcttttctctactagtttgggaggatacactttgtttctgctctgttagtatagttagcctagggttacagcattagtacttatcaacaaataaagctagtgtgagaccctttaccttctactaagatgttaccttggaatatttttaatcaatttatccctttctcaatgtatatgttattaccatctggtgttttaatttttttaatatcaccagacattattattctcttttatggagtcaatgtttgtttacatttgcctaatatttgccacattctttgctatttatttctccatgaaccttggacttgctttctaggatcactttttcttctgcttgaaatatattctgagaaattcctgtgctaagggtcttgcagggacaatctatctcatagtctgcttacttgaaaaaaatctctatttctccctcatcctagaaatatatattctctttgaatatagaatttttagttggtagtcattttcagtcagcatgtcaaaaatatcattacactgtcttctgttatccattcttaaaatcaaatcacctgttaatataactgatcttttctgattgctcataatatttttctcattacctttgtttttctacagtttcatcatgatgcatacagatgtcagtttctttttatttttcctgcctggattgttatgcttcttaaaattattgattgctgtcattaatatatttcaaaaaatttccaatagctatcttttttttttttttttttgagatgaagtctcactctgtcacctaggctagagtgcagtggcatgatcttggctcactacaacctctgcctcccaagttcaagaattctcagcctcagcctccagagtagctgggattacagacacgcaccaccaagcccggctaattttggtatatttagtagagatagggtttcactatgttggccaagccggtcttgaattcctgacctcaagtgctctgcctgcctcaccctcccaaagtgctgggattacaggtgtcagccaccgcaccaggcccaatggctatcttttcaaatgtagccctttttacattccctctctcatttccttctaaaccttcagttaaacccatgttaaatttctcactgtattctctaaatgctttacactctcatttttcttatatttttgtctttctgagctgcattgcaaataatttctctttaggtatcttccagttcttctttctccttaatttcaattattgtaatttttatttctagaagtttgtttcttttaaaaatgtactatgtatattgttagagttaattttttcctgcaggcattttttaagactctattttattttgttataactaggaggcatagttgttttataatctgtattttgtgattctaatatctaaatttgtgtcagtatgtttctgctggttcttatgttgctttgttttcttgtgtgtctggttatctttgactgtgtgctaatcattgttattgaaatattatcatgggaggcactctgaggcctaggataaatgtgtcctactccagagtattttagatttttctcaggaggtttgggacattcccagagactgactatctcaatctaaattaacagtataaaactctccaattatgtctacataataggagggccgtagctatcctgccacttctcagggacaagattgtgcttcagtttttcttattttcttattttacattgctcatctaccaaaacagtcttctttatatttccttcggtttggagaaaggccacaagtttaatatcggttctcccttattctttataacactttggccaggaccttgctccattattctgggtttgattgaccaaagctcaaatgtgtagtataaacaaatgacctcaggaaaaatgcagttgtgttactttgatattcagcttccctcactgaattcatattcccacccctaaaaaatatttacagtggcagtcccactgtcttttcagactttcaattcttttaaggggtaattttaaaaagaaatattttatccagcatttttattgttttcagtgggagaattgatccaaaaacatagcttctcattgcaatctacctcacttcaagttaagtatgcatttggttaatcaagtttgtgctatttatataaatcttggtgggaaaagacttcataagaatatgtattgaaattctacaatgaacagcttgctcgttagggctacatataaggcatagagatataatcaagatatagtctttgccttataaaatctctgccaaaaaatagggtgagatgaaataagaaacatagtagagttgtttttttttttttttccactgagattttgaagaaggcgagctcacatctgtgaaagatttgaattgggccttgtaggaccgttataatttgaatatgtggagatttgtagggagggagtgcaggggcataaaaaacatgaacaatggcataaaactgagaatggacagagcctgtgcacaacaaggagaaatgaatttttgttttggtttgaagataggataagagaaaaggattgagaagagtttcatggcctgagatttgctgagtgacaaatttttaataagtagtgttagcgttctccaggtgtcttcattctggaataatctgtcatggctattgttttaacaaacatatactgaacagcagtactagtcagtggtatgtgtcttaaaagagccaggcctattgtagggccaaagcaagagaggatgctccttcttcgaggctcttcatctcatttactgcagaagtgaaaactttttcctcaaaagcacccacactagtgtttgtttcatctggtgctaaagaagtactagagaatcaggagttgtctgtttgatttatcttctcaggccttgactcacactccttgtatttttcaggtacactttcctattttagtatcagtgaagtatttcaattgactctagcacttcatttgcagcttgactcctaagtacctgctgtactttgtgattttagagcttctgcttgatgtgttcaggaggcacctgaccatgttcatgggatttggcaaatctccatttttggttaaacaaaacccatttgatggattgcatcatagagaagaagctctgcaatttagaacatccattcatttattctctcaacagttaacaactcctaccaggtgtcatataatttttttctttttgttttgttttgtttttacattaggggcaacagaaatattcaaatgaatagtatatgatccctgctcttaaagtactcacaatatggtaaaagagacataattttgtataggtttattataataaaaccatgactaaagtgttaaaaaatattagacaacatgccatggaaccatagatttagctataggtagtctttttccagagaaactattgttgcaagtcatgttcagcttaggtatctctccttttgttcaaatattactgtttgatattattatatcaaatattattgagcatctcttatgtttaagtcactacgataggtgttctgaaagataaaaaatgaaccagactgaaacaaatagaaagtatggccttagattgagtatagtgaagaaatggatgttggtagttgtcctaaaatggcatgaacagagacatggcgtcgttttatgataactcaagagaagagtgtgattgcttccatttggacaggatttgaaatatattcatggaggaagtgacatttgagcacatttctgaaggatgtataggattttgatgtaaaagggggcaaaagatattttatgtactaataagagagtaattaatagtgaactatggaaaattctttttttgttgtttattttacagatgtatattgatctcttgccttcttccatgcactgtgtactagtcactgttcttgaaatgtttgaatgggggttccctgaggcctggagtgaatatttcctagtccagagtattttgtgtttcttctctaagttgcctgggagtgaggaacagctttagactaagttgcggaacagcattgtggaacagcaaacagtgtaatttggttagaaagtcagtgtggaaccggtttaggaaagactttgaacaggattgggagaagagatcatttcattctgtaggtaatgtggggtttttgtaaccaatatgaaatattctcaaattaagagagactcagagttttcagagacatgtttagggaactgatatatatatcagttgtctataaaattaagtctctcttaattttgtgtatatataacttaaaaacacatgcaggacttggtaaattatccgagagacatgttctaaaaatttatgcaaatagatgtgagcaataaggcctgagctcttacgacagagaaaattgtaaaacggctgtgtgtcatcattttggctcaatgcatttagtaaatcacaggacatcttttcactgacaaaatattttgatattctcatatgtctctgacctccaacagtatggccatttctaaagacgttctagtgcaaagagaacaagcagagctatccatctaaggagagcgaaaaacatgctgtcccaagaactaggtgtgtcaccatctcagtgagcacccgttgcaaacctactggtgcttccatctgactccagaacatctgtttagtgtcacaccctacttaaacaaatgcattgtgtgaagtctttccaccaacaatcagacgctgtggaactcattgtcaccaattgggtggatgagagccaccgtttctattatattcatcacacactgctcagaaaatttagtgtcacttttgatataaattcaaaaacattgtaaacattttagggaatattttccccctaaaatggtgtggttctaaagccagtatattcagtagaaagcctatatgttggttgtgtaagggacttttttgttactcttatgttttttattttacattgtactaatatgtatttttaatcagagccaacaactggcaatttttactttttaaaaattatatttttgggttttacatttaagtctttaatccatcttgagttaatttttgtatatggtgtaaggaaggggtccagtttcaattttctgcatatggttacccagttccccacatttattaaataaactataaaaactctagaatgaaatctaggcaataccattcaggacataggcacagacaaagattttatgatgaaaatgccaaaagcaattgtaataaaagcaaatggtgacaaatggggtctaattaaactaaagagcttccgcacagcaaaagtaactatcatcagagtgaacagacaactttcagaatgggagacaatttttgcaatctattcagctgacaaaattctaatatccagagtctataaggaacttaaacaaatgtacaagaaaaaacaaacaactccattaaaaagtaggcaaaggacatgaacagatacttctcaaaagaggacatatatgcagccaaaaaacatgaaaaaaagcccaacatcattgatcattagataaatgtaaatcaaaaccacaatgagataccatctcacaccagtcagaatggcaattattaaaaagccaaaaaacaacaggtgctggtgaggttgcagagaaaaaggaacacttttacactgttgatgggagtgtaaattagtctgatcattgtggaagacactgtggtgattcctcaaagacctagagtcagaaatattatttgacccagcaatcccattactgagtacatacccaaaggaatatcaatcattctattataaagacacatgcacgtgtatgttcattgcagcactgtttacgatagcaaagacatggaatcaacctaaatgcctgtcaatgatagactggataaagaaaatgtggtacatatagaccatggaatactgtgcagctataaaaaggaatgagatcatgacctttgcagggacatggatggagtggaaatcattatccttagcaaactaacacagggacagaaaaacacacttataagtgggagctgaataatgagaacacatggatagagtgtggggaacaacaaatactggggcctgttggaggtgggtggtggggagagggacagcatcaggaagaatagctaatagatgctgggcttaatacattggtgatgggatgatctgtgcagcaaaccaccatggcacacatttaactatgtaacaaacctgcacatcctgcacatgtaccctgaacctaaaaatggaagaaaaaaaatgtatttttaaaaagtacagtgtgatcttttgatgcatgtatacattgtggaatgattaaatcaagctattaacacttccattacctaattttttgtgtgcaatgaaaacatttaaaatataatcagtgatttttaagtatataggatgttattaattatagttaccatgctgtacaatggatctctagaatttattattcttgtctaatagaattttgtactctttgagcaacatctccccatacccttcccccaaacccccagaccctggtaagtactattctactctctgcttctatgagtttgacgttataaaaattttacttttaataacagaaaactcttccaaggcatttaatgaactattaacttttccaaaccactcattcagccataaccttgaaagcaaaaatgggcaacataaaaggcctcattaaaataatttgttttcagcctggcccacatatcgagaccctgtctctacaaaagtttttttttaaaagattagttgggtgcagtggcccatgcctagaatcccagtactttgggagcccaaggcaggtggatcacctgaggtcaggagtttgagactagcctgtccaacatggagaaaccccatctctactaaaaatacaaaaattagttgggtgtggtggtgcccacctgcaacctgagctacttaggaggctgaggcacaaaaattgcttgaacccaggaggtggtggttgcagtgagccgagatcccatcactgccctccaccctgggtgatagagtgagactctgtctcaaaaaaaaaaaaaaaaaaaaaaaaaaaaaaaccacacatgcacacatggtggtcatgcacctgtaagtccagctacgtaggaggtcgaagcaggaggatcacttgaacccaggtgtttgaggccgcagtgagctatgattaagtcactgcactacaggctaggcaatagaatgagactctgtctctaaaaaaataaaacaaaataaaataaaataaaataaataataatttacttttaaaaaatattgtttactttcaatatgagtaatgaacacacacattaattaaataatgcaatatatctaatgctcattcactgtagtatgactttaacaacaaaatgaacttatttatggaaggaaaatgatgtgatttagcaaaaagatgaaaatagtttcaatcagaaagctattcatgaattattgagtattccgtgcaaaatgaatatggaatgattttatctttgtagagtgagtattgagcccttattcagacccctgcttaagaagatcatgaaaaaatggaggggcaaacaaaagatctatcagccttagactaatgaaggcattttaaaatctctgtttaatcatttaattctcataatagtagtactcttgccacatcagcatggttatcattgatgcagtatgttagtatagctgtagattgcaccatcatatggcctcatcaaacatttaatgattaggaaaaacaagttacagttcaaaatctggaggataatgggtagagatggaaatacagagaagaaaaaaaggaaattaaagttcagtgttttattaatgtaaactttggaaggaaaaaatcaagtgatcgatattgctataaatgaagccatgttctctggttatatttttttctagctttggccattaactataataaattctgtaacttacataatttttaataaccacagaaatccatgaaattgacaggattctttacaaatggatcagagcttactgtccctcaataaacctcaccttaggctctctcagaaaactgttttaattatgaagcttgtctctctgtggtttatcattttggccaatgaaatgcatctgttttggagcttgcatttctctaagataaaatgagcttttaccccacagtgtattttttaatttatagagtatatgtatagtctttcttaaaaattcactactaaattgaaatgctctgagaagcagtatcacattaggtagaaacaggggctttcaagtcagatcacctgggttaggaatcctaggttcatattttacttgctgctctagtttattttcaaatattaatgataaatttattttcacatatttattggctatctcaactgcaatatgacattaacaagggtgactatctcgtagaactatatgtgagaaaattgatgcaatgtgcctcacacagagcaaacataataaatcttaattgtatttatcgttgtcgttattactacatgaagcaatagagtatagtggttaggagtagtggcagatgagggaagggtaaagggagaatgtgggaaagatctgcatgtgcctagaagtcttttcgctcacattccagtggtaagtataaataattggccacattctgatgcaaatggggctgggaataaagtcttcagctggcaagctgcttcccaatgacaacacaaggcacttgaagagggagcacaacacacattttggtggagaacgattcacctctgccacagcgagagcagcatcagtggtctcaatcctggttttctggaatacaaagcctgaattaagagcctgactttatctgggaggtacaaatccaggacaagagagtgaagtgaaaaggaagtcaggccagaagtgatgggcagtggtacagggatgttaccatgttggctccccactacaatgagcttcaaagagacggagagaaaagggtctgcaagtacgctggtgaaagcttaaagcaatctgtgggaggaagggagcagaagaaggaaaaggaatttatctcccatatttcttcccatttcctgcacttttcccatttcctgcacttttgattaaagttcaccacccagagtcttcacttgcctgcttcagtcggacctgcctcagccatgggaggctactcagaaagccaggtcccactcctgcaaagtggcatttcatctaaagtaggaagtggtggaaggagccaaaggcccttctatagtctggcagcctagggggaaagtctggtattccaagaaggtggctggtcattctcaagaggtggactgcattgcccaggcagggctggtcatctgcagggacagctgaggttgactgagtggatgacagtctaagaggaaactctgaggaggcacctgagacatcaaaagtgtacccaagctattcaccttgcagaaataaattgcctttttaatgtaaatgtaagactatatcagttgagaaatataatcattatatttattccagcaagattttgattcagaaacaaatacaataggtgctcatttcttgaaaagtgtagaatactttctcctcaaaaacaaacaaaaagcacataacattctagtgcccacaatcactaacaaaggtttatttttctgaaaatgtggtttgatttggtcatgtaatatactgagaaatttcactgtagaaacaatttctgttattattaacatcatttatattcatatacataaaacccacatcttataatcaaagtatcctcttttatgttgacaggggccatactttagacattaataagatcaggtatccattcagccctctttcctaaatcattttgcccaaatgagaatatataaatgagttttatcctcctccatgaacgattttccagaatcaaaaccagttatgtgataaaacttaattcctctaaacagattttgtgtttcgagtttcaaaatgataaggacaatctgagtctatattctggaatagcaattaatccaaaataaaaaatggcgctaataacctatttcataaaatccgagctttgtctctctttttgaaccacatctagtaataagggtaagaggctgtgcggccaaatgatttgtggcctgcgtatatgcccaatcttcatcatggaagctatcatcaagctaaagagcatctggcctttgatattttcttaatatacattaaaagactatggaccccaaatatcccataaagaaaaatgggaaacttaatcccacaggtttaatctaagtcagagaaaaaagtattacagagaaaatactcttagctattattgggaaatggtgaagatagacgaagagaataataaaaatcagaagtgcaagagacctagggtcaatttttaatgacttcacattcctctaaaaaagaggcttttatgttttattgtccaaaagcagtaactcttaaataattctatttaagtattttaaaaatcagtcatttctattttaagtttaccccagaagaaatatggtgtgtacattcttagatttaaattcatatttagtcattttttaaaaagtgtatttttataatgatgtagaatatgatccattggcatcatgctgttcattagcagactttttcttgtgttttatagctgtagaatcggaaatatgttttctattaaaggattctttaatttcaggcttcttgaataaaatcttgattgtcttccgaataaattctacaacttttctgaactacttattccaataagtagtttaaatgtttaacatttaaacactgagaatttcttctaataatctcgattccctaaaactgctcttcaggcataggtctttctgctgtagctttgtgaaaatgaactacttattaggaccatttttacacaatcctccagctacttattctagttttctctttttaaagcgaatatatttattattacttaagaactttgtttttttatctgtcatacttttgaattcaccccaaatctctattagctttgattataccatatgatcagttcttacttaaagttggtataaaatggaaatattattccatatgtacttctcactttgtgaactgtcattctgagatgtattatttatttttatttgttaatgcattggaatcaatccagatatttttcattgtcattctctatccagttcctcaattatttcaatagttcacaaataactgttgaacacttatttggggccactttgctagattctggaaaaataaagaaccataagtcaaacccattctcttactggatagctaggggaaaaaaaacacaccaaaaaggagtagcaatgtgtgactaacaagagttgtaacacagtatgtttcaaagtaggggaaatggtggaaggagtgagtgactacctgcagagggaaaattctccccatggatatttttatttttttaagttgtgtcttgaaaatgagcaagattacggcagatggtaggcaagcagggtagattgaagagagagataaatgtatttcagatgaaaagaatgaatgcatactcaaatcccaaatgtctggcgttgtgaaaacacattgcattttggaaactgccacggatgtagcgtagctggtgtgaagaatgggagaacgcatagaaccgagagggatggttggaggaggacagaaaggagctcgtataccttaccaagggatttggacactatcccgtagataaattttccataataaacaatgtgaggtttgtgtctcacattgaacgaaaaaaggtcaaaatacagagaatgaattgcaagggtttttgactggccacagaggcaagaggtagaagaattcttgtgagagaaaataagaactctactgaggttaaggtcatgagatggagaaaaaggaactaattccagaattcgagactttgtgccttttgattatggatggtgaaagaaaggagggagttaagaaactttcaggtgaagtgagtgaagggattattaagcaagacaagcaatagagaaaaggaggcaggtaggagaagaagataatgatttcactgaggtgactgtgctacactctcatggtaatgtagaaaatataattctgacacatcagagggagctggaggccagaggcacccattgaggggtcaacatatggcaggtaatgggacaagactaggggcaagaccaaaacccataggaatcacatgagtgaggagaaatgatgagggcctagaacgctaaacctggggttactaacatttagaaagtgggaagaggaagaggactcagtggaagaaactgaaagggaagagtataaaaggtgaaatgcttccatggccaagaaacaagagggctctaaggagaagggccaacagaatctaacagtgcagagttcaagtcagatgcagatggggaacaaggcatcagattgtttttgttgaccttaatggttaagacattttagaaaagtcaaagaaggaagtaaatatcagactgcagtgttgaagaagagaatggagtctgagcaaacagagaacatgaattgaggagaaggacaaatctggcaataacggaaaggaaataagtgagattgagaaaaagtgagggtgtggagttgatgcttgcttttcttcttcttcttttttttttttaaacgggtaatgaacatggttagaggctgaaggacacaatctatttgagggggagaaagtagaacgaaatgtgaaattcttattcttggacaactcaggaaatgagggacaagactggatgaaattaggaactagagataaataagccttgggcagaaggagtatctcttcctctgaggcaaagcaggacatgccttgtgagtcctttttgtgctttatggtactgacaggtcaggtaattttgacactcacagaggccactgtcctgccaaggcatgggagtttattagacagatgggccagtcacagccccagaattttggggctggaagacaaagtgggaaatgacacaggaaaaaaatggaaaatgtgaattattattcttggacctgaaaaagccatttttaggtgaactagtaggaggaaaaaatgagtgtggaggggaggccatggattccattgtgatcaagaactttaaacttggaatccgataaaagtaaattcgtatcagctcaggcactttctaagtacatgaccttatgtcaagcacttggccgctctctgcttgggtttcttcatgtataagttgaaagcaatggtaatattttcaaaagattgttgtaagaagtaaatgagaaatcaatattaagctttcagagtgcaatagaggaagctatcattaaactttatattcatttgtttatttggattacacagactaagtatgaaagtgggaagagttgtgactgttccagcacaagggctgtgatctccatgaagtcagaacaaaccatttcgtggggtggactcataagggttgaagctttcagagagcagtggcaagaggaagaagagaaagtgactaggaacacatacaaagtatcttaagcagagtcaaaggcccagctgaagaaggtagacattatttgtaatattgctaccctaagtagtcaaaagttatttctccagtattcggggatatgaggaatattatggaggggcaagcagatgagagcgatatccttggaggagagggcaggtggagggggtggttgaagtgactgtggaatcaggaatataggacctgaaaggaagtgaagccaggaaggaattcagagactgggagattgcacaaaggtcaatgattttaatagcatcagaaacacacggataagaaaatctccagaaatggaatctgtcagatgagcagcagaatgaaaatcactgaagtggagacaaggtgaaggagtgagattgtaaggagtgcaagagacgggcaaggtcctggagaggatggccacagacagggtttggattgtgataaacccgtgccaggtactgtggaatttgccttaggaggctgtagggtaaacacacctgatagcaatagcttaacaatctctttggaatgaccctctatggcagacacacctgaatgtgtgtttcaagctagggaatccaggaacagctaacctggagattcgttccttgtccgtgaggaacacctgagccctcatccagtctcgtggatcacaggctgcacaggggaatgaggctttgagttttgggttggatgaaggttgccaggtggaggtccttaaggggagggctttaagtgaaaatgctatataaactgcatgctggtagcaagaggttgtggttttcctgcccagccctccgccactgggctgtggagcccgctgctgctggtgcattcttgtacgtgaggtgtttctcctgtccagcctggcaccactggcctctttccccggtatgtaaacccttaaaatcccatatcttgtttgctggctctgggtctcgtctttggcctcttgaacctcagccctattgggttaataaggattcagcacaacagatgctgatgagaacattttgagattgacaaagctagatgatgagaaaactgtaaaagcttagactgttttacccacaggtttcctttagctctatagcatatggagtttgtaggtaattatacagaaatctaaagctaatatgagatttttcaaggaagagtcagtatctcccttatccctggagttcagggagcccagcacagtgggtaacacattgacacatagtaggtgtgcaataaatgttaattgagtgactttgtgtaatctcacatttaatccaaatatgagtcctttgaactgtttctcacttttccaaatcacaaagactgcttaaccatttaaaaaaaatacaaatcttaattgctataaaattgggaattttaagacactaaagtcttccttccaaagcacaaaagctagttgcattttggtatttttccttcattcatgaattcagcaaatattcattgaacaacaactatgtgccaggcactgttccatacattgggaaaaacagtagaggaaaaggcaaacaaggccctagctcagggagcttaattctagtgggggaaacacagacagtcagcatataaaaatatatatgttaatttcagttaggaggagggctgcagtgaaattaaaacaagtagtgggatggagagtaaccaggagtactggagtacagctcttttatataaaagacagtcaaagaagacctctgacaaggtgacatttaactgggaactgaaggataagaaggagccagccgtgtgaagattgggaggtattccaggtaaacaggtggtgtaaaggacctacggcaagatcacgtttaacagagaaggacaaaaacaagatgaatatgtctattctggagtctagtgagaaagccatagcttttcccaaattcttacatgtttttagcatatgatcacagtgtctattcaatttttaagggctgcatcatggttaagaacagtctctgcagtgacactgcttggatctaaatcctggcccctccttttctagctgggtaaccttgaggaaatttacctaactattctggcaggttttcttacctacaacttagtgatgataatacctacctcatacagttgtgaatgtaagatttcacagaatcatttggttaatatttattgcacacttattttgtgtccatgtgttagccacagtgctgggccctagaactccagaggcaaggaaaatacggaatcttcctcattttagccttagacttctgtataattgcccacaaactctctatgatacagaggttatacactaaacgaattatcaataattgttgtacgtaggtaagtacctggaacataaaaagtgcttcttaaaataattatacctttttaaccccctgacttgactgtatgggaaaaataagccattttgttacgtactcttaatgattattttcgttggttctgagtatcccctaatgtaattaaatctataagaagcatgttgttgttaatttttctacatcataaatcacttgacaaagactatcattatcatgctttgaaatctaaaatagtgatcacctgggtggcagagcgtgggtgaaacaataaaaacttttcactgatcaaaatctctttaaggagcatggctcattttgatgggtttctcctgaggttactaaataacaacaacaaaaaaggtagatatgctatcaaattctatcctgccggctgggtttatcctgtaggaaagttatacaatgtttcaaaaaaaaattcagttgccagaaaaaagtctcataatttaccataaaaaaacaaatttctggcttctgaaaaagcctatttatgttgaacttatagaattggatataatggctaagaggcaacaaacatggacagaatatgtttttaaaacatatttaccattctttcataatttcatgttttatcctaatgttcataatgttaaaaacattggctaaaaatataataagcttcatatactaaaattctgaagtattttatggacaatgacttgagaaaagtatggaatctacagagaaacctagaaaatttatctgtggagaaacttcttgaaaaaatagtaaagaaattctcaactggtaaactttttaaaaaataattggcggtatggaggtatgccaatgtaaagttgtataagtatgattaacttgaatcaagtgaaaatatgaaaagacaaatgtgggtgatattcctattgattattgtgaattattgaaataaaaaacatcttttaagtaatacccacattgtaattgtgtaataggaagcacacattttaatccttttggtctaagttaaatttaccaaatgaaattatatttgtgtgtatagtcttaaagtctgaaaagtgaatttctaaaaggcatagttgacacttaataaatatgtattgaatttgctaacatgtgaaacacaaacctgaaaggggaattggagattaatccacctgctcaattttctagatgatgtagtcagattctaagcaactctactatagtcgcaaaactaaaactctgtaacagttttttgcattgcactatgatttatcaattttttcttttactgttaggtctaaaagtaatataacttaacatgcttttatgttactttagacattgaagagcaatattccatattactaaatagcagattttaaaactttcattattcttaaattactaaagaataccatctcaaaatatcagtattctagatattaatttttcctatggtttatagttaattaaataattttaaaaataagtctgtaattttagacattgaaaaaaattaggtcccaaatgaaaattcctacaaattaggtttcccctggggaaaacaaaaaaggcattatatcataaatatgtatagctgctaactcaataaactcctatttctctgacatctatctacagtgttgcatcctcttattcttacttcatttttgtgattacagaaaactgggcacaaaccagaaagtgtggatttgtgtggagcacacattgaatgggccaaggaaaaatcgagcagaaagaatgtctttcaggtaagaatgttacatatattcaatttattcctattctctctaaatctgagctctcttgggtaactaaaataagactaccttcttgtgatgtgctcatgtacatgaactcgttgtctgaaggtcatgaaaggcgactcctcttcccagttgaatctttggttttgttgctttttttctggcgactggttgctatctaaacacaaaatgtatgttgcacgttgattaatataaacacacaaaagtcattgaagtttgcagtatatgcgatagatgtctggagttcaaacatgggatgtttgacttaagtagatttgatctagaattttcagatgcacacaaactaagactcaccaagtataagctatttacattcattgacactcttgccttctagtcattaattacatttaccagtataacttacaagaatggagagggctgaacagctataaaaaatagattctttcatattgcttactttagttttttgaaaaaaaaagttgattaataattgcaatcatattcgattgaatggcaagaaccagatgaaatccttgagagagataaaattggaaaatgtaatttcacacgttaccaaaatcacctaattgcgtgatttatctggtaattaataatttgagatcttggagtttgatttttgttctattttatatgaaatttaattttatatttccaaagtaaccagtaattagatatattttagaatttatataatttagtagaagagagatagagtataataattattttttaaattaaatgtcttctgagagcatgttggcccttgaataaaagtcaattcttctactcttaaatgctttgctgaaattaatattgggtcctatggaagcataggtaggtgacattttctaccgacactctcactgaggggaagaagctggtttccagttcggtttgtattttccagatgctattcaggtatatccaaataatttgggtccataaaatattttaacacattctagaataaattacttttctggttctagttttattttgcttaggtatagagattttttatcaaacaagaaagtgagagaatatatgcaattattatttgtcaattaaaaataaaatttaaaaaggaaggaaggaaataaaagggagagagaaaagatagaagaaaaccaaacacgcttgtcctgaaatcaatgctctaaagctgaaagtgactaaaatgtggctttacagaatcaagaaggagaaataaactttctttcaaagggaggaactatagatcagtgacttcccctttcccccaatttcttactcttattattctaccataaataacagtttagaggttataattctagccttatgacaacttagatgatcaacataagaagctctgaagtagaccgggaaagctcagtggtagagccttattatgtactgtgaatttagcatcctaatcaccaaaattgtaaaagatgttgaaatttgtcatagacattattcttggacaatagcaattctttggagatgggctaagccagcctttttcagtttcttctgttaatcttatgaagagttaaattagttcacaaatgaggatgacagtcagctatatttgatgcatacagggctgaaaatattgatgaaaaaattatgtatatttttatataactatgaacattatatgcacagatagacatttcagccacctatattgacagtgtgtatcatcccaatcttttcaggatatgactaatcacctcctgttgcaattttctatttgatttttatatttttgaatgtagatccttccaaagatattaaaaactattctcacttttggtagctttctgaaggtgaaaattttgccagctagttttgtttgtaatgtaattgaacagttcatggggcctcagtcttcttacagacgctttatttttttttagtcttgtacttttagagaaacaagaggtgatcataaggatattgtgaataacaaaccaaaagaaaagattcaagtttcatgttctgtttcattctttttgagtgaatcccttggtttccttgtcgtgctgaaatcttttcatcacctaaatgcatgagttttggtaaaactgactaatacatatccatagatacagactatgagagtaagccttttgagaggaacaatataaatagcttctatagttctgttaacaaaaaagcgtcgggaaggatttgccagagagctaaatctagatgacttgcatcaatatttgattagatacattagctggtcgaactctcaaatgatcagaataaacatgattatgtcttaaaaacatggtattaaggcattgttggacgttggagtgtatgtgtgcaatggtttcattacctgcagaataatgaagtgtttcttcctgactgaaaaagaccatcatagcttcagctgatgtgctacattggaaatagctttagaattccaagtttgaattaggcttggtgttcaatctcagtctatgaattatagattacagatagcaaatgactattgagatttttggttcaaggaaaatcaaagaagagcaaaattagaaatattttaaaatttgaaatctgtctttaaaaagtttgatggattagcaattgtatgccatgtaattacaatgtctgcagagaagttgaacttaaaatgaataggaaaacaaacaaaaaattgtatgtgcctgagaaatgttgcaagtctcagaagcacacatttgtgacaaccaaaaatggacagatttcatttatttcatttgttcatatatgctgtttggatgtttgagttgttttctctttgtactgaaatccaaattttccttcctagttgaaatcctatcaaactgttgacatggactgaatcttatttgattgctatgtggaaacataacaatgacaacattaattattaagttttggtattcaacaactttcagtaaatcagaatgatacttgctaagtttaagaatatctgcatattttataacagcacactctttggcctaattggtacttcttaacaataaataataaaagaattctataataaagtatgtattagatgttataatttatattaaaatatatacatgaatatacatgtataaaatatatatacttatatacataaaatatatatgcaaatatacatatgtatatatactctacctgtgtgtatacacacctaatagcttgaccttaggaaatagagtaagcacttccacacacaaacacagaaagatagtacacatttataaaagatcatacaaattctaagttaaagtggtaaatgtccattgctgctaacttttgtttaattctgcatttatgttcattgtcaaggactgtcacaagtttgatgtagttcgagaaacctttagcaactcagctataacgagctgggtacgcgttttcttagttaacagcaacactaggtcttcatcagggatagagtgaataaaaagatttatgttcaaaccacatgttttaaacattcctgctaagtgctagtttgctctttggtgtttagcctgaaatttaaagcactaaggattaaaaggattacaacataatcttaaataatcctaaatgtcatttacagagagatagttgtaataactaaataaaaccatgtgaaaggatggcagcattgtcaggcagcctccctcacacaagcggggctactgtcaccttctgtttcctggctgggcatgttaggcagttacagtctttcaataagaagttcaactgagaaaatggctgcaaaataatttagaacaagtttgtttaaaaaaaaaaaaaactcttatatcttgtttctaagttgaaggaaatttttcagttaggttttgtcttttcctttgaacacaaacctttctgagttaaatattttggaaagcctagggaaaggaagttcgtgacatggctatcaaatagacaactgatgtatctctaaaaaattccccaatgtccaaggagatacccccttattaaatatgtgagagtctcagagcactataattatttccgtgtcattaaatttagtacttaaatatcctttacttaaatattctgtcatgcaaattagtcttgtctccccaaagaaaatacatagaaactatatcccatactgtcttctacttattaagccagaagactgaacactttttagctgaataattgttactgctaagggtacagttgcattcctttaataaaacaaaacaaattcactcctattaaaaaaaaaaaagttatttgtatccacaatataggccctgtactccaaaatttccagggtgtaaaataggaagtaaagatgaagaagataactgtttcctgggtctttttcattacaggttataagacagcattatttatttaagataattaaatcatttttactctaaaaatttaccttttcttagagccagacagtgactggcctcagttttcctgagcttcctttaaaataaagtttttaaaaacatacattgggctcttctatagatttcatgctttcagtaggatatttctgccaattaataaatcatggctgattaggaatatgtcaattacctgtttgctgcttgaaaggcagaaaaaattaaatgactaaagaagaggaaagtctgttatcctccccccgccaccaccaatttgtaacctcaacaaatatcatggtcacatttcctggatttgagattatttttcaagattctttttcaatatattaaaaaatagatctcgggggacagattctgtccctaaaagtaaacctcggaatagatttattatttatattacttctctgactttggatggagtcttctgactacaatgtatattaaacttttttatgtaatattctccatggatatgcattacatttaaacataatttgatctttctgatctgaatatgtcttatcttaaaatgtttaagtactacttaagtttattaatgtgaagataatttaataacatcttaaaaaaacataattttaagccaaaaggaaaactactggtattgtgcttttatccatttccttgtgttacaagtggtggtttaaaataaatccgagcttttaccaattttctttcatttttcagtgcttgtagttagactaaatgcaaaaggatgattcttcacattcatacatgcattagatttccagtaaagctggtttcactttagagaattaaagtatcttaaaagacacggcattaaaaatagaccagagtaagagaaacattcacgtctaacacagttgttttttgccctacagcttgtccccaatcatttcatctacctattagatattcatccaacattcaggaggtgcagtggagagaacacatgggtctggggatgtgtgttccaatttgggctatgtcagttgtaactttatgcagaactcacagcaggatcctcctccaactttgtcacaccaaggaaataagagatgacagtcctcacctcacctgcccatctgtgttaatactaaaatgaagcaatcctgtatgtttgtttgagagcaactacaaagaagtgattttaatacaaatacagcagactttcattattcatctactaaccacatcatctcacaatgttttgagggaaattccagatatgaattttagaagaatagggttgagagaggtaaatatctgtgaaatgtaactcaaaatttctgctctacttctggtctttctgttgccttctgaacttaatagactgatatttaatacacaacatgaaaatctttttattgtgtgactaagaatatagatccttaatcttatttttaatgtgctattcttagtggcattaatgtaatatccaattaattaatcaatgacatattcaaattaatacttaaaagcatatcaccttgaaagccctaccaagctgttaatagaaacttgcaaaaggtaacatagaaacaagtgtagcaactatgccccaagtgaaagagggacaatagtgacacttattactcccctactgaggtatcagtacaatactgtttttctgattgaagggaaagagatatgattatttgtatgatgtttagcttcacttttgttgatgcggtcacacagattttgcacagagggaggcataaaattttataattagagatttgatttaagaatatgaatgtcaggggtatataaagattgagtgcaaatgatagaatctggggacaggaaataaaattgattgtaagaatctagatgagatcaagagagcatgttagctttgactgatgaaaggagaaacagaaacaagaagatggatggaaagtacattctgcaaatgaagaacatgcctattggttcagataatgtgacttgggaaccactgtctttttgcacgtttaattttctaagaaataataaaacttttttaaaaaatatattctagacatctagaattaagatttataaactaagtgtatcgttagggaaaacaacacgaactttatgttgcctgggtgatcccgtgaaactcactagtcaaagccttagacatcaaggatgtatgctcatttgcacaccttcattgtttcattactagagggcataatgctgccttactagattcattctttttgaactatcaaagcagcatgcaaccggatgacagtaaagattgaaaatagtagtattagtacattttggtccccaattagtgaagggaaccaaaattttgtaattccaaaataacataaaacaaaagaaaaaagtcaacttggcttcttctgtttctaacatttcagcagaagaatggatgcacgtcatctaatgaacttagacaactggatagctcacttcacattgccttctggaatagctggctatgtgagctcaaagatatgagttgtgcagttggaataaattctgggttttagtctgacaccaggctaaatgcaccatgctgttcttcatttaccgacatcatattgtgaatcccttcctctcatggaacatattctgtttcttgatgatttggtagagctagtgtggtagtctctatgccatccatgggctcctgtggcttgcaacgcactttctctgttttcccataagcagaatgagactaactgagccacatggagatcaaacctgagacttgacacgatgcactccaacctgggcaaaagaaaccactgccactggggaattttatggagtaaggtagaatcaacaagtgtatggtttttctacttgttattttaatctcatttataaagtatagaaaatatattgatgctagcaagacaatattcaagccaagggatcctttttcatatctgtttcaatatcttttatttttaaagagagcagccatgtgtatttcatgctgtgtatgatttttaatagcaaacagacctattccagaaaaaggaacaatttaatccctaaagctggtacataatagatggggccagtaaatggtatcacattttacagcttgtccataaggatgacacaggatgaaataaaattgagtgcttttggatagcataggatcactggctgataaatagatgacgctattcagtttttagaaacataaggtaatgaagctggatctgaaagcaagagaaaaaatacatatatatatatatgtattcagtgtttatatgccacaagccactgagcaggaggaaaatctgggcagcggtgagcaaagctgaaacctcagagcaatgtttaaagcaatataagaaaataacaaagcaagcatccataaacaaaggcttgaaatgcacagaaaaataagttcaagatgaaaggaaaatgcccacacttatgcataactggaaaggccacttatggcatctatgcatagagtctctcaatgtaagagttaaacatactactaaacatttagcagaaaaaaaattcaaaaggatataaaacactgcagggcagttaaggattcttggtatttgaagaggggaggaggctgctcttttatcttaacaaaacaggatgttgagaggtggcctaagtgaaacaatgaaatgaaatggttgatgttggggagaaatcaggaaggaagctgtttgaactcttttcagataacactgatgggtatgagatggcttaaccaagggagaggtgttcacatggagggtttagatgcatttctttttagtagagagctattagattcttgacctcagcctcatcaatttacctaacattgcatttccggcactgggagaaattctaacagtctcactttctgggtgaacaagtgtaaactaaaaaaattacagtggcaaaattaacaaattgctgaagcaccttgaaaacggaaataccaataatgaggattcctttcccaagtaacttagaaagaccttgattgtggtctttttttttttcttgaagttgaattttaagcaatgcttcattttcaaaattcccatgcccttgatcaagtaaaaggcaagcttctgatatttgagatctgcgatagatttgaaatcaattcatggaaagggaggttacgaacatactcttttgatgtgtaggatgtactgataggggtggcagaaaattatgtgaaacccttctcttttgacagctatactggaacatttacaaccacagatgttatttgtccatcagaaaagaaaatatttgtttcaagcttcaggcattttctactacagtatcaatatgaaattcaacctcaatttaatgtttaatgcatatgaaaataaatatttggagggggcaaatactagaaaacaattgaaccccacaaaatgtaactagcaatatggaaaaaaatgctggcttcattacgagcaaatttgtccttttactaaagtaaggattgttctattattaacataggaaatcttagatggactgcaaagaatgctgcattattcataaaagcattgctgccatctggtggctacttggcatttcaacactggcttctctgattcggtttgactgggtgctctcgggaggtatttaaagaagagctttaagtggtaaaatataaatgtggacatcctctggccctacatgtcattcatctgatggcagtcctttctccctgtcttgtcgtggaatggaggattcagggagaggaaatgagatacttggatatcttttgtcctgaatgtgaaagtgtattttacatggcttatctaaagaagttactcttggctgttgttgactgatgaattttatcgacattcatttctgttggcaaataaataagtatatacccaaatattaagaaggtttattgaatctaaagatatgctattttgcttaaataagaatatacatgagatgctttaatccctcatttggatctaagcatgaatttttttaagttatcagtcactgaatttgactttagaaataatataatttagaatgtcaaaaaagaaaatgtacagaggttcataaatttcttcccatttattcaattgttatattaaaatgggaggattgttaatgactcagaaactcgtaatccttcttcatgaattttcaagttaaatgacaaatattattcagttcacatcgcactttttgttgaaaataaaatagttaaaatttaagaaattttgatgattctcaagcatcagtgtattaactcattcttaacaagaaccaattagaattaggatatctctgtaattttagtacggttttaagtttccaataatcgtagaaagtctccttggtatgtaatgaaaaccttgaccctttaaatggctatttatatagatcacaagtctttgaagattataggagataatgagttaaaattgccccaggaggaaagctgaagttttcttctgaattctcagggatgatatttaatagttaatattcagtttctagtgaatatttccctgtatcattaaactgccttctgatttagtaaaagtcagataacaaagaaccattacactaaatctggagaattatatactgaattaatattatcctttacaagaaaatgtggaaatgcctatattgaaagtaagacttttgggttttatttttaaatttgtgggtaagattttcaatctgtgaatacatacttgatattccctttgttactagctatttctaccactaaaaataattccttcttcaaaatatgtaatttggcttatggaagaatgttgctcatcttctctaggaagatggctcgattccccatccttcctctgttctccattctactcacatttaggaaggatatgaacaacaacaacaataaaaccttgcaaagaaagtaaaatcgataatgattatatccctgtctctttcatctgtaagtataaaatttcaactaaattattctcctaatagacttggatacaaccctgtggtggtttctaatggctccataatagagatagtaaaccttgtagctatggtcaggatgccctaggttttagtcataagttgctaatgtttgtttcaataacatttgctctttggcagcttttacagctacttaacactaaattcccatttagtcaggaggatcattcatatactgtaatgaatgatgtcaccttaaatcctttactatgtaattgctggatgttacattttatagtggggcatttgatggtgtatttgtttatgctaaattttatgacagtgacagctgtatcttggaggaatgaccttttttttttttttttttttttttttgagacggagtctcactctgtcacccaggcttgagtggagtacagtggcaccgtgttggttcactgcaacctccgtctcctgagttcaagcaattctcctgcctcagtctcctgagtagctggtattacaggaacccaccaccacacccggctaattttttttttttttaatatttttagtagagacggggtttcaccatgttggccaagctggtctcgaactcctgatctcaggtgattaccagccttggcctcccatagtgctgggattacaggcctaagccacggtgcctggccgacccttttcgttcataggaatctagtttcaaatctttttaagcaaatagtttcatcatatttgccttctggcttaggctaggttcccctgaaagaaaaatttgagactaggaattgtgtgcaagcagtttatttgattgaagaaagcagaaattaagaactagcaagagtgaaacagaaggaagaaaagccaatgcagaacccattattgagttggtcatagggtagctaggacaacttgccagaattttccacccaaggatagacaagatgaagcatttgttcattagctcctgagcctttggtttctggttgcctctgggtggggataatgtctttagatcttgagtttcaggctgttcatgggtgggcgtgtcaagaaggctctttcaggtttcctaccctgtagaaccaggaaatatccacagcagatagtaaaagatgtgtaacgcgtgctgaggcaagatgcagtcagtacaaaggagttgaagtccacacagaactgttgcaccagctgcagctgtagtgacacccacacagctaagaggatgtgaagcagggcacaggaagcatctgatgcaatttaccgcttgcaatattcaaatttacttatctcatgttaaatctaatctgttgccatgtcttcaaaatgatggctggcctcaatctctacaaaagagctaataaaaatgtttttgtttaaaaaataaaaataaaaaagctccactcctccactgcaactgtgtatgaggccatatttgatatttatcatctaccaccttcactcattctagattttcctcatcctcagccaggaggagtttagtcggttttgtttgtctgaaggagtcaatcggacctttgtatatgcggggtctgaacctttgattttttttttttttttttttttttactttgtcacgccctgttcactgtagttgacagttcactgctctcatcaggcctagatgtaccacaagacatctcactgaatcatctgacttccagattcattcttcctcctgctgctgtgcatatgcaaccttactttctcattataattagggtcagctatccccatgaatatagtagctattttagttgccctcttgtacacatcatgagtatccatagttaccatgcagtggtcacagctttgagttcatgatacttactaatccctgttagaagcagaactctcccgtatcccaagaataagaatatctaattcagcagagccaaagttgcaaaacccagaagcatacatgctgcagataggttactacgggggctactcttactcctaccttttggtccttagacccacatattccacctactggagacaccatgtcatgtaacatcatgtatcaatggtgtgccatgcattgattcagtgaatatactgcaacttggaatattgaacccccaaaaaacaggatcctgtctccaaactactacctaagcagacactttaagaggccacttcattattagatcaggttgatttcttccaagtgatgtgacatttagtaagaacggcagatcttaagatcacgtgcctggtgtttcatttccctcatttccttgatttcaggcaagatcatgaatcaccccacattgctaattcagcattcttaaagatctggaatggtagggcaggcagagacaccataatcagagaaagcaaacccatagaatgaatcactgttcccccaaggatggaaggggtctgatgttgtcagtttgctgtcaaacacctggtttgtcctgaaggggtcagtatctgcctctgctgctggaagatcatgtaatcagtggtaggtagccttggggagaaaaagccatgatgttgagtgtgtgcagcatctccatctctgccacatggccactccactcatgggcctattgtgcatgttgtaagtgactaaagagaggctaaagaacttcaactgaccagtcatctggtacattggcttaccctctggtagatgtagacaaggatctgcatgctctggatacattcttatgaatcttctaacatttcccaggcttcttgtttctaatctttcagactgtctccttccaggcctctaaagagcaggaaaagtcaccttccattgcctggaaatcagtctatattctaacctcaggctaccctcctctcaagatggctgcttgcctctctgtcctgtgggaggatttctcttcaccacagtcctataagatgactgggtgggtctacggtgaagctgcagtcttttttttttttttttttttttttttttttttttttgtgctcaccaacatactgagctaacccatccatgaatcaggcttgaggttttttttcatcattcatcagctggcttcaagcatctccatgaagccctaggggtgaactcagggagaggcaccagtgttaacagtgacaagaaaaatgggaatttgagccatctgttcatggaactttcttaatccctctagacctgtttaggccaaattctgaatatagcatttcaatccatggattgttgtccactctatgattcagtgaattcaaaaatacccaggtcatcatgagaagctgaagccatagagttgtctgatgtcatataattagatattccttctctattctgacccagcaataggccagaagctacttttcaaatgggaaggatatttttgctgtggaaggtaaggccttcctccagaaccttaaagactttcattgtgaggctgttagtataacctaccacacactccacagtaatattatatttcactttctcactaaattttctgaatcatattcccaagagtcaaggagctcacatgacagcctggacctgctgcaggcattggtagttatgaatagccaccctggtatatgaatgacattcagaaatactcctattgtccaatctactaacttatctagtaatgacagtcccgggcttgtggtcatatcaccctatgagaatatctgagtgaggcccagattcctgattgtctgcaaacagtggcagttttaaaccactaaatattgggccggtttgttacagagcaatagctaattgatacaagtaatatgtctacaaatacagtagtttgatttttacaagaaatggtgacatatttgaaagtcaagttcaaccggtattaacggaccttggaaaaaagataatgagaccacagttcttggtgtcagcttctaataattaattaccaagcactagctccatagaggcttgtagagaacatgcaggtggtgccatttcatctggtcatgtagcttttctgttactcagattgtttacagaaatagctgcctaacaaagttaacttctaggaaggatgccaggttacacggaatcataccagagtcttagaatcacattgggctttcacccaaagtttttgcaacattaggtggaggcaatataatttggcttgaaaagttacaagggaaaaaaatgtcagaaaatgctcatggaacagggtgttcagagtcttcaagataggatctttcttggcctcctgaaaatcagagaaaattgtatatctgtgatttttttttttttttaatagaacgacccaacagaatccagggttgtcacagatcattattaggccaacaactgtagaagttctaaccccaaaattgagctgtaagacataggagcagatagagctacagttggaaaatctaaacatagtctaaaagttttggcgcttcaagagcttctgggggaaagaaaagaaatttgatttctgtgttgctgatggaaaagctcaaaaattacctgagaaaattgtatttgacatatttttattgcaaatggtattttgctatttgtttctaaaagttgaaaatgaccttgcacgttaaaaatcatcagtttagaaaaaatatgaagtctgtttgcatttggaattaagtattccaataatttcttaaatttaaaaactacacatagaaagtgttattattattttggagagttttcgtaggatattccaggccaatgatacttatctgggtaaggtgaacatgcaattcttagacttgcctttgttaacttttagtttttttccttcccaaaatatataaacaaaaaggtttaacttatttctttctgaatttttctgacataaataaacccaagataagcatagtgtattcatgttaaagcttcataacgctaagtctgttctgtcttggactgaaaatttatttgaattccttcaattaaattaaaatttaaagtttcaataaaatatattatttctaaatctattttaggttaacttcaggaatagaaactgatgaaaaacagggggtaaaattattcagttacatcaaactctaggtgttaagtgattttttttcagagttattttcgaaactgtgtgttcagttattactttttcatagtactgagtagagctccagaaacttggaagagtcagttttcaaaaatatctaatttatggttaggaaactgaataacagtcaactatttcccattgtttcccactaagtcctttgttccacagttactttaaataaattttctcacttcatataaaatgcccttttgataatactgtcaatttatcttctaaagtcaagcaaaattaattttttcaatataatacaaatcaaactatggtgaaaatttcagtgataggagaaggtagctgaaatatatttcaagtacaagctctaagcaagtaactaagacttggattatgtagagtgcttactttctattggtgaatactactttgctgggccccaaaacagggcagactaaaggtggttggtagttgccattgtatgaaggtagattgcttttacaaaagatacaatttggaaatgatatgtatctatgatatgtttcttattttgttcacttagcatatttaagtttacttattaaaaatgaaacatttctgagataattttctattttaatgactccaatctgatttagagacagagagatagagttctccttaaattattttgcatagggtttccattgtatggacaaaattcttatgctttttttcataaactttgctcaggattcactcatgtttctaaataaataaaagataaataaaaataagttaatgaagaaaatactaacaggacaatacaaaggaccaagtatcattggagttttggtttatcatagttccatgtatggcccctgtatcagccaaaataggctaaactatgctttgagaacaaatttctgttgttcagttccatactgtcttcagtctgagatccaggttgatggaatagtctctttctggaagggtgtgacaagcaacatgtttgcctttaaagctcttacctgaaagtggcatatgtcacgtctgtcttcatttcatgggactaaggaagtcacagagccaacaaagcacaaatgcataatccctccatatgtacagtgacgacaggaagaaacactagttggcatggtaaagaattgtagaccctaccacagtccctacacaactaaatattcagatcacctgctcaatctaaataaaggtttgccatagttgttgttgctgttgtttaaatgaggcaaactttgataaagccattccagagataaaagcacatttaacataatttattgagtacttgtaattgatggtaacataatgactgatttaaaagaaccattcagctcctttgataaacactgttaagtgtcaagttattcaacaacatatgtcaacctgcatgccgattcatatctatttttaaaatttggaagtgttgggaatatgggaaatttgcatcaataattatttaagtccaaggcagatgcataaattataggagctgaaggtcaaagaattcagggtgaaataagtattttctgaaggtgacaaaaatgaggtaagggttgaaaagtatttgctttcagtaattgaaatatgtaaatgggtttagtcctttttccaatagtaaatgaatgtatgttatacatcatcaaatgaattggtattctattcacagatatttgtataccatttttaaagatataaagtgcatacatatcctacataaatgtttttggcatgttgggaaatgctctgctgagaagatatgctgttgagtatctttgttattggaataattgttttttggtatacaaatatttagcacaaaaaatattttctctagctagttttatgaaatatatccatgtgggcatgtatactaaagtgataatattagaatggatcacagatagaatgatggccattaatgtaaattgctcaatagaaagaaaaccccacattttgcttgggaaaaaaccatctgtattttcagaatgaggcataaacctcatttttaatgctctagatttgttacaacaagtaaaaactactctaattttagcaaaagtaccaactagagtcagtgaaaaatgattgcaattcaactctatgtatgtaactatcatggcaaactaattttatagagtgtagttttttttttttttccactttgaagagattggtgttaaatcctatttttctaatgtagagcatattggtttaaaacaacaaacaaaaaggccctcaaacaacagtcccagtaaaccaagttgcaattagctgccactcctgggaaatattctaggatatgtggctggcacttgaaaaatttacaccttctgaggaaaagcagaaaaattctgtcaaacaattaaactgattggaattcccaagaatataaaaaaccaaaatgagtcttatgttagaaaagaatgggaaatagttctatatatggctgcaaattggagcagaacaagtaaaagattttttgcaccttgtataaatcattttttttctttagaacaaataggaaagtcaaggaaaaactcattgtactagtttatttttaaaaattacacgttagagtttgaaaatgtaattagttaaattacctcaaaatagcaataggacagagagttgttagtaatatttttggataaatgtatgagatggttgttagatctatgtatgaatatacattggacaaccaagttggttaaaagtaaaaatccgtatattactgttaaagaatgtagaaaatatcaagatgagaaatattcaaattaagagtaagatagaagaagaaattggcacttctaagattcaattaggataaactcttataactttgattaaaagaaaactatgcagtacaatggaaagggaaagaccctattgtatctgcctttcctaagtaaatatattccaaagtgttataaaaatttagacatcttagattctcaaggaaataaaatgttttcttgtttaaaacgctgtgtgtttggcagatatcttgaagaaagagaaaagactatggtttgcatgtttcctatgccaaatatttctatgctaacatcttcaaatatgggttcattacgttcaaattccctaatttatatagaaattaaaagcttattaaagtaatgcttctcaaacttttccattaataagtctctaaagagagaataaagtactttgaaagtctggagagcggtcagagataaagatatagatttagggattttcagaatttagatgatatttaacacatgaggttgaatttttgccattaaagctgtaatttttgtcacatataaaagaaatgagtcttacggaagtcatgatccttacaatcaacttgctcttcagttcctaaatttcactatcatagtgatttgattgtattttttataacagtactccttttcagctgatggcagagactcttgatctctgaattaatatagcctcaatgagtcatccttcattagtaagatgaagaatgaattctcttttacccaattaggctctgagcattttccatgaagatgaagcacaaaataatcctgaattttaaatctctgagttggttatgcatatacaccttccaattggaaaaagtgtttcaaatcacttcctataagttataaatgtgttagtttttttttaagtcaagctacttttaaaatatttatttttactatttctttgattatactgagaaaatcaagaggaaaattatttaaaataaatcattctcagggatatactggccacaggtttatgataccaatcttgcaatcatgcctattaattgataagtgtacacatcccattacatgcaagtatcagtacctttttttacagaagttttccaaaatgaggtacatatgttttgttgagggtttataagaaaaatatttctccattaaatattaatctgtgttacttttttttgttttttaaaaacagagtctcgctcttgtcgcccgggctggtgtgcaggtgtgtgatctcggctcactgcaacctccacctctcgggttcaagcgattctcctgcctcagcctcctgagtaactgggactacaggcacgcacccccacgcctggctaattttgtatttttagtagagatggggtttgccacgttggccaggctggtctctaactcctgaccttaggtgatccacctgcctctgcctcccacatattcttaaccaactacatattttttatgaaacttcatttgattttaactttgcttaaaatgttaccacacagtagtcttcaaccttgtagacatttctgttttgctttgaatatgatcttcttggtatttacaatttaaaataaaattcttacccatcctgatcggtagcttttcacttgtattgcctatttttgaaagaacttcaatattttttagcatttagctatttgacccattggtgatatttaatatgttcataatttattttgctgtgtagtatgaagtaactcaagtactctgcacattcaatatcatttggtaattaatgaattgctcttctaatgtttcgtgatgcttatttgtaattacatactactttcctgtttaaataaatgtatctcagagacattttatttctttggtattgacatagtattactgttttagttattttaaacatataatttattataactactagaaaatcaagtctcctggtcaactttttcttttcaaaatatctcaatattgctatagcattctcagactgttagtatggtatggaaacaacctgattttggcttttgtaagtaacctctttggcactcgtgtttatatcttcattcagaaaatgttagaaaaacatatttatcagtcatattcaaaatattttaatgtatattcaaaaacatttgaggtcaagttatttgtgttaatgttcatatcactgatcaagttatgtttttcaatcttcacaaattcacactttctgtccaatagctcctctccatttttcatgtgtaccatttctatctcaaaatttccatctgtctttcttctgtattagaaattgaagtttctcctttccattgtcagcacaattttatgcactattaattatgctcttttctttctttaataaagattttaattctgctactgtatgtagatttctcctgcattgattctttacctttcttcagccatatgtgcattccatttggtattaaccctttaaaaaagcaaatcttccatttctggcagtataaattacaagttttctgttactgagaggtcaacaccaggtacattcctaaagtttctatttcttgtaataaatctaccttcccccttaacccagataaacattttctccgtatcttttaaggatttcttctcttctaacttgtggacaccttttctaggacccaggttgatatatggttgttgtttggttttgtttgtttgtttgcttgttgagacggagtctcgctctgtcgcccaggcttgagtgcagtggcgcgatctcgtctcactgcaagctccgcttcccgggttcacaccattctcctgcctcagcctccggagtagctgggaccacaggtgcctgccacctcgcccggctaatttttttgtaactttagtagagacggggttccaccatgttagtcgggatagtctcgcgctcctgacctcgtgatccgcccgccttggcctcccaaagcgctgggattacaggcatgagccaccgtgcccggccgtttcttacaggtttttatactttcaaatctacttgagttctaacaaactcattcactctcatcttgaaggaaaatcgatgtgtcaaatatcgttttccatgttctgctcattaaaaggagatggatttatttcaagaattaaattgaaatgtattttaattttaaacagtttgtggaatttcaaacagtttgtagttctttttttacttggatgcgggcatgaatctataattccctagaagaatgaactatgccttgtgttcttttaaatcgccggtcattgttgattttacacatcaagtgaaatctatcctcttctcatgctgcttccttagaagctgatggtggtggcaggtgaagaagatgggataaaaaggaatgtgaatggtcctggtggccccagaaaacaggtcacacatggtaggctgatgattgtgaggctttgctgtgagcagggcaggccagaacatattagggaggagagctaacaagggctttcttaacatccatactctttctgctttttctgcttaacatccatactttttcttcattgaaaagttctagaaatgggccaggcacagtggctcactcctgtaatcccagcactttgggaggctgaggtggatagatcatttgaggtcaggagttcgagaccagctagccaacacagttgaaaccccatctctactaaaaagaaaaagaaaaaaacaagaaaaaagaagaaattgccaggtatagtggtgggcgcctgtaatcccaggtattcgggaggctgaggcaggagaattgcttgatcccaggagacagagattgcagtgagccgaaattgcgccactgcactccagcctggcaacagaatgagactgcgtcgcaaaaaaaataaaaaaattctagaaatgcattagctgctcatctcaatccaggtgatctaaagtatttagagagtattatgttctctctctttgagagaactgccaatcgatattcttgattttcagtactactaaggcctgacctcttttgttttcatgtggttttcagtagaaaaatattaatcaaataggtacttgaccaccaggtcgatccagaatcttgctttttaattggatgtgttttaaatttaaatttaactctatatgatggaatttttttttatttttggcattgtcatctccaagtttgacaatggaaaagtactgatgtcaatatagactatttttattttatgttttcaagtactttcttgatatgtttgccagtttataatttcattgttcttgtgtcttttcaataaattgttttaagattagattagtttaaataaattatttatacttctctatatacatcattattctattgctatttgtgaacactatattattttaaaacatttctgcttaaaatattgctacactaatatcctcattttcaaattgttgacatccaaaagtgaaagaaattgggtgggaatactttcatttaacaaattagttaaaaaaaaattcaacaagctctaataggaactaatacatatttttgaattatttgatgatgattggtaataattacagatacttctcaacttatgatgggctgacttcatgataaaccctttgtaagttgaaaatatcttaagttaaaggtgcacttaataccccaatgaacctattgtaaagtcaaaaaaaatggtaataccatcataaattggagaatatctgtactaaatggttttatagtataaaatgttcaacctaactctagttaataagtatatgaacaggccacttactagttggatgaaatatattacaaataaaaaatcataatgcatgtccttatgccatatgttgcatgacattttaaaaaatattaaatacgtcagtgtgggctaatattttatttgtacaattttttaattttataaatctcttctgctaatcttactttgtaaattaatttttaacctattttaaatgctagtcatttccaaaaatttcatttccatattttattcctataaaacttcatccagttagtaattttctatttattgctaatttatttcctgatgaatacaaagattattgaacatagtctggctcatggagttcaaatcttttttaatgaataaatatattttgtattttttttctggaattctaacaactcttctgttatattatgactgggaaaatatctgaatttgatacatgaactttccagaaaagtatggctttctgcatttggtggccatccattttattgtaatcactacttatcctttaaaatttttaagtaaaatgtcctgtgaatcttgttacctttgtcagttagatggcctcattaagtactctgttgtataaacataaatatattagataacaactttgcagcttcgaggaaaagtggcaaatgtctctctactccttgttatctgggccttagtgacttatctaagtcctggctgtctttaaagttcagaattttaggagtacaaagctgtctttaataactagtttgtttccacagagaaaaaaaaaatccaaagctcttcattaattttcattgttacattagaactagcttttctctggtcttctcatctgtacttcattaagtcacattctgtggtataatgttgcaagtttggaaatgcagaaacagttcaagaaattgattctatttgttctttctgttcaatagacctttgatctgaaatgttcaatggtgcctggctgttccacacaagccacttttaaaccattgttcacattgtaatagccttgttatcaggttgtatgaattaattccatcacattaggagaaggaagttagacttccacagcacaatctaataactgtctcatgttaccatacaattgattgggtcacaagacaacacatcgtgtttataattgaactgttttgtaaggtggtcttggtcttaatttcagaatttcataacgacattaataggttttgatttccccaggacaccttgcccaacagtctttgagaacctaacaatgtataactgaaaatgtcacaatgaagcaggccaccactcttggtaaaattcccgaatcaaactcttctgtgcaatgatgtaaccacctacaaacaaaaccagcactttgggaggccgaggtgggtggatcatttgaggtcaggagtttcagaccagcctggacaacatggtgaaaccccatctctactaaaaattaaaaaaaaaaaaaattagctggatgtgtcccagatacttaggaagttgaggcaggagaatcactttcacttgaacctggtaggcagaggttgcagtgagccaagatggcaccactgcactccagcccggacaacagagactccatctcaaagaaaacaaaacaaaaaagcagaaaccacccacaaactaaaaaggcaattatcttgatggggcaggaggagttaggagaaatatggaagttctctagtcagccgctgtcaaaccttggcagagagtagctactaagttgtctgtggagagatcccagagatcccacaggcttgccacaccatcacggaactattgatagcaaaaaatggaaattaactagtaagggaatggaataacgtgttacgttgctgtctctatcacatattactgagcttggtggtggtgagttgcagttagacaatttgcaaacagtaattttgaaacagttcaaatagacacattaacaaattaactatttgatgagctgaattcattcctccacctggttaagttcgtatatgtgagattattctcattacttacttgaaaagatccagtgagcaatttttccttaaggcaagcttcctgctctttaggttaccaaccccagagggatgatcaagtgagttcccagattcttttatgtaaggtaacttccagggctattaacctatgataatgtagttccctggacccggtagtcctctgatacgctggtttgcttgtgtctgtactcttttggtgatatgtgactgctttgaaacaatggataagccctttaacaccactgttcatttgttcatttgtttgacttcccaatgctgagccatttccctcctggtgtgccctcactttgcctctcttccaagaccctggctatctgaacaggtagggcttgtaagtcttaagctattaggtacctttgggcagctttgttagacaactttcaagtgacaagacaaatccataaacccatcctttacaacaagttctttcatgaactcttccttgacttccatagcgagaatcgttcttcccacctctactcttctgtagtgcatacaaccttaaagagactggtgtgaaaattaaacataacttagacagaatggctcccacatcaagtgttcagtaagcatgaataatgtttatgaagaccatttattcagcccaccatttctaatcttatcattaccctttaccaaacactctagtgaaatctcagcactctgttagatctttcacgtgtatcatttctactctttgcagccgacttaccaaatgtatagcttggtctgttttcttgtttaaatgaaagaatttacagagggattagttactttcccctatttcataaagctcttatggcaaaatcagggtttaaacacagaggtgggttgcctgtagtgcctgcattgctaatgtttatttaatattacttctggatgacagttttgctgtctttgtgcattattagaattattaatcccatttgttagacattttttgttaactggcatttttatgcatattttcatatgcctacatattccttctctcattacattttgcatctttgtaaagcaggggccacaactactttttaaaatcttctggccaggtgtggcagctcacatctgtagttttagctacttgggaggctgaggcaggaaggatgacatgagcccaagagttcaaggctacagtgagcagcagtggcaccaccacactccagccttggtgacagagtaagattttgtctcttaaaaaacaaaacaaaaaaactttagtgcctaccatagtttcttgcatggtgatgcttaatagtatgtttattctttgtttggtttaattttgtaccttgctgaaacattggcttagctttaggcacacaatagaaatgagcaaaaacttcagagtgatttagaaattgcatcgttggagacttccccaccacaccatcttatcatctttctatgcactgaggcctcatatttcacagtgttctttgtagttgtcttgtttctgttgctgtgattgtcatttgtgttttgatcctggatttactgaaatgcttccttacaccctcctgaactttctttgcttttccccctctagtatgcccaggcaacctaagcgtggaaatgaattcattcttagccattctcttttcaaacaacaagaaataaagtcgtttatttttcatttgttgcacactcctcagtaagaaaaaatgggcagtttcattacgtatcatttgtttcttatttctttagtgtaactggcagacatgacttgtttgcttttggaaaaaggaatatgagaaggacagattcagggactcatatcaggatccagaatgtccccccaggccttagaattatatatgtgcttgacacatagatgaaatgtctgcctgggtatttggacagatagaacttttacttttacatcttaaggtaatagccatctttgggcatctttctcagaaaaccttcaagcagaagccaatgagacaaatccagagactgtactgccctgctttgtttactaaatgcacctatttatagacaaaacttgaagttggtgataatacctacatggtgcaatggggtcacaacacccattttaatcagctggataatctttagattgattagtttctaagcctgaggtaaaatgggccatgattccttcttcaaattctctgtctctgcatcctcctcttgctgtcccattctcaccagcttctgtaggggccttttcctgcccagttctctccatatggtttatttagagaaaagtacagagaatatttttatactctgtgaggaaatttatagatatagactatgcatctccagcatcttacaaagcttgggttcattatctgaatatttttacattggttgatagtggcaggtctgagactctagcagaagtaattctgaaaacaattccctccaggttgtatttgttacatttatattttttaaaatcccatatttatatactaaacaatacagacattttatcctatgtagaaagaaaatgccaagataaaaacagtgccagggttggttaattcaatagctcagtgacatcattgacaacacagttgttccttcttcctgtcctgtcatcccgtgtcaccttctctcactcacggctgcatgttgcctattgccggtccagaatgttcgtgaagacctgacagagttaagcagattgaaggattctttcttatacctcttgaagatcaaaaaatgcttctcccagatggtctgcagcaggcactcttgtgtcttgctggactagaactgatcacatgcccaccccacaatctaaccctataacctgcgagaggaatggaggtaccatagttgacgaggaaggaggactgacatttccccaacttaaggctctactagtaaagaagaaaatggcttttgagtaggtaactgagaatgcctgctaaatttggccccttttttagacactgaccttgggcattatctattgtcattcacatttcttaccccaagtatctaattatctagtccaaatgcagggtttttttccattccctaatgtagagttccatagtgcctcaaatatttctattctggtacaatgcatatacaactacttaaataatactaaattgactactacagcaatttaaaaatacaagaaatcttcttatttatagtttaataaaaataacttctggcctcttgagcccagaaggcactgtgaaattcatagtcacattttgagatacagatattttgttctttgtacctagctacgctgaagagtttctttctttctttttttttttttttggccaggctacatgtaagatggattaaaagaaggcagatttattatacattgtaggtgctgtttttactcaaatagcagagaatttagaggccacttatttaagtacaaatgctgcctcctacctaagtcacttaatcaggacactttaatttctaccactgctaaattcagctaataatacctgccccctatctacctctctgggaagctgggaggattaattagataaagtcttaaagctcctcagagagaagtggtatatgtaaaagatgttattatttctagggaagaatgaagcggtatctcttttatggactgtccacacttctagaattttttcctcttattcagctcaagtgccaattttgtggattttaattcatcatgtgagacccttctcattctcaagtagttgtacttagagaaaagattttcaagtattgcgtctgatgatgggaagtacattcctgagtttcactgaatatttcagagcactatcctgcaaactggtatatatgctggaatctggttgcaatatttgtaaaaacaagccatgactgcattgcagaatgtgacccgggcctatttttgagatcctttccaatccccatgatctaagtcaggtcactttggacatagaagacaaattgatagtaaaatcttgaatctctcataaatcttgttaaatagtttatatttaaatattcttttgagctatacatttttatatttagattacagaattctatccttcaagaattctcagttttggttatatagttaagtgtacacaattttcccaacctatgatccactttacagagctttgagtatgcttgccttttacattgctttattggacattgaacactttcattaactattacattgatggtttcctgtttagaaattgagttagcacatccctgtgtgttttggtaactgcagctgctacttgatgttaacaagtctgcattctggtcagtggtgcagcagctcattacagatagagatgggcttattttctcacagtagtttgagaagccagtgagtcactggatccactggagatcttgggagagcttgggaagtggctgttgctgggaacagccaggttgacttcccccaaacactttagagaagattttgaccaccttcaatcattcacactttctagaaatgaattcaacctataattcttcacaagtcaaaatgacagattctttcaaagcaaaagcatagctatatgatttactggaatcaggttttcatatttataggctttcttttaaaaagataaaatttcttgtttttcttccagttctaaaggaaaagatgagaaatgagtgtcaaatttgactcagtgactaataccaaactcactcaatctgccaggcatcaggaactgggcaactcaataggagcaagaaaggatgtagggagcacagtgtcattaggggaaaagcctttaccttgccggaggatagagtgaagaagaaaatcaagggtcaggtcatttctaggtctatttatcacatgaagaaacaataaagagaggttaatagtgcacttaagacttgcactaccaaccacttacctaagtcaggtattgggccctgacccttctcatcataaactcctctgctcttggcagaagctagaaatgagggtgagtgaacacgggcctagcatgagagaaggcagaaatggtttttccccgtatggtgacaacatggcttttcctagtgttaccagcttcattcatcaaaatgtattatctgtctatggtgccttcttgtgaagcattcacagccaagaggagtgctgacattagcttaaaaagctaagttttaaggctttgatgaaggattcactgagtggttttgagaaaggagaatcatggctttgaaattcaaacacatccttaactaccaccctcattccaccaattaaataaagtgaaatgatgaataacagacaatttataagaaagtatctatagttttagatacaaagagatgacaaatgcaaaaagaacacccctatattttgctagaagaaaaaacatttagatacagattttttagaaagtagtacagctaattagcagtagagccatgttttacttactacatgctagacactaagaacttatgcttaatccttaaaacatcactaagacagttacacccattttacaaatcaagaaaagtaacaaagattccagtcacttttccaaggtcatataattagtaagtggtaaaagacaggcccagagctagggcgatctatttatagatggcttcatgttgactactctgctacacatgtaatgaagacaatttaaaatgtggaaaataataaatgctaattccagattttcaaaatacatcaaatatatacataggaaggacagtaatcacaagacaccattaggctactttaatataaaaagaccaagagcttggatgaagtcttttatacagaaagtgctaaggagcatagcaagatgagttttatattaggatataatataataggataagatatgacttattgttaggatgtttttgcaattaagatttgcttaaaaatagaaacatgcttcatgaggtcctgcaacagttcaggtaggaagcaacagctaaatacaagagatacttcaaatgactcttccataggtaacgtggactcccgggaaacgggcctaagaacccaatctctcagatgttataatgaagctgcaggtcctctttacattggccaactgttaatgatgatgtttcattatggtaatacaatggccagtcattaccctcacactttattaaaatgtacatgtgttgcagatacctcatcttcattagcaatgatagactccgaatattctactttccattttaaagaatcctactattgagataaagagaagaaaaacatttctcactttattccttttttatgctttttgattgctgaattatgtgaaagtgttacctagccaaaaatatttttaaagtcttctatgaatccagtattcataagcttatgtaactcttccttcactctcagactaaatgaacttgttatagatggaattgaataaagttaccatctacagtactcataagttttttcttttagtagttttcagttttagtaacttcttggagttatcactttaaaattgtgtttctaatcctcctatacttgtaaataaatttgtaaatatcagaatcatattgtttatgatatatgtaaagttttatttccccctaaaagtctatagactttaatctgccctcgtatggaagtttctctattactttaataataattttaataatgttataattacagaagcaccaaaaataaggcatgcatccatctctcattgtataacatcattattggtgtattagtttgtttgcatactgctgataaagacatacccaagactgggtagtttataaggaaaaagaggtttaatagacttacagttccacacggctggggaggcctcacaatcatggcagaaagcaaagaggagcaagtcacatcttacatgggtggtggcaggcaaagagggagaacttgtgtcagggaactcctctttataaaaccatcaggtctcatgagacatgcgcagaacagcacaagaaagacctgcccccatgattcaattacctctcactgtttccccaccaacaacatgtgggaattgtgggagctacaattcaaaatgagatttgggtggggacacagccaaaccatatcaggtaaatattaattgctccatcttaaacgtgagaaaactgggattcagagaggttaaataacttgccggatttcacacagctgataaattacagagccaaaatttggacccagatctgttttcacaacttgtactcttctcacactggcatgctatttagaaggttagcccttttctggttaggcttcctcctctactttacaaatcattaagtgctgcctcctgttggtctcccttggcgttacgctgtagccagcccttcaatacaatcagtgaaaacaatccttgttgggagtagatcatttcggagtattgattctaaatttgtcattgttttccgtgaaagctaagcatagagtataaattgccactcaccacataaagttgatgactttctatgcccaaatgatttgacaatttgtgatttttccccaggagtttttttgctaacatttttcaaggcaaaatattcaatccctgtccaaaatgatcaaattttgccctgcagcaaacttgtaaatttttgccaggacccgtgaaacttcacaaggcaagagatcaataatgtcacactgttcccttctcaccgctttcctcaatgtacacactatctagtttgaaactgccaacatgagaaagtaaaaaatttaagggacaagtaaggaactctctcctcatcttttaaaaatataggtgatatctttaaagtagagatgatctgtctgtgctcaaaaatttgaagtaagacaaaaatttagttttggatatttaaattaattttacaaaatagcaacatgcatgactctactcttgtattatcctgttgtgtatgttcacatacccaaaaatatttttggtgttctgcctattgtgtctgatgctgtcagcctttgttgcaaatcaggacttaggcaaagagcccagatgggctttgcactgctgtcatgccaaggcactaagacattttacttccacctgtaataatattaaggctttacttcttcaacattaatttgatgcatacctttcttttttcccccacattaaaaaacgtcaataagtgtgagccaatgtttcagtagatttcatcactctttctcttcaaactttgtctttctatccaggtctgtcttgtctgcctgaattgtaactgtgaatattttcccatgttcacctattgggctttcattcttcttgatatctaattcctccttcagataactcatccattttcatggcttcagctatgcctttacttgaatgatttccaaaattctatcgccaatcctttcccctcatctaagcaccagtcatttattttcaactcttcactggacatttctactttgatgatttgcccccttttcaaaataaacaagctgaattctccacccctcgatcgcctcccactcctgatttcgtttttgttttcaagaatagaaacctgtttccgaatatttatttggaaataaatattatccatacttgaaactttgggccaaggcacaagaatggcaatgcaaagacgtacaaaaaactggagttaacatacagaagtgcagtgagccaggctcagctgtatggacttggggccttggccctgttttactcagcgccacctaatggtcaccatttagaaaggcaggcctacttttgccagatgcaattttgcaaaggaaaatgtaaatgtcaattttatagtgaaatttatcaatatgtttaaacgttgtcactgttaaacaaaatgcagcactctggaagcaatatgaagtttatatatgagtatgtttattccaagagctgccaatttgtgaccactacgaaatcagctgagctaaaagacaattggaaaatatataaataaataaaaagtaactggcagctcctcttggttatgataatgatgctagagctaacacagataacccaaaagaatggagccgttccagtgcgtcacaagactttaggacacttacatagtgttctgaaaaataggctaaactaatttcatcagtgagataaccaacattgagctaaacccacaaacctgaaattaaacatcacacattgtaaatcagtgaagcaaaaatcaaacatccagaaactacaaaaagtaatcctgtctcttttaaaataagcctcaggttattcttctttccttaaaggtgctctgaggcatgaaaagtaaattttcagcctaagagtggtagatttcaatgaatatacaatatggttcccatgtctcaaattcttactttgttctgtttttttgaaagacaatgtacatttgggttttacataacatataagcctttggaaataaatattacagacttctaatgttagacttgtggaaattgagccaaagacatacaccagtcaaagacatatattgatgacataaagcaatctttgtgacaagatcgcttaagatttcaaaaagacatatgcagatgaaattaagcacatataaatttatccaatggttacttaaaaaataaaaataaaaattagattaactgccttcacacttgggatttttacttgtaaacccaatactaattgagaaaattaagaaactatggaaacttaactaattcaatattttttttcaatatactggcaagggtatttttataaacataaaggaaatgcaaaatataaatatactaaaacattaagatatataaacactcaaactatcattacaaaatctatgtgaaatataaatcaggcaattgacagtaaataatatgaaacttgtactttgtttgctttagaaatattattttattttccaatatctttacctcggtcaggtggccaaactgtctgattagaaatatcttagcataaagatgaaaaatgcattctatgaactactatagcataaaggcttttgaatttcttctgagttgccattgatctgcacgcattcatttctgaattagaaaacagctaatattttgtgaaaagaggatacatatttctttaaattgagaaactaaatttcatgttaatatagtatcagtttattgtacttcagattttagcacaagcatttcagaacactgaaaaactatatttagagtgagatctacatattccatacagatggaatcagtccatgaatatatattggtatcattcttgccagtcctaataaaactctgtctttagtgtgtttgaacaaggcttaagttatacatgaaaactgaaacatcaaaccattatataccatttaagtgtagataaaataattttacatccgtacaatatttttaaatgttgactttagcaaaaacttaaaaattctctgaaatttgaaatgaaaattcatgatgcacaaaattatgaaagaagaaaatgtctactccaaatatcccataacttttttgaacaaactctgttgtgatttaatctttttcatttacattttctgtctgtatttgagtttacaaagtgctttcaaatgcaatacaacatttaacctgcactatggccttttgtgaaaagtggtgttattgtacttttaatgatgagaagagtctcctggaggtgaatgaccaacttcatcatcacacaaccagaaataaatggtaggactgaagcttgaagctctggttctctgaatgccagccagagtgttatttctaacagaccacagtgtgctatgctggtttctgatcagatccgtttttcctctatccattttacacacataaaatacatgagaacaaggtaaatggaacaattctaagttttttagtttttctttgtaatttgactctcttgaaatcccagctttgtctaagcatagcataactcgaatatgaaatcatattcatgtttgtgtgcatctgcatgtgagtgtgctcacccatatgtatacatgtaatgaattcctatacaattaaatgcactgcttccttttattttcttcagaaaaattgccatggttctaagaagaaaatagagaaaaagagaatctcagtaactatacaggaatcaaaggatttagtaaaatggaaatgcatcggcaggaaatcataaatttgttatttttttaaaatacagtcatgtgccaataggattacattctaaggaatgcataattaggcaatttcttcattgtgtgaacatcatagagtggaattacacaaacatagatggtatagtctaccacatacctaggtgatatgatggaacctattgtttctaaaccacgaacttatacggcatgttacggcattgatcttatgggatcacccttagtatatggactgttgttggccaaaacattgttatgtggcacatggctatatatagccaggtgggtagagcccatctggactgtaaatacataattcttaggagtctaaagttctagaggtgaaatggtttgacctgagtttttgagagtggaatactcaattgaacaaatgtataattctgtttctgtttcttggcgtaaacttattccatatatattcatatagcttatttttgtctaatgctgatataaaatttgactaataacaaaataaattatattagtccttagaagggaagtctgcttttgactttaatgaaatgtgccccaaaacacattggaagagattagacttaatctaattatctgttctcgtactacttaggacaagcgctttcttcctttctcaaaatccatcttgtcttctgctcggtttcactgtaaacttgaaatcactttatgacatcagcctgtcaccctgaaaataacagatatcccagatgtgtcattgaaagttcacttccaaaacaaagaggaagatagaatgggctctcgggggcctctgatcttgtttaaagaaatgtctgagtcccagcgcggtacctcacgcctgtaatcccagcactttgggaggccgaggcaggtggattacctgaggtcaggagtttgaggccagcctgaccatcatggtgaaaccccaactctactaaaaatacaaaaattagctgggcatagtggtgcacacctgtaatagctactcgggagggtgaggcaggagaattgcttgcacccaggaggtggaggttgcagtaagctgagatcgcgccattgcactccagcctgggggacaatagcaagactctgtcccaaaaaaagaaaaagaaaaaaagaaatgtctgagacttctgctctgtgggtctctccaggggaggtgaatgcccagacatatctcacccctgcaggctatgcctttcaggtgaaggatgctgaatgttccattcagactgactttctgatcttccaaactttaagaggttgtatcggagtcatactttgaaaagttatctcctcaagttcctggtattccctgatggttcagaactcatacaccttggcacatgtagttatgaaagctctttgcatttgatgagaagcacgaagaagcaggaccagtgcaagcccatatgggaaaaagtgccatgtgattcaatagtatataaatcggcctcccatggtgacagaaggtgtcattcaaggccataggccacagggagagtgtcactcatatgtatgcacactcagttcagtcctgtgcacatcctacacttccgaatgcatactgaccattttccccttggagtcacgtacacaacatgcagaatggttatgtaggagaaatccatggcaacagcacatagcttgtagattgtatttggaaaaaaaaattaccttttctaaagttttaaattttaaaacatgtaattcttgagatttacttgattcaaacttgaaaaaaaatagtgttgcacaatttttttgagcactagcttatcttaaggctttctgaataacctaagggctattcagtcttccttttagaaacctccgagttatttttctgtgctgtgtacattttcatccacaagaaaaatattttcttctcattcccttagattcctcgggacactttttttttttttgtctgcagacaccttaaaggactgtttaagaccctatccactctatctattcttagcttcacctgaagggcaaaatccctaagatcttgacacacatactgataaatacatggaattattaaaggtgccatctcagcagaagaggattgctgctgcctttgttctcgggggaatacatatttcacccagtagcaagacacccaactgctgctacaatcagaaatctctgaaatgcctttaagctaatcatctttgaacataagcctttgttgttgaatcagggaccttctagatgcaaggcacagaaacctttttttattattttgttttttctccaccttgcacaaaacagcatcaagcctgtcaccaccgacagtaaggttcagtgatctgtcaacattcacccctgatgaagacagtgagagaaatccatagctctggagagttcaggagagaaccaaacagtgtgtttgcaaaagagcatttttatatgttttcttgtgacagcactagtttaacagaaaatagttggagtgtgccaaaaagggggaaaaatgaaagacagtagtagtaagttaggctagcatgacatgatggatctgggctatgacaaaccaaattggaacaaagcttccctggggaccaactataccaggtttgctgaattgtatttcttgatttcttactgtgcaacagtgcttttactgttagattgactaggcttcagaatatttttaaaattgtacaaatcaaaatccatgtagcttaaaaatgaaggatgtaaaaggtttaggagtttgatgtattgaaaggcattctgtattccctcatgtgagtattaagtatacactttgtctgttcgatgaatttcaaatctttgtggaaggcagtagacacgatagcagtttacagggtggaaaaccctggttggaaagcagggcacaggctggagagattcaaagcttcttcctgcttatcccacccagatgtgcccaggaattgcaatatgcagcatctgtagggtctcacttgttctgagatgtttatataaaggacaagtaaagaaaccttaaatctggtgccctcttaacaaaggtgtgatgcattattcttattacttgtcctttcaattcttacctagtggctttcacatagtctaaggtaaggccagaagaaaaataaccaaaaaaagaggaagaagaattatttcaaagctgctaaattttactggttttcatataccacgtgaaacctaacaactagacaatctgattctttacaatagtcattcataataaactttgaataaatatctaaatgaaaggactttcttaaatacccaggcaagtttaggtactcaagctgcaaaggcataaacaattgagtccctatctttaaggagtttacaagcaatttgaataattaatgaaactgtcagagtgtaatgtgataactaccaagcaacagccaagctcaaagcagatagcaaactatctagtgggcttgatcaacacagctccatgactttcccaatagctatttacgatcaggagaagggtagagtaaagggatgctgaaagtgaggtggttggggttcagtaaaatagaagatctaagtattgaggaaggagagctaaataagacattagttcagaacacattaaagtaggaaacacaggctaaagcgcttacggctggtaatgtaagggaataaagtggtggtgtttaagggttaaggaaaataggaaatgatggcaacaagcccaaactcgagtttgtcccatccaaaaaaagaaaaaaaaaaagggcagcggctattcaactatagcccattgatgcatgccagaatgtggagcaatattgccaaatcttctggtcttccaagagaaaccagaaatctggattttcatataacatatatttaaatttagaaaacttttttttaacattacacatgacgtggcattatgtgaacccaatcaaatgcacctgagaattgttttagcccatgcactttcaagttgcaaccgtttttttgacatactcagatagtgtgtaataatggatacacaatgtaggaggaggaacagggagcctgaactgtttggggtaatcatcagattcaaatactttttaacagtaaatggctggaatgggttaggctgaggatacaaaagagatttagaaatgagggaaacacagattactcacttctcaagtagagtatgatagccggcagcaggtaacgaggtagaaaagaacagagccagctaagtgtgggtatggtcaagaaataagagatttgtcagaaaggacttaaaagacagaagagaaggaagaagacagggtgttatgaagtggccagtgagatcatcagtgagaggatacacagtactgttctgtggcctgaaagtggcattgagctgatcacaacagaatgccctaagtatagatttttaagagaattattgagagcaacagactgtttcaaacagatttgactttgaaagtccaggtgatttaaccctggtttgataatttctatcagaaatacagcaaataaattggttaactgaattcaatgcacttgcaaaatgtactaaagacagtttgaatggtattcgattaagtattttggggggtacttggggatgacaatgaatatgatgatacattagacactacctgtcccaaggtgtttacaatctgtatggaaaagcagcagacatgtacatgcaaacacagtttctctccctccctccctccctcctcactcactcactcacagacacactcaggcacatacatttgtgtgtgttctaatgcttgctaagtgttatgccataaaagcaaagcatatatgattgttcaaaatcaaatgttatagttttttctctaattctaaagtacttcagtgtattaccaggtgggttctcttcagagaaccccaacagcaggccaggaggcagtgtgctggtagatgccaggcaatccagacaggatcccattatcttcctctcttgccacttttgttaaaacctggtaagactagcactcagcaaacgttcagtgagttacatgttttaatttgaatgggctgatttgaattcaaactgatgaggtttgaaccttgcccctctatatctacccattttatcattgcccaccttctcttcaccaaggctagagctgagactagcgctgaaaagaaaattcttggtaaagaattccggaatcttttaagagttgtacccagacactggagaaatttaatcaaaaactcagttacatagaaacagcatatttaaaatgtttagaataaaagtattttagaaactgggaagttttaagacacttttgaaaagccataactacctctaacgcgatggctatttcacagtggtgctattagacagctacagccaagtgccccaaattaatattaataacaatgagtataaataatagtgggcttttctgtatataagcacatcctattcttattttaaaatacagtagcttgagttttgcaatgactattaaatttcatcagccattttggggtgacagttagcttccagccaataacagaatattataaaaggagaaagttaagatcaatcttaaatgtaatagtttttatataagtgttgctgcttttttttagttaattatttacaaatgtattttctcaatatataatgcaggaagatgccaatattactcaattattttgatccatttataccttgaactaaggaaataattggtatgccacccctaatattcatttactgaaagatttgtatcctctttggtttggttttatttatgtgtaaatatgcatagttcaaaacttgttagtagcaacactaataatgtcatttatatacttcaccttgtccatttaaaatggattgttctatttatagagtaacagcctgtaaaattaaattaaatttttaatagaaaagacagtccttttaaaaattattataatagaaaggttgatttttttcataaatcacttccaaagtaatttttaagaaaatcttattttagttccaaaactttaaaatagtcttattgatttttaaaaataattattcatgtaaaataatttatggcagagttttctgtacttgaaaataattcttataataggaattttacaagaccatttattttagcagtgctaggaaacacaactataatttagaagctattgttgattgtttctagaaatatatatcgacctcattagttttaagtgataacattactaagccaaagttccaatccaacagtaccagaattactgattgtaatcagttttcttcgaacttttcctttagcacttagatttcacttagcttatcatacataaatataaatgtaaatttaaattatcttagaattctcattattaaacagtatagaattaatacccatggaagctccagtgtctaaagtcttttgttacagtccctttggtatgcatttggggtctggttgtattgataccaccctcttggacactttattattaatcaagaagacacccaatggtctcgagaatcttcaccacccaataagcattcactgagtcatttattcatcgagtaatgctctagaggagaggaagtcatcatcctcatcactagcaactgacatttattaggtcctcatacatgccaggtgtgtttctacactcttaacatgtgttaacatatttagtcctcacaacaaagtgttcctgaaaatgattttgtgaagtttgttagctggatttacaactgttaaatatttagacacatggtctgcacatctccatttatattcttgtcttgagacccactgattgttaaaggctatcccaaaacatatccatttcgcacagtttagagtgtgattttatttatttcggcagaggatagattaaactgactttggtgtcttaaaccacatcaatgtgtcaaagatgtcaggctttgttaatgatgcacaatttactaagcacctgatgaaaagcagagactaaaagtttcttaggtaagggtcttcaggctgggtgttctgggaggaaggaaacggaaagtaatattaatatatatgttttgcaactattaagtgtcaaaaggataatgtgatcatgggatattcatattcaaatccaagtttaggtatcatttgctgacaaatgtttaacacaaaaactcaaaggtaaaatctctacttttttgcctattcagtttgaaagttctatagttaaggcagagacaacagcaaaatcaaggataaatatttgaattactctaagtccatttgacaaaaataaagttctggaaatgtaactcaatggtaaattagtcttagtcaatttctttacttaaaactcttctggtatttgtcataatgataaatgatcatctcctctaagcccttcctttccccataactgaattcctactcaataagcaccttaaagattctaagacagtctctgttgttattcttacatactctggaacccacagcacttaaatttatgaatggtttgaaccaccaacctattatgcaagcgtaacctaatgttctttgaatataagcactaggtaaacaagaaaatattgccacatgcatttacttagtgcttctgacattttgacatttaatggattgataattaactttttcaagactggtagacttctctccaaacatactagttaggataatactagctgctgtaacaaagcccaaaatagataatggtttaaacaaaatagaattttattttgcactcatgtgaagttcagcatggacattgttgattggcaggctgctttcctgcagccattaaaccaggaaccctgactcttcccatgtgatggacccagtgtcttcaacatgtggcttctaagaccactgtttctctacatcaagccagtggaaaaggaatgaagaggaggagggtcctacttagactggaagtgacacacatcacttctgcttatttcttactaggaagtgtagcctttgggggacagccactttccagcatcatctgccaaaggcactccaaaatgcaaaaatgtcagtgattagtccaaagaagtgactggaggattcaggttctctaacatccagccaatggctcttgttactagatcactgttttccagccagtgggactctttctgcaaacaggtgacctctacttggagagaaaccagaagaaaatttaattgaattctaagctaatgagaagaaatgtaatcataacaaaataatagccagtgtttattgagcattcgatatgtcttgggcattcttctaagcactttatatatgttagtttggttaatactcagggtgatgctaaaggaaattatttttagtagccccattttacagttggggaaactgaggcatggggctgtgaatatatttcccaaagccatatggtaagcatccaatgaaatctggattcaaatctaggtagtctgattccatcagattattttatcttccatcaaagatagaaaaatgccatttgaaaacaaaggggaaaatggagagaaaaggtttcttcctgaaagaaactttctctaattaggcatggcttaagttacacagtttgtaattctgtacaactcactctcaccctgtagacttgaaagcccctgttcttttccctatgattacttaccttgtccaagtcatgtgggctcagaagagggaaaaacttaaaacatggtctctcatctcaaggaagttagattctgttgaggagaagagaccctaaaatggtaggaaagaacagtcaagattaaaggacaaataaaaggcagacaataggatttcagaaaaggctgtaatcaccacacataaattaccaagaaaggtttcatcaaggatgttcttctttagctggtccttaataaatgggtaggatttcatgaatagagaggtactgagaatgtcaggggagaaggaagctgagaacaaagtttcgggtagataaagacacggtgtttgtagcagccggtctgtaataacaagcaattttaggaattagtgagagttacatctttatccatttttactttagaacttatttttttgcatatatttttaattctatgtaaccatctggtaatgcctggcactctatgatttgttgcagtagtagtgtttatctaaggaactacgtatgtaggcacaggaaaatgaatactgagttctgggaacaaaggctggggagggatttccaaacaaatgtcaccttctactcatttcaacaagtgtaagagttaagaaatgtgcctcgctgtcaccacatttctgggcctctacggcttgttacagagaacctaaccaagacctcggtattctggctgtcctgtctaactacatttagagtaactgaccatccttacatacctatatcacttcccatccctgctctctcatgcagagaatatttcatccctccctcaaatcaagggatgagcccctggaggacagcgagtgagttctgaattctctgaggagccacctctgactacgactgtccctctctgtcaatcacagagcacttcgagtgacatcatggctgtttgcagtattatgctgttgctgtaggcagcatgaaattgacaaggaatggcacagagaagagctgaaagggcacttctgcttttgtgatgcatctgacacctgtagttacaagaaagaaaacagctttcataagcatattgctaggtgatgtagaaggtgaatgagaatttagaagtagtttttcaatgtaatagcacaatagaatctaaactgcttctgtgcacttgcaccctaagaatatcttcctaagtggaagccatccggtaaggtagtttctcagaaacctttgggtaaaaagttaggcttcagtgaaaacccaatctagatctcagaacgttttggtctatgagatgggggtcttaccagctctgattttaataaaatataccttttttagaaactcgatcttcacatttttttaaacttttactttaggtattagggtacatgtgaaggtttgctgcataggtaaacgtgtgtcatgggggtttgttgtacttactatttcatcgcctgtgtattaagcccagtacccaatagttattcttcctgatcttctcccctctcccctcaagtagatcccagtgtctgctgtttccttctttgtgttcgtaagttcttatcatttagctcccacttgtgagaaaatgcagtatttggatttctgttcctgagttagtttgctaaggataatagccaaatatacctttttttccttaggttatatgcttatttgtatttcttctacctgagaaatcatattatagattgtaaagctagtgtccaaagtgaagcagaaagaaaaaaggtaccccagtatcttcctgagggggagcctttcctatgactgaactaacaaattgacctaaatttgttattattactgtaatagtaagagcaactctgacaattaagccttagcaagagaggggatttaagcccaaataaagtcagttgttttgataactgaagtagttttaacactaagtggacaggttacaaaattgggaagcaattgattgtactatgctgagagatcacaagtttgcacaccatccataatgcattcaacttgagcaatgtactgagtctgcagtactctgtgtgtgaacatggttgactctgcaccttcctgtagcagcccacagtgcaaatgtcatcttgataactctctgctgggtggctccttagaccctgtcatcctgatcttttgcctgttgtctggtcatggtttcttccttgttctcctttaccccctttgtgtggaaaaacattttagtctttagcagcaaatcaaagccattttcaggtgacactggtgatcttctctcttacaggtatatccttctgtttcaggtttgttatgatgaatgtaaggagcacagtgaggaaagctattgccagtcttactcacaagcactataggaaaattaaaaggaaaagtcttcctgtaactatttgtatgtctctcaaaccatggaaactaagaagagctacaattattgaaataaagtgctatattccaggctaggccaaatattcagcagagagcctgaatatttcatgtatatgcagtcaggaaataatacagaaaaaagaaacccaccacaaaacagtataattgaggactattactaggccacatgttttgaacacagtatctcatttaatcttagtgacaaatgttctgtgtgatcttctacctttagctcggcccattcctctacattcctatgtcattttgtagacttatcattttaattgttaaattatactgccctgggttcatagatatcattctctccagtgggaacctcttactcatctttttattccctggcatctatttatctatcaattgccaaaacaaatagataactagagttgatttgttccctatcacttctcttcgggctctaaatcacatcaagttctcagatatctcatccacgtatgtattgctatagagatattagtacttcaatccacactatgaattcccatgtggaaaaaatggtaaaaaaggtaatgttaggattacacctcaaattgatgtaatccctagttagcatctcgtaatactgaaactctttattatcctcttagtacaccatggtattgacagcactttgttttaccttatcattataacatcatctgtaagaatttctacttgtatcattaaaagatgattatgacagcttcgctaagcctcattcatgtgaatggaaaattagtgccataaagaaaattcctaataattattttctaggacgtgttggtacttttcaaacttaaactcattaaatcgatttgaatctcatttgagcaaatccacacaaactgagtgtcttattaatgtcagtctcatactacttttaggaaaagatttaatcagaaaatatgttaataaaatccacatgcatggttttaatctcctcacatatatggcaatagtgtctatggatctcaatatttgggaagtgattatcacaataatttacatattataaattatcaaagtaaattgaatttaataattaaattatcaaagtaattcaaataataagagcagacactgtgctagttgttttacacttattatcttatttaacatgagaatttttgtccccactttacagatatcataattgtgaaggtcagagaaaagtgacttgctcagggtcacgtaatgcatgtgtagcaaaaagctttttgggacatacttctgatagactctaaaatccttatttttttaactttgctacaatgtcatattgattcatgtttccagcactgggtccttcctttcattgtttcttcaagagcaagagtatgtgtctgatataaaaagcaagtactgagttttcttaagttctagttcaaggtctaaaaaataatgaaggattaaactttttttattcaacttatccattatgaaacatacttgaacaaatacacactgcagtaattaaaatcagcatgcaaaatgctttatgtaagtctagagagacagagtcaaacctcaccactctgaaaatttgtttgggttctattttcccagtgagtcagattttcctttttaagcatcaagagatagtagccaacattttggatggaaatcctctaaatatttaccacactttctcataccttgtctgtatctaatttaatataatgctttattgatgacatctcattataaacatatattacattatgtaatgttacagagtggccctcaataatcgttgagatatgagagattattgaatcctacactgaattttccccttattatatgaagtttcaccttctagtcttacccttatctgccacttttttctacgctttgtgcttctttccatggtactctctctccttttcctgtttggctacaagttgagaaaactactttcttaaaattgtgtctaaaataaacactcacagtccttaatgaggatctaaagagttcttctgtaggcaaaatacaagtgttttccatgaatgtgtaagtcataagtggtgaaaatttaaattgttttaccatgaattaagacaggccaagtagtttgtttacctgggaaatattcatggaatattttggaaacaaccatgttggaaagggcatttgagtaatattaaagaggaagggttgtcatctttcaggcagatatcaaccaacaaagtcttcatttttctccctcctatatcaacaaaaatctataatacacttgtaaatgaggcagcaagatacttacctcatgtgattttgtttaataacatttgataaatgaaatatctgggattataaaaggaaaattgaaatgtgtatagacaaactataaaacctattcaaaggggcataaagtctgggaacgtcctacaggagtgtgattaacctgatacctatgtagaagggaccaggtctgttggtaccagtgtggcacatggaaatacatcattcaatttggtcaacagatttggcacattcaaagattaaaatgaagctgaacaggatgagacctcaggatcaggtgtggccttggtgaggaagaattaattgctaatactatatataatcataattttttcatatatgaaaacttagtaaactgtatatacttttacatatggtttcaagttatctctaagcatccatttggttgtccatataggatcctcagtgtatgagttggtgtatccctaactaatacaacagatgagccagaaatgtagaattgcttaactgaaacaaacattcagacctggaactctacattcctgtaagcactgggggttcttggttaggcagctctcccctatgcagtgattcagggaccctggtaccttgcattctgtggctatgcttcctcctgaggcctcatcctttctgtccaaagagagaacatagacaagacacacagctacttaccagtcttgtcccataaatagcacacatctcatccccttacattccaatgattagaacataaacatgtggttactccaaatgcaaggcaggctgggaaatggagtccaattgtgtacaagttagaaaagaggaatttggcactcttgggtgtgttacatattaaattactacaggacctgtctctcagagggaactaccaaaccaacaagtttggtagcaactgcaccattgtatggatggaataactatattaatgaataccttaatgtgtatgcaatgtctgactacacttttttttctataagtcaaaccctcagcatgaactctaagacaatgcccttagtttttttaccatcatctttgccctttcctggtgactgtattttggctaaatactaaataagtgaacatgacaagaggcaaatatgaatgagatgttcctgaagtgttatatctaatacccaaacaccaagaatatatatttgagttgaaacttaatatttgcattccttttcactatttacttgttaaatcttagattattaaaggagagctgttcaatgtctctacactaataatgttttgaagataataaacaaagcccatttgtttattacacttcaggaacatctcatcagtatttgcctcttgtcatattcacccatttagaatttagccaaaaaatattcagctttgtcaatttatcattttcttaaaggtgacaaaagcactaataaagaaggcaacagtcaatatgtgataaactttagctatgtgtataaaaattgtctccacaagtcactatgattacttgatagatggtcaagatacacatattgccaccattgtctctttaaaatatcttcatagagtttatgatgtaggatatttttaagcgtgaaactttcattatgaaatttgcttaatgctaatatagcaccatttctgggttgcaaagagtttaatatttcagtgaatgtgtggattaaatatgtatacaaaatttgtatataacacatctttccatatgtgtatatatgtgtataatacatctgtccatatgtatgtataatacatacatggacggatgtatctatatacatccgtctagatatatatgtatatacatatatatggagacaacatatatatggggacaacatatatatggagacacatatatatggagacagatgatagagacatagagatagaatcaatgctctttaaggattttaaacaatgaatatgatcccactaggttaatctaatcaagcaacaaccaaggtaattttataaaaaaagttaagaacttctctgtttctaaaataggacagtgttttgttttagactttgatatttgctataagcatgtccttgaatgagtttttaatttcgttaacctcaatttgttcacctgccaaatagacgtaacctcttttacataggcatgttgaaatgatcacgtaagatatgaatatcagatgtctatagattgcattcttggtgttccatatccatcaatttcttcctctttccttctgtgtgattctacatttaaaatatcaccccctccacaatcagtaccaccattcttgtccctataagactgttaaagaggacttttaattcaactgacagattttactttctccccaagttaattttttgtttaaactttcacataaaaaactatagcaaggtataaataatacttcttgctctgactaaaaataattctgacactttatatcctttttgaaaatttcagtccaatgtggtgtgaaattctgggctgaaaaatctgcatttctggtgaaaatacttatttaacttagtggcacagatatatggaaggtgcagaagtaattctattttatgaattttatgacaaaagttgtctaaaagcagaaggagatcaagcattctccagtttgtagatgactctaaattctcccaggtagtgaactatccacccccgcccattagaaagctaaactaatatattttatatgcatatctattcccttcatgtgaattcaggaggaatagtcctgcctcacaaaatgatccctttatcaaagagaaaagactcaattgaataaatcatgagcttgaccagaagtaaactcttgtaatctaaccctgattggtgaggataaacaaaagggcttatatctttgaagataaatataataattctgctcctctgtaaataagtataaaattacaaggtatatatgcacattcacaggctactagaatcactttctaatccctggcttgtccatttaactttttaaagcagattgggctgaaagtatgaattaaagacttaaatgtaagacctaaacccataaaaaccctagaagaaaacctaggcaataccattcaggatgtaggcatgggcaaagacttcatgactaaaacaccaaaaacaatggcaacaaaagccaaaattgacaaatgggatctaattaaactaaagagcttcagtagggcaaaggaaattatcatccaagtgaacaggcaacctagagaatgggagaaaaattttgctatgtatccatctgacaaaggattaatatccagaatctacaaggaacttaaatttacaagaaaaaaccaaccccatcaaaaagtgggcgaaggatatgaatggacacttctcaaaataagacatttatgtggccaaaaaatatatgaaactggccagccatatgtagaaagctgaaactggatcccttccttacaccttatataaaaattaattcaagatggattaaagacttaaatgttagacctaaaaccataaaaactctagaagaaaagctaggcaatacattcaggacataggcatgggcaaggacttcatgtctaaaacactaaaagcaatggcaacaaaagccaaaattgacaaatgagatctaattaaagagcttctgcacagcaaaagaaactaccatcagagtgaacaggaaacctacagaatgggagaaaatgtttgcaatctactcatctgacaaagggctaatatccagaatctacaaagaactcaaacaaatttacaagaaaaaaccccatcaaaaagtgggcaaaggatatgaacagacacttctcaaaagaagacatttatgcagccaacagacacatgaaaaaatgctcatcatcactggccatcagagaaatgcaaatcaacaccataatgagataccaactcacaccagttagaatggtgatcattaaaaagtcaggaaacaacaggtgctggagaggatgtggagaactagaaacacttttacactgttggtgggactgtaaactagttcaaccattgtgcaagacagtgtggcgattcctcaaggatctacaactagaaatagcatttgacccagccatctcattactggatatatacttaaaggattataaatcatgctgctataaagacacatgcacacgtatgtttattgtggcattattcacaatagaaaagacttggaaccaacccaaatgtccatcaatgatagactggattaagaaaatgtggcacatatacaccatggaatactatgcagccataaaaaaggatgagttcatgtcctctgtagggacatggatgaagctggaaaccatcattctcagcaaactattgcaaggacaaaaaaccaaacaccgcatattctcacacataggtgggaattgaacaatgagaacacagggacacaggaaggggaacatcacacaccagggcctgttgtggggtgggggaagaggggagggatagcattaggagatatacctaatgtaaatgatgagttaatgggtgcagcacaccaacatgccacatgtatacatatggaacaaacctgcatgttgtgcacatgtaccctacaacttaaagtatataataaaaaagtgaacttagagttttgcattcatctttagccatttgattgtaaatatatttattcacaagtgattaaaatgaatatcacttatttaaaaataaaaatacattaaatatatttaaaaagctcatcactggtcattagagaaatgcaaatgaaaaccacaatgagacaccatctcatgccagttagaatggtgatcattaaaaagtcaggaaatgacagatgctggagagggtatggagaaataggaatgcttttatactgttggtgggagtgtaaattagttcaaccattgtgggagacagtgtggcaattcctcaaggatttagaaccagaaataccattggacctagcaatcccattactaggtatatacccaaaggattataaatcattctactataaagacacatgcacacatatgtctattgtggcactgctcacgatagcaaagacttggaacccaacccaaatgccatcaatgatagactgcataaagaaaatgtggcatatatacaccattggaatactatgcagccttaggaaaggatgagttcatgtccttttcagggacatggatgaagctggaaaccatcattctcagcaaactaacacaggaagagaaaacaaaacactgcaagttctaataagtgggagttgaacaatgagaacacatggacacggggaggggaacatcacacactggggcctgtcagggggtcgggggctgggggagggatagcattaggagaaatacctaatgtagatgacgagttgatgggtgcagcaaaccaccatggcacgtgtgtagctatgtaacaaacctgcacgttctgcacatgtatcccagaacctataataataaaaaaagtatgaccggtcttaaagcaatactcatctagttttatgggtgcttcatcagacttgtaatataagttttgtttgaaccaaataaaattactaattttgtagtttaaaatggtcaaatattggctctctaaacctttacaaaacatagcacttccaaaataaaaattaaatataatagtggtaaaattataaaacccaaataatatagatatatcaaacttgagatacaatcaatcttcttattgcagcgtttaactgtcaatgaactctttggaaaaaataaatctctaaagtgaagcaagtagcatgtcggtgctttaggaaaactggttcttctatacaaatggaattttagcaactgttgtaaacaaattaagggtaatttaaaatatataaataaaatttagtgccaagagcatgccaatcaaataaaactagttaatactatattctttaagatattcgccaaataagtgcactgtgtatcttacaaacaaatcactttactataaaaatagtttgtgagaggtacttacgttgaatttttaacaaaggttgttttttaattttggaaaaaatatttttcaaacacctgttttcccactactttattaaaatcttttggaacaatctcagtaatattactgggcaaattgtgaatttcttatataaggatatggcacatctcttcaaatgaaaatactgcgtgacagaaaaatgccttaatatatttaccaaaaatgtgagaaagacatagaaagtcgttctgagacttatggacagagatcaaagaaaacagtggttactacagtgttcggatttgtagagatagggggagacgactgcctgcttagaggagagtaaacactgtagtgtgttcaaatcataagacttggaattggctaaatctgtgtttgaacattggctctgtcatttactagctaatgacaggcacatgtaacccacacatatcgattatatcttctgataaatagggctaataatcatatataataatagacctcaggtgcttatggagatcaaaatagatgatatatgcaaattgccttgcacagtgcctggcaaacaaacaaaaatattaatccttcttagaattacttaggagaggatctataaaacaagtataactagtctgaagaccattagggttgtccttggataagacagacctaagtcctctgaatccagacctccatttaattcacccacctcttcagtagcggaaggattttgttttcctcagtgggagcagcccttggatagtctttttcctctcactttttccatccctttcccccaaatcccaccaactttctgaccccttagaattagttttctattgctacatcacaaatcacaaacttgacagcttaaaacaacacacatttataattttacagtgtccatgggtcaggattctggacacagccttgctgggttctctgctcagggtctcacgaagttgctatgaagtcgtcagtggggctgtgatctcctctgaggctcagggtcctcgtccaaactcactggtgttgggagaattaagttacctgtggttgtagactgaggtcccaagtcccatacactttatgacatagctgattgttttcttcaaggccagcaggagaatattgcttctattttgagccctttttctggggaagggcttgatcatcttttaaagagtgctcttgatgagctcagccctcccagaagaagcagccttctgattaactcaaagtcaatggctttgggaccatggttacatcttcaaaatcccctcaccaaaccacaggagtgatatccctcatattcacaggtcctgtctgtagtgaaaagagaggattatattgggcatttatgccaaggggttataattttggataccatattagaattttgctttccacacctccaaactatttcaactaaataaagggcatttcatttggcaatatggataagttttaaatgctaaggctcaataaaggtagtaacatgatatcaacatgcaactgaggtatcatcagttaatacattctgatcattctgatcaaaaccttctgtcccatattacaaattgaataatgagggaaagaggttgatctggaggtaactggttaatattttcagtgtgaaaagagagagaaaagagaaactttgcccctcattcaaacgaaaaaaaatttcaaatacctactgtttggagtcttatccagtttaccttccaatgacttaggactgagagagctgaacattagggggtctcaatcaagcagctggtaaaataaattacataatttgaaatattttcttttttctacgatataattcttatgactccatctccaaaagaaaaaaagttccatttaaatgaggcatcactgcatttattcatggattcttatatttgttgaaaagccttagttttagtctttcatgaacaagaaactagatacagcacacagttttatacctttcttgatgaaaagaatataattcacaacctctttcctcaaacatttaagcaaaatttaagaagagataatatgcaaacttttaactgtgagcaattttttgaaaaatccttcagatggtaagctatgctgttaggtctttggtatagctgtgaggtagaggagaatggagagagaaacagaatgggaatgaaattaatcattacttaattgattcaataaaaatagaataccataaatagacttaaatcatatctaagtaaatttctgtcttagagtttcatctcatactctattaaacattttcaacttttcttatgcattaagagaaccataaggggaaataagcaagcactttgtagccagaaagaaccaccatgggattcttgaggtcgcactagctcactggataatattaggcaagtgactgaccctgtccaagattctattctttaaaatcaagggtaattgtacccagtttgcaggattgagttgataagaaacacacacacacacacacacacacacacactacacaatacactacacagtgcctagcacatgaaagagctatggtaactattgtaattatgagtctttatattgccaatggcatgtatagattgttttaagcaagaatatgatagaacaagcatccctggtaacctgtcatgaaatgctggggaatgtgataactgtaaaatcattgagtaagtcaacggagaagtgcacgttagttatttggtttaaagaccattataatgttattattacatgacacaagtaagactacctgggaaaacagaagctgattctacttaaatactttatttacactttcccatagcctaagaaaagatagtaaatcaggaaaaaagggcaaacagatatattaaacataagggctagtatttgtgctgctaatgaaatttgtatttggtattgaccttcctggcagccaaaaaaaaaaaaaaaaaaaaaggaagaaaataatatattttaagaaaagaaaagtttttatggagtttattctgataatattatctcatattgttctttgtgtgttagtgcattgctaaaggtattttcatttttgtagtctatcaaggactgttaatagaaaaattagagcgtaataaaagatgacacactgaaggagatttgttcagctaatgaggcctattcttgtggaatcaaccttttcccttcatgctatacctctatttttaaaatttagcaacaaagagcctagtcaaagcaatttggaactttggccaatacatcagaaaatacacacataataaaaatcaacattatacagataccatttgcagctgttggctctgctgagagcagaggttcccatgtacaaaagatttgcctaaaatctcagagtcaagaaaattcagttcaaatccatctacaccaaagtgagtgtaggctgatcactacacttacttggatagttatttaacaacctttaaatgaagaaatggtactatactgatgtcaatgcccacaacagggcctagtacatcggatacactccacaaatatgttttaagaatgaatactattcctctgtgatggtggaaccagtttggtggctaaggagggttagttgatacaaatacttgatatttatcaattagaaaaggggaggtggtaacaataaaatccctaggtatgtatcagggtttctcaacctaggcacgcttaatattttgtatcagataactctttgttgtgggggctgtcctgtgcattgtagaatattcagcagcatcactggcttctgccaactagatgttagtggaatctcaagttgtaacaaccaaaaatatctccaaacatttagaccccatttgagaaacacagacatatatgaacttgtgtgtgtgtgtgtgtgtgtgtgtgtgtatacacacatgatgatgatagataatagctttgttgcatattatttgcttttattgtactttgaatatgcgagatcaattattttcaattattaattttatgttctttcaaggcataatagataattaacacaattagcccaatggtcacttattttgaaaatagcatgaatatggtctaaaagaattgagcgttttccaaaatcacagctaatgtacttcattgcattgcttatggttcttgataaaatcacgcaaacataagcagtctgatgttatttttttgtttacagtattactgtgttgttttggttaacagaatgaaaaacagcactgtaatactacaagtaaaaatgttttattcttagtttgtttcatcaataaaagctgacatttttgcaagaaagatgttatactattgaaattaacttttagtcaattgtaaatgattgtattatatcggtatgttatcatgaagattagaaatcatttcctacagaatcatgtttttgcttcctcagcactgtttcaattgaaaggaatttgaatgaagtgcatctcattactaacataaagtagatggagcttgaataatttttatatttattttccatggatcgctattacatttcttatctatccaaattttataaaataaattgttttaatccattctttggagaggagcaatgaatttatttttgcaaaagctatgcatctgagtatattgtaatatgcataaagctctgttaacacagttatttatataaaaagtgtagctgccttaccttttatttaatttacatactttatttactttctgacaggttcttctctttgcatttttatttgcaaaccaaaaatgtcttttcagataagtcaactaaaactttgatgtactgtataatctaaaactctataaaatgttttatgtattgtataggtttatatgaatttttagactgaggatatagaattttggaactatttcattaatgattcctatatggtaacaccatacttcttaaatatgatgatagagaattgtcttttgtctgagatcatgtttaggaaaacctacagaacttaagcccagtctgtttcaaatagaaaaacatatctctggctatttttaagggttgttattttttctcaaaatatgaacttcacataatatgaacatcttaatccttagagaatttggtacatttactgtaaccttatacaaaagattcatatttttctactcaaatgttggaaacaataaaagttgcccttgtatgtttcataaactgtaacaggaatcacccaccagtaaagtaataagcacacggtgtatcaattcaaagacgtccagttttagaaatataaacttaatcctcttcccctcccttttttttttttgtatttagcttttgtaagcatggtttgtatttgcataacccaccattcatattcttgtgagttcatgatataaataatttgaaaaatttcattcagttccccaaattattctagtcattatggatgattcatgagaggattaatctcttggatgtgacataaaactagagaggaaagacactacctatcatatcatttgcagttaagaacatgctgcatatctttaagctttacttaaagtgcttatagtaattgggtgtgcatgccttagctccgttaaaacccaaacagcaatatgggagagtgtggtttgttttttaaatgtgcaaggaaggaaaattagtgaaatctgtttaagtcacaaaactgcctcattcaggacccaattcagcagcatggaaaaagtaactcaagttaactgtactcttagcatatgtctaagctcacaaatttcaattcacttcaaatttctttcttctcccatggatctgcctgcaaagaaaagagatacaaagatggcaaaccggttcaacagttcattagccctagattctcttagggttttcagaataaaaacgtgtccatttgcagaccaaattcctttatgtgttggaatggcaatgcgcctcaagaactgtttacgttgcattgtgggccttccttttttttccctcttcaccctctactcctgccactgccatacatgattacacacatgcatatggagttaagggtataatgtattttgattttatccatgcaagtaaaatttggtggaggaaacaaaactaagctaatgaacaaaagatttcagaattatacagagattgtggtttagtgacctaaattgcaccataatcctttaaaggattacagtatttggataggaaaaaagatttatctttctataatggcatctctgtataagaggatattattggatatgagctgcatggtagcagcagatatttttctccacgtctttcggcaattcagaatagttctctgatccatctgagaagtagcactgaagaattagtcctcatttataatcaaacattcttgaataacattttcttccaatttttgttttaaaggtctaacatttgatcgtatgttttctttagttaactttctatattatatggcaatctctgcagttatttttttcaaagataaaaagaaaaaaaaagcatgttcaaaaatgtagaagttatttttgcagtaacgtatgtcatgatttttaaacattcaggcctttaaactttttttatagtgtatgttcttgccaatcccagcacagttctacaaagtaaaatatttggcagtgaattcatattaacagatggaacaagaaattaacacgtttttgcttcgctaattcacagttcttttaatacgctaattctaaatcacctgttctgactttgacaggctacagacacctgtttggggtaatattccacagctaattattacatgagaaattcagtttccaacaaaagagtttctgtgtgaaattgccattgtagttaacaaattaatatcaactatatacaaatacatttctgatgtcttaatttaaatacagctaatatactactcatctataactaaagaatggtatataaaaactaagactgccctcttagtgtttgaattctgtctgtcacactttacaccatggttgcactgatcaagtcagaatgttcttcccagtagcagtaatttactgtaatactgtattttaaatggcaggaaaagagtatagaattttcaagtggctggaaaaattcctaactgtatgttaaaaatgactcaggagagttaaaaaagaaaaatactgacaagatgagagagaaaaaaagaaaaacttagcttgggtagcataatatggaagacagaacaataaataaacaggaagtccactgcactaccgagtttttgaagtatgacggacttacatgaagtcccatgaagactgttgatttgtttgctaagagaaaagcaagtaaacgatgccagatattttatggatagaaaattaaatacccgcttcttataactcaacagagttataacttaatagagaaactacttctattttccactaaaacctgattttctttatcttctatattgttcttagttattctgacatggtcatttcccctgtgtcacctcagacaacttcctttaacactaactcctttccctgcctccaatttcccccataaaaaccatgctacgggaaagtgtggaggcaaggagtgtgtgtatgggagggtaggttggtggaacaagaagcaaaaatcagaaacgtaaggtttttagatgtttgtaacataacgacagatgctgaggtagagtctatctttaggtttgccaaaggttccattttgtgtgtctgttttttgattctctctaattgctgttcagctttgtatgtggctttgctaatgtgtcttctgtagccacattgtcgtttctttaattaaccttgatatcctagtacccagatagcagagttcatcaagcaggcacttggaacttttaacattcatgctgttgtactttgatttttaagagttattgtacaaagtatatttttaaaatgcatttttattctgcgagacttaaggtggatgaggagagggctttttttttttcttgttttgttttttgtttttacatttagcctccagcctccttgtaattttattgtttttctcccaaatgctactctagaaagcacatggtctttctctcaaaccatgctttatgacattgctatttgcagaaatttaactggcagcccaccccaggaagataaaatcctgtttcatccaagtttggttccctcctacacccacacctgaaactatatttctgccagagcctacattctgctaaggaagaaaccaatcttttataatacttcaacatacgtgaattttattttatttttaattaaaaaattacatttctcatccaaaaatgctagatgacatttaaagctagaaaagtgtttccaaataactcacctttacaattaactcttatcaggaccagatagttatttcactgtaccagggcaagcacatggctgggatgaggctgggcagtgaaaggcctccatgatgattgtcactcgatctcttggcaacgtgcagaagcacattatcccacaggatttgctcagggctcaaagtttgtaagagagttactggtacataattggaatgagaccagttttattttcagttaataagatgctcaaagataaatgaaacttcctggttttcaagggagaaaaaaaaagactcttaggaagcttatacatctcttaagtttttcctgaaaacatttttagacatacatttgctacctctaaaacaacttgaatgaattagatctagatgataatggaaaatatttaaggtttaatactgaaaggataatgaccttgcaaaagtgtgtttggcaattatattcaatgtgaaattcttaagaaaattgctcaagataatgaatgacatcacaacgcaatttcactcatctgtcctcagttaaaacactttgacaaatcaattcattaataagtaaatctaatatccctgtactgtcctaccttaaatatactcattatatataatgcaagacaaaattatgtaattttgctatggactaatatatatgtacgtatctttatttttatgtatgtatgtgggtatccacacatacatacatatgaatacattttagggagcctatttaatccttcaaggaggtttgcagattacaatgagttcttgcagcaacaattatatttcacttaatacttttctaagcaagtagaattttaacatatcagcctttcataaaacagatttatgtaactagcagatgctattaattgataatcaccatttatagccttatacatattttaaaatagttccctatacatataacattacggtactatatttagggttttatttatagaatatattttagaaggaattaggtagctttcatttaaaaaatttaattttcttaatttatcctaggccaattctattaatttgtcatcttagaatcatgatattattataataacaatagcttactttgatatacatgtggctcccaagcacagctaaacataagaattgctgggataatttttgaaaaatacagataccagaatactaactgtattgccaaggagtgggacacagctgtctgtattttataaaaactccccaggtgctcctgtgcaggatgggagaaaatgctatcattgcatagtttctactagccagaaataacagttacagaataatactaataactattacaggaacaataccaccaataaggacaccactaaaatctactctctccaacattttttaacctaaaaaatgacaagtcgtgttatatattcctgaatcaccttaatcctttaagaaataaatatatattaaatatttatttaggcctggagcagtggctcgggcctgtaatcccagcactttgggaggcagaggcgggtggatcacctgaagtcaggagttcaagatcagcctggccaacacggtgaaactgcgtctgtactaaaaatacaaaaaattagctgggcgtggtggtgcgtgcctgtattcccagctgctcagagggctgaggcaggagaattgcttgaacctgggaggtggaggttccagctagccaagatggcaccattgcactccatcctgggagacaagagcgaaactctgtctcaaaaataaaaataaaaataaataaatatttatttgtaaggatcaaatattttttaattcaaattgttccagacggggcattatttaagaaaatcagactttcctcctagtttaggtaggaaatcaccaaccaaccaatcaatcatcatcaaaccttcctgcaaaaatgccattctcaaacaagcagtattgacaactgctgagatttgttagaaatgcagaatttcaggccaccctggacctactgaatcaaaatctgtattctgccaagattttcaggcagtttgaatgcacaataaaatttgagaagaactccccagcacttgtgtgtgcccacatccaagctaggtgctagagtacccagaagcaatataggtgtgcagagatttatctttgcctggcagaatctcgctatttgtaatatatacatatatattaaaatatatataacatatattaaaatatatgttatatattttaaaacatatattaaaatatatatgttatatatattttaatatatataacattatagactttggaggctttcatttgaatttgcatttgagtcaaagtcctaattctggctactgtctctgatccatcatgagattctctgatcaattctgtctccaaatatgtaatctcactataagtatcaaacaatctaatgcctcaaccttcaaaatgtagctagaatctcaccattatttccagcctagattacaataaatcacttcctaactcagtccctgcttctatattcactcctcttatagtatattttccaaaagtagtcaagctcagtgacttcaaaagactttaggcttattgttcccattcaaaattgaacttacgtagttatagtttatgtactttaggtgtctgctcaaatggtagtgcctcaaataaacttttcctgattattgcatttaaactaaacttcctgtctatccctctctctctctctccaactttaccctgcattttcctttagggtcctgtggtcctcatcactctttgtaagcaattgtgtcatattattaaatagttgactgcctgtcttcacttggaaatataagatccagaaaatagacactttgtctttcttgtcccccagtgcctataagagtaccagataaaaacaggaagcaaataaataatttatgagtgaatgtttaatcaaattagtgagctaggatattcagtgcatgtgtggttattcattgagtgtgaagtgtattcattgaacacctaatatatgtcactatggcagactaaaaaatggcacataaaatatatgcttttgagaaataaatacatgaataaacaataggcatatattgcacaaaataaattctttgggagttgaaggatgatttcagtggcatgaagtagaagaaagaagacttgttttgagaagtaggtgatatagtgatgacattatcacaagggcaaatagcaagctttagggctgaaatatctagagtattatgcgtgaaacagcatacctgtggaattgacagttcattagaaagacatctagtgactagcttttggtggctttacctccaaaactgaggaatttgtactgtattctgtagataatattttcgagaagatagttatgtgttcataaccgtggtttggggggattcatgtaaaggcaacatacaggatggactggattaagaggctgcaaagacagataactggttaggagattgctcatccgaagcggaaagaatagcctgggtgaaagtgtagtattaggaatttaaagtattaagtgaattaataacattaagtttcagaaaagcagatagcatattacttgcatagggtttttgttttgttttgttttttgctatcaacaccttcatcactattatggcacataaaactacccataaaattttatccttttttttttctttgatagagtctctgttacccaggctgaagtgcagcggtgtgatctcagctcaatgcaacctccgcctcccgggttcaagcaattctcttgccccagcctctcgagtagctgggactacaggcacgtggcaccacacctggctaatatttttgtattttttttttttagtagagacagggtttcaccatgttagccaggatggtctcgatctcctgaccttgtgatctgcccacctcgatctcccaaagagctgggtttataggtgtgagccaccatgcccgtcccataaaactttcacacagtcagaacgataagggtactaatataagctgtgtagataacaatccttccagtgattatggatattatcatttcctgttgatttaaggctcaaatgatttagcatagcagtcttggcaattatgaatctaaaaacgggagtttattatcttagaaaaagccatcacttcacttccagattaagggccttttttttttttttttttttttttttcgaacagtcaatacaagagacaagaatcttttcctatattcaaaagcaactttcgtttattgggtggtaaactgcttacaggcacaagtcttttaatcttcattgcttcctatttctgagcaacagttttcttaacccaacatgagaatattaaaatcgacctggtaggatcatgatgagggttaaatgacataatctaagttaagtctcagtctctatgcctgagtagaaagtcaataaatacatgttgccttctctttcccccagcacctagaaaagtatcttgacaacattaatgctcaataactgcttgccaaataaatgaatgttgttgagtttgcactaactaaataatgactttttaaaccattgaccaataagcattcaaatgatcaggttccgaaaactcccgcgcaaatatcttatagcaatgaacctcaactgcagtcctgaaattttttcttaatctcttctagcccacaaatttctcttcctatagatttgtgtagttacctacttttccccttaatattcattttagccatctgtctcctatctcctagaccacaatttgttgattacttgccaggatatatattttcaatgctcttagattgatagctccatttctttttctatcccttccactcccctcttgtgcatggcaaaagattttctttattggttcccgccttttttttttttttaatatggtgtctcactctgttgcccaggctggagtgcaatggtgcaatctcagttcactgcagcctcagcctcgcaggttcatgcaattctcccacctcagcctcccgagtagctgggattacaggcgcgcatcaccatgcctggctaattgtatttttgatagagatgaggtttcaccatgttagccaggctggtctcgaactcctgacctcaggtgattcacccgcttcggcctgccaaagtgctgggattacaggcatgagccaccgcacctggccaggtcccacttttatttaatgctgttaatttctattttaaataacataatatgttcccatattctgtgctccccaacccctgtattctctcttctatttattcttctttcctacttattttatgaaactcttttctgatctgcactataaaaatattttcatctctttgcccattttgtctgttgcccaaagtattatcttcctaattggattagaaaactcatctttatagggccttttatgtgttctgtgcacttatggttttctgtaaacaaaaataataaataacaggtggagagctaaatatataactcactaggaatggagcatttcaaagaagaggaaaaggctatgtcagaaacattctacatagagtacaccaagatcggtaaaaatgtaaatggtcttcaactgttacatttaatagactaagtcatgctgtttattaatcataaaaagtaaacatttctacttatctacattttttcagaaaggtattgtaataaatattattgtaagtgtgtgtgtctgtgttgtaccaccaaacatgaaacgtctcctctgtcctcatctctacccagttcttggtaggtagagagacagatggactcaatgaaagataattaaaactatggggaacttgctaatataaactacatgacctgattaggattctttagctgcatcaattctgtcttcccatattttaagtcctaccagacaaaggaggggccaggacagtggtgggctggagctggctgcagagctgattgtgcacatctcttctgaactccacattccatgacataatgtcagccctaaaatggccgcaatgggaatattcacagtagggaaattgataaatgccacaaatcaggacttccccaccccccccccccccagagatcctatgataaacatttatttgcacagcattcacccagggcccagaaatttggggcaaacatatgctgcaagtcacttgactataattgagagaaagcagtaagaagaccctagaatctaactgggctaagcaaagcgggacgctacaatctaactgggctaagcaaagggggaattcagggatgaatcaacaagatgctgctccgggagaaaagatcatagcaaagagttaaaaatgagactagacagggaagcttgggaaaattctcccagcaaaaatagggtaactgcatgttctttgtattggatagttgcgtcccctggtgggttagagagggaggttaatggattgggtttttaaagccctaaagtgaacaggatgaggttttaaataaaaagtgactttttaagattcatattgctgcagagctttgcgtgctctgcagcaatgtgactctatcaggtaacaacagatgtacctggtgagactagatttctgtacttaggtacagctgttcctagctgtaacaccaccttgcagccagcaccaggcttttgcccggggcctaacagcctccacttcctatggggggattcacagccacggcccttggatagtcatgggtacccctggatgcctggatgcctaccctggctctcagggcccactaccattttcctggtatcctgagcattttcacaggggaagagcacagtttcagaatgaagatcgtgtgaatgtggaaaagaggaaaaaggcctcagagaactagaacaagcacactcaagtgtatacaaaacatataaacacatggtaactgccccagtccaatgttaggtcatggaaagtataggaccttttatattgcaagtgacaaaagctcaactcaaacttgtggaagcataaaagggaataaactgacttaagtccctttgctctcctcttgtccactggttttatttataaacagttttgctctcatagtcggttcacacaaatgtgctcctccttagcactcaggcaatcagctaataggagagagtgcttacttctggtaacttccgggggaaagtcctaagagggctgttcactggccttgccgtggtcacctgcccttccctgaaccaataactatgagcagagaaataaaattttcttctggactgagatcctctgccagacatggagaagggcctgggccccataatctgagagtacttcctccaaggaaggagtgcaagttagctagagagagacatctattacaattctttagttttgtttttgagacaaggtcttgctctgtcacccactttggagtgtaatggcactgtcacagctctctgcaccctcaatcttctgggctcaagccacctcccacctcagcctcagaagtagctgggaccaccgggtacacaccctgctacatttttgtggagacaggtctctatgttgcccatgctggtcttgaagccttggcctcaagcaatcctcctgccttggccacaattatcttcctaatggagtcgtaggggacttgctgataacctccgtaagtagatacaagctctaataataatcactctatctagatgattacttcttttcttgctaattttcatctttcctggattctatgccttttaaaatttctctctcctgcacatacccagtgttctttatttctactgtttttggaacagttccaatgaggccgctcaaccactccctgccacgcccaactgcagatctgtatcagagttgagcactctcagtggctggactcctaagcagtttgtttctgtcaggctgactgatggcacttaggagatactatgttgatttgccaagaaaatccgtgatctaagtagaaggggctgctttcttagcataaataagctaatacatttactatttaaggtgttacttttattcataattaaaaagtttaatcagagagtgggctaccttctcggtaactctctagagcccaccgtaagtagcttgtgaaatgaatggcacagaaataatagaacaatgatagttaatctaaaatgccatgatggatttcctactaaatgtagaaatacaataatgtaataacaacaaaagggatattcttaataatagcaagtaaccacaaaattaaacattttcctttagttagaattttgaggcttaaataagttttgaagttttccattttaaactgttgcctgatgggaaaaaccaaaagtcagcattaccgtggatagaatgacctcaggatctagcctaattattgctgttactgaattgtttgtttacttcccgtctgagttgcatgatgcttcgatgtggtactggattagagaaggaggaggaattcatgagtgaaatgtttgtcctgataactgggagaatggctaaggtgaaggtttaatgttgtaagtaagcaacactattccatttgcaatgatatgaacttaattccttatcttttaatgtttgtacttttaattatcaaccaactggttgtctgtcttagactaatgaaaattaggtgactttggaaataaagtttggtgctgaatagttaaaagcttgtatccatctgtccctcccttgaccaaagcttccagtttgcctaggactctcttgggttgatgtatgtttttcagtgtactttttactttgtgcctccttgcataaattgtttttatttagaaaatgtagataagctacgtttatgttatgtgtgagagtgtttcacagattgagaaggaacacgtacaggtttgttacatgggtatattatgtaatgctgagatttgggcttctagtgaacccatcacacaaatagtgaacatgctttttgttttgaaacagtggattgctcaccaaaatcagtggaaatgggtaatgaatgaggtcataaaagtagctttcttcaggaatctttaggatctgatgaagctggatatgtgcattgcccaaagatggcttaagaagtctatgaatgtgggaattgacttggacttgatgatcacctttacttagcacacaaaactataaacacttcggacagggatgaaacgtctgaaagtgtgaggaaatttacttcaacattgaaaaatcagtcttacctcaaaaatgattcagtggcccattctgttttattatattttctaattaaaaagaaatctaggctgggtgtggtggttcacgcctgtaatcccagcactgtgggaggctgaggcgggtggatcatgaggtcaggagatccgagaccacggtgaaaccctgtctctactaaaaatacaaaaaaaatcagccgggcgttgtggcggacacctgtagtctcagctactcctactcgggaggctgaggccagagaatggtgtgaacccgggaagcggagcttgcagagtgagccgagatcgcaccactgcactccagcctgggtgacagagcaagactccgtctcaaaaaaaaaaaaaaaaaaaaaaaaaaaaacacctaaataggcagacaacgggccatgtatcagtgaatttcaaacattaggatttccttaaaatgctttataattagctttggaaaaactatctgaagagatgtaagcatgaagaagttgaggccatgtgctatcccatctcatggatctgggcttcaaatgtcaactctactacttactagttttagttcagtctatggtattttggtttaaaattgcattataaatgcacccacatacataggaacatacccacacacaaaactacaaggagaacaaagattcgtatgtaatcatttctttccttagttataacatccactaaggttaatattttttttacattttgtttttctaacattttcttcctgttccttagaattatagcatattctatgtggactggaaaaatagtcaatggttttcttttggtgtttgcgttcttaattcctgaggtgaattacatgctaaaaatgacttgtatgtctgtttggtgggctgccaccaacatagaaagtctgacatattttccgtggaagaaatacttattagtttgtaacctaatatttatttgcaccgtattttagtgaggaaatgaaggcagagtagaaatgaatttgttcaaatttaagcattcactagtactttcatttctgtacttgaacgtacagggttagctgggaaaaatctgtacattggttttcaagccataatcttacgttcagattttgtatgctggtccgttgtgtaaatatgaatttttaagcaatttagcatttcatcaaagtaacacggcacttgattttcattcatccatatgaaaacaattaggaaaaaatgccacttatcttaaatagtatttgtcagattttcttcatcaaacttggtaaatacagatctcttgacattttgatgaattttcatcactctgtggtaaacctaagtgactaggctgtggcccgtgaacagcttttgtttctatgcgacattaaaatgtattttttaaaaaacatgattataatgaatattcaaaattagattcattctctagcatgtgcacaataggtcacaagtcatggctggagaagaacacttactagtcaatctcaaggttttattatttcttatgaatcacaatttttttcagagatataactatcaaagaggaaagccagctaaacatacaccattttgagtttgcctagacaactctgaaaattcatttcatatgtagttaacttaaaagttactgtatttccctagctgtgtattgtcttgactcaaaatttcttggaccgtatgttcaagacagcttgaaacagacattataaatgaagaataatcagttaccatagttcagagcatttcttcaaatactcttcaatttctggttccagcaaaattttatttacttaaatataaatcctcttttttaatactctagagcctcctcctcaacaaaacacctcattttagtacaattgtttttatatcctgtcacaggatgatgatgataaatggaaaatgattaagtatattgtttgtcagatttcttctttcacaattcaataaatattcccagagtcctccctagtcaccttccttgcaatgattatcaaacggaaaatatttgaaattcaaggaggaaacctcgtttttattttggttgttctccttttccaaaaaaatacaaaacatgaattaaaacttttgggagcttacaaaccaagttaattacttagagacattaagtcctttatttggggaccttgagctgttgtatacttcagaaaaaatcactctaagcctctctttccatggaatgtacatttgtaatgaacagtgcttctatgttggttatactttcattatttaaatacttgatttccatctataatgcacttattcaatgaaagtttattacatctactatttattatatgccagaaataatcaccaggaagaatgatgacaagtaaaaaaggaaacaaaagtaaatcctttccctaaatattgcccacactgatcttcatggtccccgaaaattccacactattttgcactttgtggtggtaaattatagggtctcagttgaaaggctaattttattatttgctgtatttgtctatttctaaacttccttgtttcagattgatcctaaaattgcttacatgtttattatatcaaatacaataaggcaatagattagagatacttaaccaaacagaaaaacgtcactggggaacttatgctatgagtgacctacatttttatggtactttattattttcaaagcccttttctcatttaatatgttgttatatattctttccagtaatcctgtgagtaaacaacaacatttgatttactattatctgagcaacacttatgaagtagttgcttttactccttttgttctaagtgacaaaatggaagttcagagagttcaaataacttaccaaaagtcacactgctacttactgacagagctggaattcaaactcatgtctgcctggctctacacagcactattgagaaagaatgataaacggctttatcagctaaagtccttgttcattcactgagtcttttgtatcttttaggaaccagcctaaatctcttctttaatagtgacttctccaacaattaactcatttcaagtgaccaattttctgagttactgtacatgccactcattttgacatttaattacacactattttccaatattatttctgagtgtatgcattcctgacttttctaccctgtgatatttaaatgaaagcaacactccttcatgctacaaagtctcaataaactaggtattgatgggtcttatctcaaaataagagctatttatgacaagcccacagccaatatcatactgaatgggcaaaagctggaagcattccctttgaaaactggcacaagacaaggatgccctctctccaccactcctattcaacatagtgctggaagttctgggccagggtaatcaggcaagagaaagaaagaaaggaaattcaaataggaagaaaggaagtcagattgtctctgtttgcagatgacatgattgtatatttagaaaaccccatcatctcaaccaaaaatctccttaagctgataagcaacttgagcaaagtctcaggatacaaagtcagtgtgcaaagatcacaagcattctcatacaccaataatagagagctaaatcatgagtgaactcccattcacaattgctacaaagataataaaatacctagtaggaataccacttacaatggatatgaaggagctcttcaaggagaactataaaccactgtgaggacacaaacaaatggaaaaacattccatgctcatggataggaagaatcaatatcgtgaaaattgctgtacggcccaaagtaatttatggattcaatgctattcctatcaagctaccattgactttcatcacagaattagaaaaaactactttaaatttcatatggaaccaaaaaagagcctgtatagccaagacaatcctaagtaaaaagaataaagccggaggcatcacactacctgacttcaaactatactacaaggctacagttaacaaaacagcttggtactggtaccaaaacagatacatagaccaatggaacataacagaggaccccttccctacaccttatacaaaaattactcaagatggattaaagacttaacataagacctaaaaccataaaaaccctagaagaaaacctaggcaataccatgcaggacataggcatgggcaaagacttcatgactaaaacaccaaaagcaatggcaacaaaagccaaaattcacaaatgtgatctaattaaagagcttctgcatggcaaaagaaactatcgtcagagtgaagaggcaaactacagaatgggagacaagttttgcaatctatccatctgacaaagggctaatacccagaatctacaaagaacttaaacaaatttacaagacaaaaaaaaaaaatccaaaaagtgagcaaaggatgtgaacagacacttctcaaaagaagacatttatgtggccaaaaaacatatgaaaaactcataatcactggtcattagagaaatgcaaatcaaaaccacaatgagataccatctcacaccagttagaatagcagtcattaagtcaggaaacaacagatgctggagaggatgtggagaaaaaggaacacttttacactattggtgggagtgtaaactagttcaaccattgtggaagacagtgtgaagattcctcaaggatctagaaccagaaataccatttgacctagcaatcccattactgagtatatacccaattaattataaatcattctataaagacacatgcacatgtatgtttatcgcagcactgttcatgatagcaaagacttggaaccaacccaaatgtccattaatgatagactggataaagaaaatgtggcacatatacaccatggaatactatgccaccataaaaaaggagttcatgtcctctgcagggacatggatgaagctggaaaccatcattctcagcaaactaacacaggaagagaaaaaccaaacactgcatgttctcataagtgggacttgaacaatgagaacacatggacacagggaggggaacatcacacaccagagcctgtcagggggtaggggagtaggggagggatagcattaggagaaatacctaatgtatgtgacgagttgatgggtgcagcaaaccaccatggcacatgtgtagctatataacaaacctgcacattctgcacgtgtatcccagaacttaaagtataataaaaaaataggatgaataaaaactactacttcatagcacaaccagctgactatagtcaacaataatttattgtacattttaaaatcactaaaatagtataattggaatatttgtaacacaaagaaatgataaatgcttgaggtaaaggatactgtgtttaccctgatgtgattgttatgcattacatgcctgtatcaaaatatctcatgtatcccataaatatacacacctactgtggtacccacaaaaattaagttttttaaaaagtgacaaaatgaaagcaacttgtacatttatattctctaatgttctccttgatttctcaatgatacaaccttgccctcacaagtgttaaagcagtaactttactatgctcaagtaaggtgtggcaggtgaattctaacagtgcctccatgatctctgttccctggtcttatgtctgtgactaggttacattatacggcaaagatgatggatttggttacattttatggcaatggtgaatgaattttgaaaatgcagttaaggtcccaaagcagctgaatttactcaaaaaggagatgatcctgagtgggcctcatttcatcatgtaagttctttgaaagcgagtctagatgtgagagacaatcttctactggcctcaaatcagaaaacagccacattatgttctgagtatggagaggggtggcctctgggaggtgagggcctcagcctcaaaaccacaggaggtgaattctgccaagaagcatatgagcttgaaagaggaccccaaagcctcagaagatacagtaaccccatctgacaccttggttacaacctgtgagatctcaaagagaggacccagctcatctgtgcacagacttctaacccatggaaactgtgaaataagaaatactgtgttttgagctgttaaattggtggcaatttgttacacagccacagacaactagtacgtaaagttatatccaatgcactataaaacttgtcaatttatgtagaaattatatacacatacacatgtaatttatacatatttgcacatacacacccccctccgtagttcagcagtagcatcactaacttagagttttaattgcaaaactttcattgaagctgtggagccactctacaaaagttatgagagaacatatttttaagaaaattgcccccctgccctccaacccccatcactacaaaaaaaaaaaaaaattagccaagcatggtggcacacagctgtagtcccagctactcaggagcctgaagcaggagaatcgcttgagcccaggaggcagaggttgcagtgagcctagattgcaccactacactccagcagcctgggtgacagagcaaggctctgtctcaaaaaaaaaaaaaaaaaaaaaaaaaaaaaaaaaaaaaccaaaaacaaaaaactaaactaatgattaataatttcagggggaaaattggcattaacttcaatgtttagtgtttatttgtcaaaagcaagacagaagagtttaagtgaaaattggcctaagggatctgtaaaatataaataatatggtgtaatgttaatatttcaacattctgcctaaaaaattttgtagatataacttttaactatcctaacattttcccatcaaattttaatatacaaaacaaacttgcataatagaaacaaatttctcaagtggcactgtataagacaaatacataaaatacccatagtaatttgtgttaagtttataagatttcataagtagccatgtatgattcctaagtccctgtcactttacagatgaataaaatctatatttttcagtctcttgagaacattgtataaaggcaaagaaacctagtgaatcaggccttcagagttttgaagtagcacatacacaatattgctacatggtttatgcaatttcaacatattacccaaatggaattatgatttctaattcagtttgtccttaaggtttcatttctccatcagtgatatattggaaaactcctctaggcaataaatatacacaggatgagttgtaattttccatttctaaagtaatatgtttggtaactgtcaatgtccccagatcaatgtggatgtccatagggaaagtacttatttgcacattaaacataaataacctacattatatgcatgctctttagatttccttatgaaggatgttgaagtaaatattactgaaccattgtcgctttctctctaaagatcatttctttggtttgagttgtaagctgatggtcctcgttgggcccttcatttaatatggacctttgagttgatcataaatcatttatttcagcttcaaaaggacagaagtcatacctgcagcaagaggtggctaggaagatcagatgtgaatgaaggagtttcccaactatgagcccacacataaaccagagttgtcttttactttattataatacataacaaacatatatttttccccctgggaactacattttagcaatatatttttcattattttctattcttctggacattatacactgattgcctttaagatcccttttgtgaagctttccttgctccgatcgctcttcttcccatcccaactttttataaaaaaaagcatgccatctttaggtcaatagtgtaccatagacctatataactttatgctggtacttaactatacatatttgtttatttctgtctcctttactagactgtccacttttcagagcaggaacagtgtctggtacatgatttgttttgttaaaatccagcagagcacataatgagtaactatcattcaataaagtgattttgatgttatcctttgaaaagaaatctatgaatgcatgagtgaataatgaaaattttagcagtcagattttagcagcaaggattatatagacacatctgctttcatatatctctttccaaaagaaatattgttatgaaaacaacaaagtgctcttaagaggtacatgagaaaaaaattgaaacatgtagctactttagaaaggctaagattttcttctgaggtaaagagaaatggctggatattttagcagtagaggtagggttaatatcatttcttaagcctgacctcaggtttaacttgtgattctaatgttaatcattattacatcttataagacgtaagcttcacacctcataaatttagtcagcttgtttctactatccagagccatgttaaagaactgttttacaaagcatacatttctagagttctttctgtgccttttttcaaattgtttcttgtccttctagctaattttcatgtggtacctgccacaaaaccctagaaaataataatgcagatgtttgagtcataagtggtccatctctctttcggtcaacctattacgtaaataaaattgtacccttcctttcacctatttgtacaataattagatcatggtatcaattcaaacaaagaaattgatgtcctgggaactggttatacaaatacattatttcttctctttgaaatgagtagaaggaaagggaactaataataaaatatcacattattgcctacccactaaaggcagcctgaaattttacaaaacagtcttcctggggtcgtctcgatggtgagatataactgcctttcataatactagaagtacagacatcctcatatttttaaaaaatgcttaataagatcttcatctgttgtatttttcagttgagatcttttatgctttatattgtatctaataggcctattcacaaatgaagagtatatgagggaaaagatgaatatcacttcataacaagacattgaaataaactatcctaaattatgaaagcttcccaatgcatgtggcttttttcttcacggcttttctattcaaatatcaaagtgcttcaagtggctttgatgacatacttatgaattcatgaaagtgtttttcataatctgctcacctttggtgcttagaggttacgccgattgcttttatttgcttggctggaaaagaagagctctgagtgggatgcagatacataacacttcaaaacagttccttacattgtcttagctacttttcagaaacttgctggaactctctacccaaacttcaggcaatgataagaataagtgtcaaatattattagttctggagtataactactaatttttgtttcaactgcatagtacgtataaaaaccttggaatatttccagttatcttcactgtcatttagtccttaaaacccagaacagacatttaaaatgaaaaaaaaaaaaaaaagctaccattatattgaggctgcagatgcaagttggcatcgtcagaagatgaatgcttgtagccttcactggcaacctgaccagacatattctatataattaaataacgagcagtttaaaaaataaaattacaacatcttgggcaatcctttgtgaataatggagtaagcaggagagagagaaaaattccaaatgtgattagcagttgctcttcatgagaaattttctccacctctaatatgacttttctgaaaggctttaatgaatactttcctcagttagactgttgttttaaatatcactgtggactctttgcagtgttattaccatatgaagatgacacgtcggtgaactttatcaaatgccatgcagctcttggcatgccatgtctatgtaactcattcgagcccttcttgtccgagttgcagtactcttttgcataaatgttaaggttaccacaattccaaaaagaaacgaattttcagagacctgctttatgaagaaaacggcttttggagaaagcaggaaatactagtacatcaaacaaagtgaaagacaaagtagtttaacttgttggtttgtttgctgaaactcaaaagtaaatatactgtagctcaaagtgttccatttttatctgcctcctgcagtaatggctgtgttacttcggggcttctacttcaataattgatcagggtttgtatagcaccggctaagagcaaaaataagagtgttgctttgaacaaactgctgcaatgttatagcattaggcacagaaacaagattcgggaaatatagatatagaagaaacaggaaaaagatggatacattgggtggtaaacattgcttcaggctagaaagtaatgagaatttttccgtggagagttttgacctgctattcaaaaattgtttcttgtcttaataaaatcctaaaagtgtaatttacttgcaagagggaaagaacaaaggcaccaaaattcttttgataacaacacttgttaaggttgataagttgggtttcaaatgtgtgaagaaaaatgtgtgacaatttgttttaaggtgacaccctaagtgttcagatacttccatcttacactacttatcaagcaggatcctagttgaagcttccccttgtacatttgcagtatagaccatactgaaatggtaggaactgaattaatctagaaaatatagttatatttattagaaaaccaacaatcacagatctctctaatttttcttaagctggtaaaaataagagtacttttttttgtttggttctaatttgttttgcagtctaaataagaagcaccaatacttatagaaaataccttttttctcaacatggagtgttcaaaaagagaatagctatgatataccttatttttttctagacttaatcttacatgactcacaaaggtatccattgttagatgccaactgttgcacacacatatgtgtccatttttttctattttaaagttaaatttcatctaaatttcagattcatgccattaaaatactataacctgctgctgcggtgtgccaatggtgataagatgtaaagcatgattgcaaaactttaataatagtgtgggaggaaactgcagtgaaaaataatcaatgtgatttttttcctgttatgtagcatattccaaagaggttgtttattttatgcctaatcaccataaagaagaaaatcaagcactcaaatatttcatactaaagaataagcaaagaagcatctaaaatatttgttcatatttatatatgcccttcaaaataaaattggtaactaaatgtatcccaaataactgcttcaacagccaggcgtggtggctcatgcctgtgacccagcactatgggaggccaaggtggttggatcatctgaggtcgggagttcgagatcaaataattgcttcagatctcgactttgctatgcacatactactgtaagtaaaaggcaaacactgggatgagaatgtggtgaccaagactagctttttccatagtgagtttttataatgtcatcaaactcacgatcaaaggaatttgggaaatgttgagcataacaaagataaatagatgtcttgactggagaatttctcagggcatttaatatgttaaggacctggaattcagtgttcccaaacatatctgatcatggacacttttattgagaatcccaagggaccagtgagtcctggaacatactttgagaaatactgatcttgacctatagccagcaccaactctgattagctgtgcagtgagaaaatcactttcctccttcaactttctaaattaaaaatgtccttataattcccagtatatttcacaataatggaaaatcctcttaaattattatagtgatacaatactgttttaagtaaaaatgtgaaaaccgttttagatgctgagtcagagcggctgattagactaatcagctaaagggtgtctgtgggtagtagtcccccttcttgcatagttttgtttgggattctgcaaatttctgtatggcacacgctttggggaatttcataaggaggtgaaattataaatattaaatgtttaaatgccaaggaaatgttaaaacttattggaactcttctattcattcagtatatacttatgccaagcaataacccaggaaggaagggcatgaagctgaatctgtgtttagggatataactacctaggcagaaaagacagacaaaaaagcaagtctctcagtgttttaagctgtcagatgaaaccgtagagtcccataggtgcatgtggtaggagtctgagtaaattacccagactgggaaaagccaatgttcacatttgaggtggttcatgaaggacttgaagggattattcaggcagaggaaatgcactccaagaagacaggcacaggtgtggagaaaatcatggtatgtttcatgattccaatagaaagctccaggggagaggaaggaagctggaatagtaaatgaaaatgatgatagtttttatttattattattattttgtagtttattttttttgagacacggttctcaccatgtcacccaggctagactgcagtggtgtgatcaatgctcacggcagcctcgacctcccaggctcaagcgatcctcctgcctcagtatcccaagtagctgagactacaggagcacagcagcacaccgccacacctggctaatttttgtattttttgtagagacaagatttcgccatgttgcccagcctccagcttgtaaatgttatgccacaaacttggatgtttttccctgggcaatagaggaaaccactgaagggcatacctctataaggggagaggcagatgagtgatagagaaacagccagagatgaatactgaaatctgtgttttctgatgtgcttgaatgtataagaacatgaccagtttagaaatagtttggggagttgaaaaattatgtcaactagcaaaattgacggagggcagttcatcctcactatgacattgaaagacaaaataattattagatggttttattctaataactgattttcaaattatttttagccttggaatcctttgcccatggattctgcagtttaaaaaaaagtgcagtgataaagcaggcatggctgtgtttaattggtgatgatgtgggtatgaaaggccccagggaactaccctgtagttctctttccacttagctcccttctttcccaggcccaggtatgccctaggagaggaggcagagtatgaaaatcattcttaatagtgagaagtcatatatttagtcagacatgctaactggactattttgtgtttgaagaagactttctgctttctttttgaattattgtcacatttcagttttatttatttactctataatatttattgagagcatgctttgtgccaggccctaggctggagactgggaaaacagtggtgatcatggataagattcctatcaccaaggagtttacaggctgtaaggaagagggccctagataggtatgaagctgccaatgtgcagtgtttcaggaggtggaagggggtgggagagaaacctccaagacatgcaggtaatctggtcaaggaggacagagggagggagttttcggtgaggtggaaagggcagaaggtggagcttggataggtggggaggtaaggggttgaaagtgaactccagactgagtgaagagagtgtgcaaaagtgctgtgaagatggtccatttgaggacttcccaacttgctggtctagctggagagaaagagcagaagaaggtagcagaagataggaggctagggaggtgggaggaaggggccagattgcagttttgatggctgagttaaagatttcatatttatttgaagttcaatgggaagccatgaaatgactcaaggcagtgcagcatgatgttgtttttttggcatgtggtattgtttctataggctgtatatgacaaatatgtcaaattttgcattacgttctggattcagggattttgcctacctaggtttctgcattacattcaggaaagagctacttaaatggaaacatataaagtcattactctgaaggtctctctactgttaccaattttgatatgaaattagctgtacaataccttcttttcagggatttttaggaatttaacaccttctggagttctcttttaggttttcgtacttttgggatcacagtatttattttcagaataactccaggtcaactaaattcagcaatgactggcaaaatatcaaacataaaaaaaaagtggaaggtgtgctgcttattcgatagcaaaatcctaccaaaacactggaaggtagaatgccattggcctatgataattaaattgaaggggagaacacagcattaaattaattgctcagctggaaattatttagtaattctctgacttttaaatccccaaggttttcttcttgatatagtactgttagacatcttaaaatgtaaatttttgaaggcattactcctccctttcacttctagttctcaaatgtacctttaatgtgtctagtaacaataataaacacttactgagcccttaagatatggtgagcattaatctaactcttatatgttctatctcattttccccttacaattacttccatgaagtaggagtgctattattattctttgagagcctttagaagagataacttacttaggagtataccagtgagtaagtggctgagtagaggtttaacccaagaagtccaatcaagagcagagtgattaagtactgtagtaacctgccttgaaagtaaatagaaataaacatagagctgtatatttcatggtagctaacaaatttctaacatgtggacagaagaagaaaaagactagtaccttcaactcacgtggatcagattcaatggttctttgtattgtaaggaaaattattgtcaaggagcaaaactatttatctcagagactagaatttgttagtgcaagcctatgtgacattaaaatacaatgtgtgaaaggcatccacaatctctccaacaaatagaatcaggatcctctatttgattactcgatgggaagtaggagatgaaaagaaggcattgtacagctaatttagtatcaaattgttaaataataagagtagagagactgtcagaataatgactttatatatttccatttaagtagctttttcttgcaaactctttaaggtaaaatcaaccaaaccaaaacttcactgtaaggcatgacttttgacccagatgtctatcagggaaaagaaagatcacaaaacctgtgcaccaatgccctggagtcagactgcctggttcaaattcttcttcagttccttgataggttgcttaccctttacaagctattcaacctttctaaatttcaatttgtttataaaattagaactaatagtacctccctcactgtgttgataaaaattctgggttccaaaattcaagttctttccactatgtcattctagataatagaaaaccaagaaagaatgccataacaagcaataagtatgaggtaatgtgttctttgttggggatagctatccattttttttcataaatattgattgaatgcccattatatgtcagacttgattctaaaggatatgccccttaaatgtcatgccaacttctaatatttaattaaagagcaggaaagggcctgttgtttttgttgctgtggttgttgactgtagcggagtgttgggtagtgaaaaagatgactgaactaggatgtgtgaccttggtggcaggcacagacctcccaggttggagcctttgggcaagtctcttttctctactcctgagtactcaatttcttatctctaaaaggaaagactaggtaacacactgagccagatattattcacaaatagggtcagattcacaaacttttgatagtcagatacaggatacagcaatgaattataatgggatagcaaagatgaattataggaagagtgggtaatacttctcatcagaaacatcaagcaaacctacaaaaagagatgctgtgactatgaagacagattatgttatattccagacaatcttgggtgcctggaaaggagtctggaattactctattggcagcgaggccaccaaaagaagtcagttcctacctatttctcccatgtcatcaaatgtgaaacccagacctctgtccattttattaaaattatcctagattccatcttgcttctccacggtgcctatggttttgtctactgacaatctatgactaagattctcaagttatactttatgtgtgttcacataaaatagcacactatactttaaaatgtagccagctattcagcatcatcactgtaatttgtatttatagtattgaagctaatcctgtgtctcacttactatgtgaaactctctgaagaatattttgggtgttctcatacaactttgtagatggcccataaatcaataaggaccttctttcaacaaaccagtcattttattccttcttgatttctaaacgtctcagactcacataacccaacattagtgttctttctttctctttgaaaactacaatcagtatgtttaaaacatactgctcatatatacagaagcaatacgtatatgaaaaagacaaaaaaataggactatttcatttaagagagggacattttgtcgtttgggcagatacctgccagtctaggctttctatacttttattttacttattggaataacggtttaagctgcagaaccaaagagaaccaagacaggttggaaacttttcagggtgaaagtgaccagtaataaaccaggcaaagcaagaggaaagagactggaagaaaaaaaggcctgtgggtgctgttttatgggatagtgttgagaaattttgacggaatgaacaaggtaattttaacatgtgctccactgtgtaagatattgagacagagctggggaaagattttgaaggttttctctgtcttagtgatgtaattttcatttgctgtctattatagctgattttatcctaaatttttaatggcagattttttctctttttttttttaataaattttaaaagaaaacaattactttttatgggcaagcagtgtgcaagcacctttgttcaagctgttcataaaccacaaatctggcaacttctaaattggaaaactcagggtgtcattaagagcagagattgccggaatgctgattctcataacaaaggccaccaataggctcacttttctgaaagaaggcaactttggtggcaagatttgctcctctgttcatatgatgaaaccctagcactagtggaaaggttggtggcacacaatggaaaagtacgcttactgaaaaaatatttttctttttctgtttttctgacctttgacttggcaatgctaaattaaaaacggctaagtggaaaactatacttggaaaaaatagaagttgatctaataaatcagaatactgaaatgttcactatcatttggccaacgtaagacaggtagctttttgtttttaccgttttgggagtatttattcattcatttgacttagttttgtccattgatgatttgttctctaaaaacatgcagagaagtcccttcctctcttctctgtgaacacatagaagccagcgggtcctgcttttgtggtcctgtcacatcatccattagatatggcatttatctacctctccggcatcccttcttttggaatttcattgaggggatgaaccacatcccctttttctttcgtattcattatcttagaatagcccctgaaccatagcctactcatcaaatcactctttaagacactgtcatatttgaattgagatctttcacattatccactgctgttgtgaaaatattaggatttcactgatataacaactttataggtgaagctaacagattcctcagaagtttctggcaatgtgtgaggtttcctctaggacgaataacacctttaaatccactcccaatgcattttctgaagttaatttaaaataatatacaatctgtttgtcccagcttcagattccccatgtcctcttctttccttttcggttttggttatgcttagtctaaagtcacatgtgcatttgaaagcaacagaacaaggaattctacaccaaatttcatctcgccaaaccatttttttcccctactcatgtaagttcctaaaatttcttgcttactctgcattaatgctaaattacaacatatagaatgtctcccaatgatttccaaccaaagacatagtacatattggtttccctttctgcttatttaataaagttagtagacccacattgccctgatcagtcacagaactattattaaaattatgcaaaatgtagaatttcacaaaatactgattattcttaactctcagcaattctgctgcttaaatgtttcaaaatataacttgctttcagttagatgatataaaaagttatatagtttcaaacttaagaaatagttttaatcattaaaaatacatataaaccctattttgtatttagcttatccaatattcttcacaatgcccatgcattaatggtagaattggagacaactccatatttgttttcaaataccacaagacttattgtgagctaaatgtctattgagcagaattttacccattgtacataacgacatgatagaaaattatgatgatttggagattcataaaagttgaaagctatatcctaagcatcaacagatactatctgggcttttcatgggaatcatgggtattgctagtgttttctcaaaaagaaagaacactcataagggaagtttatatgtctagaaatgtaggacagaccagtctttagagggaaaaaatactcatctagcagtataatatttcataagaaaaagaagtgtctcgaataggaaagatgatttactttttgtgctattaataaagccttaataaagggatttttaatgtgaatatgccatgatcattctctcctgtatggcgatagagtaatttggctacttatagggtattcatccagacacatgattcttcagtgttattgtataagtaattgcattttaaaggctgtaagctttacacagggtcttatgtctagcactgaagttccaaaaggctaaaataaattataacatcccacctgttgctctgacaacctttaagtttgtgtagaattatttctttgttaagtctgtgtgtcagaaactatgctgggttctggatgaggcaaaattgtataacagcttcatagcatgagtcccatcatacatataagacccattgtgaatatatgatcactagataccttttcttaaaatctctctccttagtgagctgttccctaacaataatattgacaatattaatcacctcttccaataccacacactttccttccttgttttaatctttttttgtaagaacttaacactacctaaccgcatatatgtgtgtgtgtgtaaattagtattttttgttgtattattttgcaagttgagaataaaatttcatgagattagaaaattttatctatttttgttcagtgatatgttctcagttcctacaacctacaacaagcttcataagtatttagagagtgatgaagacagtataattagtagtagggtagatttttatgatgatgtgatagcacgaatgataaaccccgcactggttaaagtttttacaggaaaatcatatttaatctgagttttcatggataagtaggagctcaccatgtggacaagggagcatggagagaggctaattcaggaagagagaagagcatctacagagcatgaggacgcatgttgaaaaacggcagtcagttctgggatagagaataaaggcaacaggtgtcaagggaatttggcagggggtggggtggtcagaaagggtcagagaaaaaagttactgaaaggatcagaaaacaggtagagattggactaagaatgttttatatctttgttagaagtttaaatttcaggcttacagcaatgagaaatctttgaagggctttctgcagggcagtggaaagatcagatttgcccttgaaagatcactgtgttggcagtgtggggggatggatagaaactcgatatttgttgcgttaatgaatgatttctcaacgttactttagaccttacaatttggtgattcttcaagctttactataaatattgacagattgagaaaataaataactgagtgatggagcagctctagtgaggaagacaagattgcacccaatttttcagggcattaaaattggggagctttctctaagcctcttactatttctgcaactattcctaccattacactaatctaggttactcctattaataatctcttttctctgaaaatctttaactgtcttaaacagaagctttctactttaaaaacaaaaacaatttttgacttttgctgtctgccaaaattgatttgctacaaatcaggtttagctatgtacttcttattcattatggaaagtagttaatgcaaatttaaatatcagcactccccaccacagataaaaacaaacttacataaaaaacagattgccaggcaggctttgaggagtctctgatgtacacacattcagaacgattacttgttccaaattccctttcaataacacaccttttattctctcatctactccaatacgttgggaattagttttctcagatggttgtttgaaagtggttagcgtctttaaccctgagtagaaaagtagtataggcaatttggtattctttctttcaaagcctgatataactaatgcatttatcaagagcagaaattaagtatagattgtctctaaactgctatttgtatgtaaatatcaacaagttttttaagatgtaagaattggcttaattttaacaatgcttttgacctaagcctttagttatgtaattatttactcaagtaaaagtttaggtagcagtatagtagagtgtgtattaaggaagtactgagctaattttcttcaattaaataaaacctctctctggccagattatataaatcagctttggcaccatgtgaaaaaagaattcatttgtcattaatgaaatgatattttgtgaaaacttcggcataaattatttacaaatttatactaggttagtaaattctgaccattccgtggaaaagttgagaatattatgcagaccatggcttgaaaagaacactgtatcacatttattcattttgcacattttttactgggtgtcttatagatgtcaggcagagaggagtgaagaccagcaagatcccttctgtgacagcacttacacttcagtaaaaagaggagaaaggcaataaacaaataaacaagtaaactacaaggaatatcacatagtcaaaagggctttgctgaaaatataactaatgaggaaggctgcagggctgctctgcagggctcttaagcggtcggaaaatcattgctgagaacacaagacttgaagttgatctctgattttctcagaaggcctctcttacttcaacaaggtgtgattcaacaataacatcaacaaatcacaccagcagttcagaggttagggttgatcatttaccacattttttaactttatactgttagcattttaaagtcacccagcattattattagcaagtggatttattttcaatttcatttcctagtaatgtgatttaaaactatctcaaaaaatggaaattatggtttcagtagttaaaattattttatgggtttggagcatatgaaatcaaagagctacaattagcctaagccagtatcagttcaagcttcccccacatggttttactaatacccttcaaattctgacttctgccattccagccatatgtctctttaagcagatacactgtgtagtgccaaagtgtgtcaaggacatcactaggttaccaaaatcatttttatgtgcaacttcttgcaatattccaaagtactcttccacctgaaccccaccccaacccctaaaatataattttaataacacacattaaaatgtcatgctgataataaactcagagataaattacagggaatctgtctgtatttttttttaacgcttttggcactaacataatggtgtaagcacatggactcacacacattgcctaaattcagtttctttcatttttttgcaggctttgggtacagagtagtgcaaaaatttataattgttattcagtgcatacattttaagaaagagctagaatgctaggcatatgaatttgtgtttgcaaggtgtatactaagagaatagaattgtacatatatgtgatgtggctttttagtttctgattgcagttttatcaccatattatcttgtgttgctgctggggaaagcaacaaacagtggcttttgccatctcagtgaacggagatctctggaaattgcacctgttcattatatgagaaatccttctgtgggcagagaggagggattcagttttattctcaaactgttgcctaattcttataacttgtgcatatttttttgagtcatgattgtacaatctgctacccattttgggataaaaacactattgaaattgagcatactaactttaaccaagctgcattttttatgaatcaggttgtaaagttgactgccacgatacagtcatgtcctgtacaaatgagcacacacacacacacacactctctctctcacacacacactctctctctcacacacacactctctctcacacacactctctctcacacacacacactcacacacacacacacacacacacactcacaaacacaccagggagaggattacattgaacactcggaagctcattattcttccaaaataaagagttaattttttccctactggtctttccatctttgaaacaccatgagtcacggtgtttcccatttcacaaacaccacggattctttattgtctgtgaggcttccatgtactgcagtaattttgaattggatatgttatgtccaaattgacagtagtgattaagccaaaaataagtgcattttcctttaaatgttagctgcagcatcaagtaacattccctacattatgctatactgaaacaagtcagtcggcaccgaccaaaatgttgatggatatacagcagatcaaaaagaggagaatcattttgaagtgctcgctatctgtctgagacgataggcttctgaatttgtacctctttgcaaaaagagacttcacattattttgtcagtttgtttcaatttgagaggtgttgaaaattggtattcatttttttgatataacccttaaattgtacaatttaagaaaactgactgaaagagataaattaaatgggtagaaatattttcaaatcaaagaccaactgacacatataaaaatgatgtatgtttcttacatggtccacagggagaattctgcaggcttgctatgatctctacaatttgcttcagggcaaactagattctgggatattctattatccctttggtctgtttatcatggaaactgatgtacaaatcgagaggtctttttggtctctttctttctatatggttggaactggtaagaattcacttatctcatgtcctcaccttcggtaaagtgctacagaagagttcagtgaccagtaatcaattattattgagaagcaatcaattgctaatttccataattatgcacatctaaacactatgaacaagaaagagaaacaaagctgcactcccagcattgccttgttagcagtattttgttaacacaggctctaaaaaaagctgccgcagctggtaccacaaatgtgtttccagtattcaggccatcaacgtgattcgtcgctaaatgtatagaatcagcttcttgctaaaaactacaattacaggtgatatacagattgaaatcacagggctggtttgtcgaagaaaattgtcctaatgatgggttttcggatggggaatgcagctcttttctttctctgtgatgggttgtgaaggcagctgcacctgcctctatgctgtattctgccgcacttaatgatatctgatgatatcattaggcaaagtgttcataaacagatgttgagcctgtgcctaaatgctgtcagatgagcggttgctggcctgaaacagtattatttatatagaacatttacgtttgttatgttaataaccccactattagctctctggatgttgcgttaggaatgtaaatgtagttaatatgaataacaacctctttactctttgtgctgcagttgagtataacttttaggctttgggagagaaacaaagatacccccaccaagtccttttgacttcgtgatttttttttttttttttggcaccatttgaaattttgatcagaagataaatggtaagaatcctaagacagatgttaaatattagaatttgattttcctcacggttcataattttgagagattttgatatctgtaagttattttgtgtgagcccagtttgttaccctaataaatcagagtgatgatcatggacactcaattgacaaagtatccatttcaactagaatgtcctaaacatactgtcagatatggacccatttttgttccagctcttttgctgacatgatcatattttttccccagtaacctattggggcactaaggtcatatgtcacagtcatttttgtcatatttgtgttggtgatttaggcaataccttgatgtcatactcacaatgcctcaaaatgtcacatgacaattactgcgtgtgtgtttaagccaaagttgaattttatgcctcatagttaattcatgcagagtaagttatgtaaattctgacagtcatcaaatgtgcgctatttctctgaaataatgttctactctgatagccacactatttttttcgaaagtgcctttgtcattctttatgatattttaactctttcttaaatttccagtactgaaaaattgcacttgcctattttcaggattaaaaaaaaactgttattttcaattgttaatgaagaataaaaccaaacagtgttaaactggtgcttcattacaaccataattagaggttagagtgctttctgaagtgtcagcttcatctcaattaatgcttatgaagtcattcacgttgctaaaagtggtaaaggtgtccatgtatgttggtctgtaggtgtgagcagcaaactagaggtacacgtttacatgtgcgactattctcattccatcttacacctaaggatagtctgaattatttgtgattttaaataatcattataaaatttcaatggtgatagtttttcccatgcctccactacctgtcatttcaatactgatcttctagaaaatgctgaaaatgccagatcctttttatatggagatttacctccaatcttccaaataaggaaatgggaaaagtaaattaagtcagaaggtgttccattctctatgaatcgcctcctgattatgatgtttatgtggagtagatttttaaaaatctgtaactgttcgataagagaaatgtgggtactggaaggaatgaaataactcctaacatcctgaacaacacatacaaatataacatgtcaaaggactcttaagattatcaagttatttagaccctccaaagtttcttttattgacattgttggaagttgttcagaagaaacttgaagattgcatttttatttgttcatctagtcaacacttaggaaagctagccaataaaaatgttcattctgaacttggaaatttagatcgatttgagtgagaggataaaagggactgctgaaaacatcaactattgttgaaaaaagatcaattcatcaaagtctatttaacaggcatgggagcctaccactgtctccaagaagtcttcagttcctgtcttttcctcagtggcagtaattctgatcagttccttaggatgagtgcctatccatggcatatattaattcaccttcattcttaaagatggaaagtaatgcagtcatttagcttgtaattttctaaaataattcagtttcttatgttgaaattgagtgagggtcactttgcatgtgaagatatctctgctgaagccaattaatgcattctattttttgatatttgtatttacctacataactagactttcatgtaaatctcttaatgtataataaatatcttttgtattagtatgatgacattgttaacctatgtgcagggattgtagcttttcctgtgtttcacaacaaactccagagtccgagtgtaaagcaatgaataaatctgaaatctagcaatgtgaattttagcctcagctaagctaatttctatgtatggttgagcaagtgcattacctttctaggcctcaatttctctgctataatatatttatgctaccttactctcttgtttcttggaaggatatgcatatggatgataagatattaagatctgtagaagaagaatggtttgagtccaccatttcaatttaaacttagtggcagttagttgaaatataataggcctttttgacaacacattaaaataagcacttattataaaatatctccttgcaataatattatcgtagttttatttttattttcttaatttttgtttataccctaaaaatggagagagtatataaaaatatattttaccatcacaaaacagatttttggactatcttccctcagtgaaaactactttaagtcaatatctattcatgtttataattagtttaattttcagcatattttttaaaaagcatatctttgattcactgatactgcattttgtgcctcctgtatgtattctaactggaatgaccagggatttttatcatttgcctgagtttcaacatctgtaatagttaggagagttcatgtagaactctacactcatgaacataagaaaactgtttgcctttttaaaagtaaggctagtatcttcagaatggaccataactagtttcatatcaaagaaaagttggaaactgcctagaggatgctaatccattagttattttattttatcatttatttttccaatgtatgaaattatatattttgtgggctgggtgtggtggctcacgcatgtaatcccagcactttgggaggccgaggggggtggatcacgaggtcaggagatcgagaccatcctggctaacacagtgaaaccccgtctctattaaaaattaaaaaaaaaaaaaaaagaaagaaaaaattagccaggcgtggtggtgggcatctgtagtcccaactactcagaaggctgaggcaggagaatggcgtgaacccaggaggtggagtgtgcagtgagccgagatcgcgccactgcactccagtctcgatgacagagcgagactcagtctcaaaaaaaaaaaaaaaaaaaaaaaagaaattatatattttgtggtaagatggcctcaaggagcaaataggaaatattcagccaattgtctcggttctctttatgtatcttactggtctttattaaaatatctattatagtatgtaagtaaagccagtttcaaagtctggggcttatatagtacccagaaggtcatttaggtctttatgagagaaaactggagttgtaaagacaatagacatgctgtagctgtgaaggtcaaaagtttaagaatggatgccgtatgcacaaagtatgcttctgacaataactgcaaaaagttacgtgcattaatatgaactcttgattgttatttagcatgtataaggactactagtctattcttaccattttgtgttggtcttttagtctaaaacagccgtaagcaatcaactaatatattttaaaggttcatcatgattgatatatgtttttgataaggcacattcttctactgggtgctttaatatcatcagggaattgtccagcaaataactgaagacctcaaagctgattttcacctggaaaggaagagaagggggaaaaggggagggagagagtgagactactgaatttctggatataacactataatcaaattccaccttcattaagcaaaatgcttcaatggacaaagtatatttgccatgatgagcagaatttgccctaggtggtcagagtcaccagtttcttgggtccatttcttctacaaggaatggctttttaacctggcgggataggcgatgtctatggtagtggcccgaatttgggcatctgtaattatgttagcttgcaattaagctgacttgtggtgggaggattaatgtcagaagattccccatttttcaatcttgtgtctacatcagtaagatcgaactaattgctaattggcatttagaaaatgaactactctggtaccctggagctttgctgtgatatggcatggaattaggaatatgatatttctctctttgataaaagagaatggtatttactccaggaagtaacatagattctcattatacttttcttatctaaaatataaataaaaggatcagttcactatttatagaacatatttatttacaagatgtggatttcctagataccattatcttggactaaatcataagaaacagacatcattcatcaagaattaagacaaagcttcaccctgaataacctttattgtcctcaactttcgaacaacattacaattctttgtagtttgatttacattgtattgcagtattttaaatgtgcccctctgccccccattgcttttggcaaagaataccctaacatatttagtgatttttagttttttatgatatattttccggggaaatttatagtttggaaaacatttgtttaaagagctttctttatgtactactgccatctaaataaataaatattgttaagaagctactaccagaaaattatgttaagattcatttaatagacttttaaaaaatagatttgcctttctctaccttctagagtcattgaaataaaataatgatctttaaaatgtggttgccttcaaaacacctaaatatttggggtttcatttcaatcactctgattagcatttttttagactagtattttctaaaatgtggcccatactttccatgatgatctatggaaaaattatcaatggtcaaataagtttgagggaatttgcatgtgctataatattttctacctggagagccacaatacaaattaacatcaaggctgtgagaagtcctgaataaaaatatttctttgcttaactcagaatttaaaatatttctgtaactatggaatatccttttatctttggattaaatactgcagagctgatggtcaacccagctcacattgaccaacattttacaaattattttgcatgaaaggcataggcagattatttccacataaataaactgtcaccttaacaaattctaatttcttccacatcctttgcgaattgaatagctaaaatgttactgagttgtaaataaatctttcttaaaaagtgtacaatctttgaaagttccattgcatcatcattatcaaaaccattatttataattttactttaataagtacatgaaattttctgatttagggtttctcctactgttgaaatgacatataacattgaactagaataacactttataaacaatttaaagaaactttttttttcaggaaaagaatagatgtgtaatacattttaaaaaaaattagaaggcacataagcaagaaatgattgacaagctgggcctggtggcacatgtttgtagttccagctacaccggaggctgagtctgaggattgtagggcccaagagtttgaggctgcattgagctatgatcacaccacttcactccagcctggacaacaatgtgagatcctgtctctaaaaaaattaaataataaaagattgacattgaatgtaaggacaaccaagattagtccagccctttaagagaaacttcttgtgctataaagggttttggtgcttttttagcaaagtgggaaaatgcaactgtatacttatgtcttgctggttaatatcccactggtctctacactctttagttaggttaaatacatggtgtgaaggtggttttgcattgctaaagatctttttatttttaattttttttagaatctcaaaatttttactcattcagttagataaatgaacctgtgtccgaattacatgagacaggagatacacagaaataacgcctatcattcttcaacctgaaaccgacaaatgaaagcttcttctcattccagggttctaaaattgtgagatggttgcagcccgatttcataatttccatgtatttgttgattgactgggaaactaaggaaccataacttagaaactgttttagaatgtgccaagattatcctgcagtgtcttaggcatggatttttgtttataaatattttctcagaacatcaataattgtcttttcagttcaaacatattaaaaatgctacggtaacaaattatcattgaagtttgttgccccaaagttgtcatgatggagcaagattttaaggctctagaatgatgttgtctacagagcaattttacctgttcaggtattttttttttttcttcaaacaagaacctctcccttgcattggtggcctcagtaaaacagagatggccctctgaattccttcctgataaatggattccgaacaggaatgacaattatcccacattcatagtttagaatgagaaattcacatcatctccaagtctcttcacactttcagagggaactggtaagctctgaggttcagtatgagaggcagttttgaaactgcagctcctccctccaaggaaccgcgttcacctcagtcggaatgaataagtagaaatctgtgacacaatgatagtggtgacattcgtgcaaacaagtgtctcattgaaagcaaagaagcacattgcttggtaggatccctaagagccctaaaagtatggctgtctacgagcacactcatacacacagtagtatttcagtactgttggcttagctagcaaacaaaacatggttcaaatggtttaacagtcctagaaacggaaggcaccagtttaatgaggtctcctctgcttgaaattaaagtggaaggagttttacggagaacagtattcaataacaaaatattaaatgataaacacagattgcttaaaatcagacgggccattttaagaaaagcattttagctcatcatgatatgtagcaccttatttaaattaggaggtgttaattcgtagcttgaataatatattaatataatatgtaaagtgaatggcattgttaatcacagtcgcgcctggaacgactttgcttctgtgcactgaatgttaattttgcaaaacattaatttcaaagattttgcagcagtgcttttgtaattaaatattaatgtcacatgttattgcagtagcatgtttatgaaagccggcaacacttcaagtcaactcatttgtttttatatttattcttgtacatctgcaatcccttccatttcacaatttcaaagtgaaggccattttgaatagtcaatatgtgaacatttttcattgtaagcgttttttaacatccaacagggtaaatatttaatgttgtgtttttagctggtataatttttgagaaaattggctataacttttaacaactcaaaggtacctaaactgtctccagttttggcttaagtaatctgaaaataaactagcaataaatgtgatgaagctgtgtaaaaatatttaagaattagaaggctttatataaaagtttgaaattagaattgcaattccatacacaggatatatcagcagttaccaattctccatatatttttattatggcactgtattatctcaagaaaactgaaaagacagcctagactttcggttaacttttttcaagttccataactagacaaagaatagaaaaatgtttcttgtcggtgatgtgatttacacttattacatgttctgaagttatacatttgcatgaaaggaaaatcctttttatgttcaccatcttattccaagtatagacagtatacaggtcattatatttggtttgcccacgactattctgaccaaatcactacagctagtaatcttgtccatgatattaccaatcagttaattacagttagcctaacaattaagttatccccatttttgaaccttgacaagaaataacattcaaggaattatattttaaagctgttattttatccatctagtaaagttgtctttacaatcaaatccctagatacattttgtcttttgaaatatggaatgagttatccatagtaccaaaaaaatcaggaaaaatcaagatatattatgtttggttatgggcacatttaacagttaaaaattatatctgcacctgatgttgcatgttaacagctaatgccatttgacagtgatgaaattaaaggatgaagaagagatacaaactacattttacaagcatgatgggtctccaacaatgccatttaaatattatttgtcactatttaaaatgaacctttcccctttaagctatgccattacgctcatttgtcctgtcaccactgacaggctatatgactcacacacaaaaatggtcattaggtactgcatcttcatcttattaaaaaaaaaagagagagagagagaaagaaagaaagcattctgatgcctctaaaagcctgtaattattttcatccgaagagatagtgttgctcggaaggtaatttaataaccttttgcatgtacctggggaatgcctctccagggaaccaaggtgccgacatgccattcagtcgtcaaaacatgacctttaatggttgcttggagagaagttagcgtggaatgttgtacacactgcaatgctaattctgctttctaatatatgcaaaatttagttcttgagcaatgatctttgtaagatgaattaatataggtactgctccaggaaacaaaagaaattgcaacatgaaggcaccaccccccttcccccaccatgatcttttatacttcaaactgaagtagctaacaacttgcacaatttgtattaaaaatagtgcgaaacactccagaagtctttgcttcctttccccctttaagttggttgatgaattctattctatatactatggaaatgtaaaacaggattaaagggattttctttgataagtttatttcccaaaataaagcattggccccaactccctgaagaagaaaaagaaacgcttacctttaatataccctctctgttttataacacaatttatgtggctcgttgaaattactaatgcagttactgagttaattttaaaaaaatccttcatggattttcatgttgaaatatgatattttgaacacttgcatatacaaaaagatgcacaggctgtttcctgtgacaaccaggttcagaaactccttattttggtagtctgatattagatcccgccttagttagaaatgctaggatttcaactcctacccctgacacgccatccgtcaatttattagcacgctggtgcagtaagccactgaacaggctatatcaattcgtttagtttttttctttaaaatgtctgtaatcctcagctctgctttctcaaccggtcagcattaaagatttatgttgcactttttttcatcaccacacctgaatatggattacttaaatgggctgtaaataatttatatctgggaataagtttccattactgaccaatgttgtaatttaatatactgtattatgggttatacaattttagattgttttctgtgtgcattctgcagtcaggcagacaacagtttaagtaaaaagggtgagatgtttgttcagcttattttcatgttcactctgtgtgctcaaatcagcaacagggctaaaggaagcagaaagctactttcaactacatgtttttctgctatttatggaaatctttttttttttaggcacttgacctgaagcaaaatacaaaaacacataatagctattattgataaatacaaaaaaagaaaatgtgctaatgtaggtggctagaaatcttaattcttgagaactgaaaaatattcttgattcctgaacccaaaggttaactttcctctttaatgcttggttcttctgtgcagaaaaatgcacataataaaattataatttatttgacaggtttgaatgaggctactggatcaaatatgtaaaatgttaaagtacaagctatttttaaagcataggcaagtgtttactcttaaagctttaaacaatttaagattaagttgagtatagtaaaaattaataatagattaatacatgaaaatctatgaagacacataagataatgatttaaaaaggaataatttaaaaagatgaattaaaaagtcgaatcagaaaagaaggccagcataaactagggaaaaacatgctgtgaataaagtctgttagatcttgaaataggagaactgctaaataatgcatagttttatttttctatcatttgcataaaccttaagagagtatttatttgtgtaaaacttgatgtatcgagtaaggagaatgaaaaaaatggcattcattttgttttcattttggtatttaggaaaaatattctgttacatatggactacttagacctaatcatctgactgaatgtgatgtgtgccttgagccaggttggaaagggctggctgcagaacagtgccctggtcttgctgcaggcgatgcaggttggcccatgctctgctggggagcagatggtgagccaatgcttgtagtcacacttaccttccttgctaaatccataatccctcactggacacggagccaaggcaggctttggaggcagaaaggaggttacaatctggacttgggtagtgactgccagaactgagaaaacagctcagaaatttcaaatgcttaacaagttatctgtcttgtccctaagccagtgcagcatttttaaaagtaattaagacatgattgaaaatgtgtatgccatctaaatacaaaaatcttcaaaaatcaccaaaaccaatcattaaaagccacatttaatatgacattatgcaaaaatatatttaaaataaaatatatttttgtgattgaaagaaaatatgtaaagtaaaaaaaaaagaggaagcatttattttttaggaaaaggcacttattttctttacaaacctggaccttatagaaggaaaatatttcatacatgtctataaatatgctgcatggatgaaatattttccttctataaggaaatagatagctatgcaacatatctatactaacagattcttctatataagtttttctttcaaaatattaaatgattatagttgatttttctatataggatacttatgtatgtatatgtatgtttttatatgtgtgaatggagttcatcatcaacacagacattataaatcagaaagacaaaataaaaatattgagtgggtagccaaattctaatcatttataataaaagggatagtaagtaccatctgtttaatgtaaaaaaaaaaaccaactgataaaatgcatacatatctagtaaattaaaatcatggagtaattcatataaaacaaaatatgtataaaatgtcaacatattccattagggtgcgattgatttaaacatgtactatctacataatagtatgatatgagaaatagaaaaatcttttgattatgtttggtgctacaccacaattttttaaaatgtttttctattaagtggtaggaacaaaattccttagttttctccactgaatttttgagtcctcattatcttaggcaatacttttttcttgcaaatgattcttaggcatactttcattgaagttcattgactttgagggaatttcttataaccttccttactccatcttgcaacatctacatttctcaagctgacaaaatgctaccaataccctatttgtgtttatgaataacttgagctctccagtctaggactatcatcaacacctttcataatttccccctttttctattgcctctttttttgaaaaatattgtcactcttaggaaaatgttcttaatttcttctctttgtgactcttcttcagaattcatttcttgccagtgccttcatccctcaatatgtccttttctggttatactgttttcttccaaaatcgatgcaaagaaataaagaaaaatgtagaagcttctttctctgcctcacccaaaaattcaagaaatgtgccttgataggagatatgtgcaggtcagtatttataaaaggagatataagaacaaaaatgtttatcataatacatttgggaaatattatgcttagtttttattcacacaataatgtgcctgttggttttaacttttattttaatttagtttacattagaaaacggaacccttgactacaattatatttacagaaagtaatgttttcatgatttcggtaggaaaattttactatagggtgacatcataaagtagtttatcacttcattcccaaacctaaaatgaggaaatatgatatttacaaacacttttttcttttaaaaagggctaattacatagagtttcaaaaaggcctggaaagattgagttaatgtgatttttgttctcaggtgagaaaagaaagtgagaaaatttcaatggttattttgacaatgcaagtttcctataaaatcacatttcagaaggccagactggtggctcatgcctgtaatcccagaactttgggagaccatggtaggaggactgctagaggcctggagttaggaaccagcctgatcaaaatagacaccatctctacaaggaattaaaaaaaaaaaaaaaatagcacattatggtggtgctcggctgtagtcccaagctacttaggaggctgaggagggaggattgctttagcccaagagtttgaggttgcagtgagccgtgattgtgccactgcaatcgcgcctgggtggtggagaaagacctcatctcaaaaataaaaaagaactttgaaaatcacattgctcttaataaatatcaaaagattattctaggacattgtaggcatcaacaacttaaaagcaacaagtcaacacgatataaattttagcaaaaaaaaaaatgatctttaatattagatatatttcctctgtccaagagttttaagcaaagacattggacttgaaaacaggaaacctgagtttgcattccagttctgcctctgaccaactaagaaatataagaagtatttatatctctggaccttagtttcctcacctgtataattacagcatttttctaatgatttctagcattttgattgcttacaaaacagtctgtgactatgtgaaggtggaagagttaagtactaataaatagcacaatacaggtgatatctccaagcaacacatgcttaattatcaaataagagattcaggcaattcttgaaactagttaacaaagtaaacatttatatgggttcttaatgttttatgttctaaatttctcattgcataatttttgatacataaattggaacacattttggccaatttagttgacattaacaatgggaaatgtctctatgtagatctctgaacaaaattttgtaacaccgtccatgtctcagaacattaccaccagaaatgccattggcacgttccacgcatgagttccacatttttagggaatctaaggttccagaattgcagagagagaagctatatctatagacactagggagaaagtgagtagcagaagtgatctacacaagcaaaaaaaaattttttttaaatgtactcaagattgaattagaaatccaatttatcaaaatccttggagatggcttctgatctccagttgaatcttcagccctttgatatgtcacctattagccacccaagaggcacgtgccaattctcatgtagtatataaagtctccaaataattattatcttaactatcaacattattacaaacattattaattaagagagacctctgtatttccgtaaaagggaagagcactcttatggaaaaggacgtattaaagaattggaattgtcagaagttgcatctcttggatgaagcataaagcagagatcttgatgttaatggtcacagaagattctgtgttgccatctgtcaggaattatttaccagtttttgctgaccaaattccaaattaaggagctccatttattggctcaaacctaccctctgtcttaattaaaaatagtgtccatctttactatttatgacctattatgagacacatggactttgggatttaaaaaaaaaaattctgcttcctcttctttagttcaggttctcatcatctattaattgaatttctaccataggttcataaacaatattcacatcagacttcttgacccactctaagccattctcctggggctggctgccagagagattattccaaaatgcaaacagtttttctagttgttcactgttaataatttctctatgaatcccaatagcctttaggaaaaacagttcaaactctttactataactttcaaagttctccgtgatctggctactgcttatctctctagtgttatatcctatgctgaatcgaagttctatccatcctggaagcctacctacaagttaccaaagtttaagttggttttccagatttcttttttaaccaggaatgctgttctacctagccacatttcctcatttttcctccaaaaggccattcctaatcgctttccccaacccccaagtctggttggatgtatcctttttacgtgctcctataataccctgaattatcacaattatacatcagcgtaaaattgtctgtttccctgtgtctcccattagaatacgaacttcaggttcaggggccaggttatattacttttcatatttccaaggcctaggctattctgtggcaaaaagcagtatttggcacagttgtgctctgtcctaaaataccttcttctctgggcttctttggcatcagccagtcaaggaatgtttcttctgcctctttgggaattctgcgtcctcctcttcacctcttatttgtggagattcccagggattgatcttcaacccctttatttccttaatatctgcaatagtctagatgattttattcgggatgaaaatctctacagttagtcttgaccatagatcttcagacctatacatccaactgtttctttgatgtctttatttggatgtttaatatgcatcttaaactaacaagactaaacaagaatacttattttccttcccactcaaaatctgtttctctcttgttatttcctaccataataaatgaactactctaactacttggttgtacaaggtaaaaatctaggattcattcgtgactcctatctgaacacaccccagtctaaataatcactgtgacctctcagccctgtgttaaagccacctgaacacatctgcttttttctgtctccattaagcaatcatggtccatgtcaccattatcattctctggactactatagtaagcttccagttggtcaccatacttatgttctaactctcctatcctacctttttcaagagttgccagaatgatcttttaaatgtgtaaatgaagtcaagccattttcctattcaaaactttataataattttcattctatttagaaaaaaatctgccatctaatcctggtttaatattctctgcatcattcaacctcctccaacattctagctccatctcatcccattcccttcttttcactttgctgtggccacactggtcttcattcatttttttggaacatgttaactcagttttgtcctaaaggttttgtccctactgtttcttctgtctagaaaactcttgcccaggtggggtggcttatgcctctaatcccagcacttttggaggccaaggaggaggatcacttgaggccaggagtatgagaccagccttgctaacatggtgaaaccctgtctctactaaaaatacaaaaaattaattgggcttggagttgcttgaacccgggaggtggagtttacagtgagccgagattgagccactgcactctggcctggataacagagcaagactctgtcttcagaaaagaaaaaaagaatgaaaaatagaacactcttgctactgttctttatatagttttcttctttctgtcattcaaattttacctgcttgccaaggctttccttaagggctatttcaaaaagtagccacttagtcatttgctgtcacaatattctatataccacctatcattatcacatatttctctgcatatcacctatcattttaatactctgcacaacacctatcatcacctctatatgtttgtcaatcaattttgatttatcgtctccaaactcaccaaaatactaacttcatcagatcatgggacttgcctgtcttcttcactgcagtattcccaacacctagaactgggttccaaacaatagaaactcaaaaataattgtcagataaaggaaatagcaattgcatgggaaatcaagtttgaacagtgaaacttatttgaggattactactaatagatggagagtggaagaagttacatgtcttcttctcaaattttaaaatgtttagtaagatcaacgagcaagattaaaaagttcctttaacaaagacaccaatttctagagtagagaaagaccttataaagtatttgatgttgtcttaagaggtaccggggaagccaaatctctttcaactatttttccccatcgcaataagccaaaaatcagagaggaaacagtagcaaaaaaacaaacaacaacaacaaaaaaaaaaaaaaaacattcaatcatccattacataaactaacagatatcatctgaataatattgtaggcacagattcaccttactcttgtgctattatataacagaaatttaattttttccttccttggagttttacttggaaattattttgttctctcacagaagtagtttaggattcatttaggagtgggagtgagaagtgggagggacagcatttcattatttaagaaatatttattaaacactttctaaggagcttacaatctaataaaaatataaaacctgagcatgatacttataatatgtgctagacaattacaagtatgatattataagtaccaagtaaatgctgggaaactttagaagagagaaaaattatgccccaatgaagaatcagtagggttcatgtattggaaaaatcaagaaagcttggttttgaagtacgcacagaattttaccatgttgcagataggggaagaaagatatttcaaggaaaaaggactctcacagagtacatgtactaatttaagtagttccaggccaggcacggtggctcaggcctgtaattcccagcactttgggaggccaaggcaggcggatcacttgaggccaggatttccagaaaaccctgtctcttaaaaatacaacaattatccaggcatggtagcaggtgcctgtaatcccagctacgcagaaggctgaggcacgagaattgcttgaaaccaggaggcggaggttgcagtgagcaaagactgggccgctgcactccagccttggcaacagagcgagactctgtgtgggaaataaaataaataaataaataaataaatagtttcattctaacaagacacaggaaaggaaggtggaacagtagtcttagttcttataatatagaggatgtagtacacccgaataaggaaaagaaatgttctaaagttctctgtagcatgtaaaacaactgaccacccaatttgtgttaaaaccttatgaccctatctcctatactttgtcttatcttgtgcctttttctgttttcatctttggcttctcttctccagtcctaaggagtaaaataaataagaagctaacctgagccatctattaggacaggatattcagcaaatgctttggcacaagactctgttgctttaggtcttagggaaatctggcaatcatcctttcagatcaaaatctctagattcctgattcagtttcctgctgctaactttctggtggatagtttgtgtgacaatgctgatccctctatttgcacattgccgtaattgtcaggcatatcagacatactttgccttttaagcactcgaaaatgtgcaccatgatctagcaccaaccatcacctccactttgaaatctcactcggatcttctatgtatacaccacacaaatcaccagcaagaaattacagagcctggattataaacatagaacttcccgaaattgaatcttgccttctcacttaggtcatacaggaccttagacaagttttttaacatcgctaattctaaatcgatttatatgtaaaatagcaataatcatacccacctttgaaagaaccaactctgtgaagttacaaccacaactatttttgcttcaatgcacaaatattccgaagatcaatgacagaaggtgtgtaaaacaccaggtacatactaagaacttaatagagattagcacctccttgttttgggtttttcgattcttctagaaagcttacttcacatttccagctgtctaatttttactcttatttttatattcagctcctatatattctaaaatattttttgaatgaccaattgaaaagaagttttattaccactaatttctccattttccaaattccctaagcattttatcagaaactctttaatcgtagttttccttctctgccttggttatggtagcacagatagatagtctctctcttattatgtgttgaggtccaattttaattttgtatcctcacagcattaaatatgctattttttcaagtaacagatcctgtatctacacatgctgaatcactttttttggatgattctttctgatgttaaaccgttgtcaaataatgtagattgtggaaaatctgtaaaattatatctagtaatttacctaataaggtctatactttgctatggacagctagatattacactaataatacatgaattttcttagtttctagttaacaaatttatatcaaactgcctaaaatctattcaagatcaccaattcaaaagaataataatttgcacatttgataaaaattccatgaggaaaacaaataatattttgctcctaggtcaaagttatagtgttgataataaacaaaatactaaaaattgtgcattttggtatcgactttttgtgaattttctttagggaatttgattaatgccttctagactaattctataaaaatctatatgtttcagtttattatttgaagatttatttaatagggttaaagaaatgattcaagtaaacttagaagcaaaataaaatcacacacaaaaatctattggctctttaattcttaaaatccaacttagaaaaaacaatctttaaaaaatttcagttggaaaaatcgtagttatgtaattattcattcctcctgaaatttaaaataaaatacataaagggtggtctgggtatttctctgtctgtggcaacatcttttaacttgactctgctatcttagtgtttacttgatttatcttaaagatatttttcaaagtgtcctgtatcataattggcaggtccatgacacttgcaattggctctaaaaatgtttatagtagccaagatgcagtagtagcattgtttaattttacttttgttttaaatagaatgaaacatgtaaaagaaaacttcttcaattgattagacattacataacaatcttaatttccttcaacagttttttcctattctttgggtaatgtatgtctgtgtttgcttcatcaacctctccactatttgtggacaatgaagatcccccaaaattaattttatcatcacctctacctttgctgtcaataagttatctcttccatctctgagggttctgacctcttgcccttcctacagttgaaaaatgttgttttatttatcttcatcatcctcacaattttctctttatttgccatctttcctttatcatgttgtactcccttgacttcattttataatcctccccatcctgttttgagtctcacacaacttatcctgcatattgctcttccttattcctgattatttttgtattttcttgttcatactaattggctccatttttatttccagtatatttataactaaatggcattcattgcctttgggcatacattaatttatctttcaggattttccatttactctctgcatcttttctttatatatttcttcttgtaacctccatttcacttcatttttctcatatgttttggtgtattatttttgttgttgctttttaaatatcccttcatatctgtaattcatgcttcatgtgttattaggagggtttataaaataaaccactgtgtatttgtcacaaacagcattaatttgaatagtctaaaaataggtttggattcattgtactgcaattttccggccaccttctttacagccatactatagggcttaactaaataaataattagaagctaattttacaaattaaaagaactacagatattttaatttatttacctgaggtcagaaaagggtagtttattgaaagatcaatggacaaaggcaaaacttatttcaagagagagatgtttagacctttggaggtaattaactgataagaaagtggtgcatatatgctaacatcattaatcttcatacttttctatgccttcatgcatataataaaggacacatttaaagccagatatcccttcttcaagaaaatccttgaaaagcacaaatttgaggcaaataaaaatgtaccaaataaactacagtgcaatgtggaaaatattacatgttaaataacagtatatttagtgtgtgattggagtaaagaaatatgaagagcgtcttagacgactttctagagcaaataacatttcagctaagtatcaaagaatcatacacacattgccacctggagatgaggaacagtgttcagagatgttgttccacattataattgaaagggagacttaacagggagagaggcacgaaagaaaaataaaatatcagcatatcttttactaagacatttggaattttcctacagttcagtgggagtcattggagagtttaagcaaagaagtgacatgatcagatttgattttggaatgagaactccagtagacatgaagaaactggacagcaacaccacagccacttagagtggtaaaataataatatcaatgagacagaatgaggacacaaactaaagcagaatctgaaggaataattagaagatatgtgagagtcattaaaaggttcagtcaagagaacttgaggacacttaggcgtgggggcagaagaaagcaagtgagaagcaagtggaaagcaatttttccataggattcaaagccacccacttaatttcaattagaaaaatagagctgtgaaatggctattaagtttaatttcatccagatagattctccagtttgcattgatgattagatcactactaccttatgacagtgattacctaccttatgacttatgattaacagttgaataaattaaatgtatagtcaacagagaaaataaaaataacaatattagaatgatactttctttattgcataaatgaatagtgacacattcagacttcccaatgtgcagcaagggagcccaaaaaacaataaaaaatattgcacagacattcatgcaaaatgaaccctgatggtagtaaattctaaaaatggcagaatttagttttaaatgcaatttccacatttgcatactatgtaagaaggcatcttataactatgttcatagtatattgttcatctcatttccataatctaattcagtgatacttatgctcttcaaatagtattcactgatcatattttatctcttttttatcttaaattatggttctgtgaattacagaccacatcagggaaagattgtaaatatcataaatataatgccaattttcctttaaaatggcaaattatataaaatatattttctgctttttcttacaaggaccaaaagtagacaaacctttgagcttagaagtggattagaataccttttaattacatagcatataatttttttaattcctcagtttattaaaagattataattttgaaaaggtaatcctgagtaatgtagagctgttgattttaaacagacttcaatttagtcaaactttcttatccaaacttccaaagtttccaatataattgcaggttgaatttgccatagataatgcaggcatttgggccatacatataatatactatctatttaagctatataatccattgttatatactgagaccattttagtgcaaggtattctaccaggcactttgcagagaatattttatgtaatacaacaacttttcagagaacgcagtattctttttcttcttcttcttttcctcctactttttcttcctcctcctattattattatatcaatttatttactgaaaattgaatttccaggaagttatataatttgcccaatatttctcccccgtagatgtaaatcctgaattgggattcatatctgttttattctaaaacgcatgctcacttccactgaattatgctgtcataaggtagcaacatcacaatcattttgggacagtaagaagtagataaggagtaggtcttaaaacagttcttctttggtgcaaaagaactacatcattttatgtaataaaaaactgaactgtaagaaccctaaggaatgataacacaaaccttaacaaacaggacttatgcaagcataccaatttcccccagagatgtttagctcatggtgtttctttaataacaaaactcaaaaaacagtgaatttcatcaattacatacttaagatccttggcatgtcttgctttttcatttctccagcccatgtcaatagtactgagggggaatatcacactctggggactgttgtggggtgggggaaggggggagggatagcactgggagatatacctaatgctagatgacgagttagtgggtgcagcgcaccagcatggcacatgtatacatatgtaactaacctgcacattgtgcacatgtaccctaaaacttaaagtataataataaaaaagtagtactattgtatcaagtcatactgattatattgtatatacttacagcttttgtaattatttaatatatatttgatgccttatgaggaaattatctaattagaaggcaacatcttctacatcgtttctaaaattattttattatatttgttcaacaatagttagaattcttaactctgacaagcatctaccaagcaggatttgagtctgttctatgtggactagtatacttcatgatactcaaagcaacttcagattccttttcccagtggtgatgtgtggtatttgagacaagcacacttcctttcatttacttctttctctactatggtatcttgtaaacccatgttaaaagtttaatgtttagtttttttccatgtttcaaatgattatgaaagacaagataccttgtttgcttaatcatgactttttttctcctttgagaccacttggaccaaagtgactatcaaaatagttgtacaatgtgccctgataaattggggggaataggttgttggggaattttatttgtttttatttattgttgtttgttgtggtcattgttttgactgtagacacctatttgaggtctacttttgaaaaagaatattattggatatagaaagtaattcaaatattattggcaagataaatttattttactttaagttccgggatacatgtgcagaacgtgcaggtttgttacataggtatacgtgtgccatgggggtttgctgcacctattaacctgtcatctaggttttaagccctgcatgcattaggtagataaatttctgcaagaagtataatgagaaggacaaattgatgaggacatcttctctaacaatgaagaaagagttttatatattatttggcaatctctagagtttctacatgagactccaagatggcatattgtccgtctttctatctccctacctacctatttatccatctatctgtctgcctgcctgtctatctatccgtcttcgtctcctctccccacccccaacacaaatatgacagaaatgaatacattcagattatatacatacagattcagtttcatctggtttgatttggtttggtaataatccatacactgagctaagtgctccaattttctttttcttttttctttttcgaggctagcttgttcccctgttttggaaaatttcctccttactgaaacatcacattacaaccaatattatactttgccaaatattttgttgtaaattctgatggcccactcttaagcaatcatttatatgtgtacttctagtacataagacttcattgagttttcagtttgtgcattccattatcatgaatgtactgagaagcaacttaatgatttattccttaacccaaacacttaattttactcctttgacttttacaaaaatatcattagtctttcaagaataggaaatcttacaaatcaacactaaagaacttactcatgtaaccaaatactacctgttccccacgagcctatggaaataaataaataaataaataaataaataaataaataggactagtcagctgggcacagtgactcacacctgtaatcacagcactttgggaggctgaggcaggaggatcacttgagcccaggatttcgagaccaatctggcaacatagtgaaaccccatctctacgaaaaatagagaaaaaaatagccaggcatggtgacacgtgcctgtaatcccaggtactcggaaggaagaggtgggaggatcacctgagcctgaggaggtcgaggctgcagtgagccgtgatggtgtctctgcattccagcctggcgacaaaaaataaaatggagtagtcgatttaaaaaaaaaaaaaaaaaaaaaaggacccagagactccaagagttctatttcaccaatgataccatagcttcttaatctactcatgtacatgtgactgtgcttatataaatttgaattttaaaattgcttgtagacaaattaagatagaaaaagaaataagatatcacattaatgaatgggtattcataaatttatatataaacttcatattgtatattccaaagggatctggaaatttttatatttttatgggagttaggaagattctttctttaccactttcattacattatttcattaaggaatctgatgaaagatatggatacttgccttagaaaaaatttcacataaacaatgtcaaattgtggaattcctgaagctcattcacaggcctccctggagtctttgatttcagtgttatgtcagttaacatgtattaaattcctgtcatatgctaagcaattttaagaaggcttgaaaagtttgggcacaaaaatgatatgttctagatgataaagataaagtatgtgcacctcatttcactgatgagtagtgagtggacaccttttaaaagcctatgacagtgcctgtacataaaaagagattaataaatgttaaccatcctctctcctcttaaaaaaaaaaaaaaaaaatctagtgagggagatacacatttaagcaattatattcaaaaaatagatgagacagataaagagaaaatagcacataattacacagtacttacaatttcatagtcccttttatattggacaactttataaccccttttgtatatttactcatctgaatctcaggtcattattagtcaggtactgttattcccattttatagatgaaaatatcaaggactagagaggtaatgaaacttgctcaagattgcacaagtattggcagaaccaggactaaaagccaggtaatgtgttccaagaatccatgtgcttaaccgtcacatttgctatctcataaaaatacaacaaaggccaggcacggtggctcacgcctgtaatccgagcactttgggaggccgaggcaggtggatcacgaggtcaggagatcgagaccatcctggctaacacgatgaaacatcatctctactaaaaatacaaaaaattagctgggagtggtggagggtgcctgtagtcccagctgcttgggaggctgaggcaggagaatggcatgagctggggaggcggagcttgcagtgagccaagatagcaccactgcactccagcctgggtgagagagccagactctatctcaaaaaaaaaaaaaaaaaaaaaaaaaaaaaaacacagaaatgtctcaagcaatatggaatggcaagatgaaagagcaattacttttgttggtagtctaggaaaagtctcagagaagcacatcaaatttgtgttaggcattgaaagagtagaggagacatatagtacctagggtgggatgtcttattaaatataaatatgacttaacatacttagtgtaatattaataaagttctatgtctcctaatgaaagaataaaacataattattgagttactcatgaacaagaaatcccaaatacatgaaacatcctgtggacctagcaaacctgcaaaaccattttcctgaggctaaactgttttcagaaatatgttagctcttaaaaacaggtctataacaacaaatcccaaatattgtgtatctgtgaggtacaattattctgttactcacatataactgatttgtacttttgttatttctcaaagaattggcaaagggtgccgcaacgtaagtggatgaaagccattataatgggtgaaataaaatccggtggctaagaaagaacagatttctaaaggggaaaatattattcagttcctagttttaaaaaatgggatatagaatattataggtggattatgggatattgtcactggaatgtaccactttcacctggagccacactatttggtgtcattagtagctgcttattctcgccattttccccaccccatttctttcccactgctaccccaccctgccatatcctgcacagagacaatccattctttgattcttctttggacaataagagtaatttttacatgtcagcactcgtaaatccaccctatgaccatagtaggttgttttttgggggggtttctgtttgcttttttgagatagtgtcttgctctgtcactcaggctgaattgcagtgatgtgatcttggctcactgcagcctcaactccctggactcaaaattctcctgcctcagccccctaagtagctgtgaccacaggcatgcaccaccacacctggctaatttttgtattttttgtagagatagggtctcactgtgttgtccaggctggtctcaacctcctgggcttaagcaatcctcctgccttggcttcccaaagttctgggattacaggcatgagctactgctcctggccataggtacttctggaaagagttgttctaccccaccagactaatgactcctccaggacaggtatgtataatccttttcccattttataatctcagaatttaatgctgttaatacatgtgtgccaaaatgattgattataaaagggaaaataaatgaatatatgatcatcacagattcactatgagggtgaatcaacagtgggatccatatttgtaaaataaaacaatgaaaaaataagaggttagaaagaaaggaaatttggctagatatgttaatcacagatgtggacattaaaatgtagtctaagtcatcttatgacaaaataggtactgatatatgacagtttatatttttaaaaagcaaatgtttatttaatttcaaggttaacattagtgatgttatgctaaaatgtgtgtgttcctagtaataattgcattactaacatctatctagatgagagctctctactataatcaatagaaatgtcattggcctcccctcctctcttcacctctcattctgccatttctccctagagcactattaaatgtaaatttcccaaattcttttctgtgacttttatggcctgaaagtaagtaatctgattggtgatgaaaattcagaacaacatagcccaagtaccctgggaatcacagttctgccaagcacttatgaactaagaaaaatatactctcttgcacatgtggaatgtcagaggaggaactgtgcggctcactcagctcactaggtgttagaacaacagtgcaagggtatccagtggtgacatacataaagacatggcctccctgggagctccagtgatttagaaatgaaatcttagactgccctgtgaaagttgaagatcctgttgctttacaaaggaatggatattgcataacttgaagataaagagagcaaacccactgataatactgccatggttaagtgttcttactgaaaacttctatcaacactatggctctaaagagttcattccggcagccaagaacagggaaatgccagctgagaccccaactactccaaatgctcattaaatagattttacttttttcggtgatggttgtttgaaaataggagtgtttatgagaagcgcaagctctctttaaagaaaaagtagaaaatgacaacagaacaagctcacattgtaaaatgcactatgcaaagagaaaaacaaacaaatacacacgcatgtggcattctttgtcatctctgacatcttcaacttccgcgtttcccattggttgcaatcagagctggtgtttagaataatgactgctaggttctgtaagattctcaacattacagatatatttcattatgcaaccctttagtattctaaaagtggaaggagaaatgaactaagccattttaagatagatttaaattacaaagatagaaaagcagagagatttttattcattctgagctaaccaggaaaatcaattaactaaaattcctgattgccagagcatgctatgtaatttgtatgatattaactttggttttacttaccttcaattgtttatagcctgtcaatgaaaatatttcctgaacaatgttcaagtattaacattcattgatagaatcaattcactgcagcctactctgtctggcttgcgtaaggttggtgtagaaaacgaagcttccaaaatcaggatccggaccagaaggaaagctttgtatattatgagctaagaacatttatttttatcaatttcagatatgtatatggtaagacttagaacacatagaataaaattcagaaagtaacatgtaccgtggaagctaacactaagcattagaaaatttgatcttaattagatttattttaaagggtatgccatataaaatctatcattaatattataataatttaatatttaatttaaattcatactttaatttactcccactttcttctggctttctgtttctcaattttatatttctttttgagcctataataaaacataaacctggtctcagctcagtttaatattttgagatgtcgaatatttaatttcacaaaacatactttttccactcctcaaatgcattccttttttgctttttagattgcacatatactgtgttttgtattattggtaatggtaaatactttcctgtaatgccttttaaatattttgctcagtaagtaataaacaagaacttcaattcatttgcctggcattaaaatgagactttgctcccttattgaggaagtacaagttttggatttcgtttacaaatggcatatatggactgctttccccaacatttagtagggttttcaatgacaggctaataaaatgtatcttaaaacatttgggtaaaattgtaatcctataaagaataaatactttaaaaaaaatccagccaatacttaccaaatgaagttatatactgtacaagagaatttttaagtaggaagaaactttagtgatcatttattctagtttcttgttctaattaacatactttttaaaaacctctttctacaaaattgaagaataaaaaattgctagcacattttcagtatttttttcttttcattattagaaaaagtgttttgtaatacataattatttcagaaaaattgaaaaaataaaataataatgcccaaagtgtctattattaaatatattacataagagttacatatttttctgcctttatttacctttacatatacattgttattttataaattgggatctgaagctagttttgtttcctattttttttcactaaatttagagtgtgaaagttacaagtcactaaatacttttcgaaagacaatttaatttctatgaagtttataataaatgtaatacaacaaatacagtgttaaaaaggtttgagttggagttttgtaattaatttacagcaataaattaacaaagtagcaaacaaaatattatagaacatatgcctttgcatcagaacttttttgttcctgattgagtatacatcagtttaagacatttcagtcttctcaatgtattgctcaaaagcgaattctttgaatgatgtttataaataggctttttttatatgtactttacatctctctctgatttaaatagtcccttttcccctcacaacaaatataccaaaatatagtctccagttaaacattaataattaatttaatacactcagaatgtcataacacttaatgagtagaatactttggctttagaaacagcctttggagataaatgcagaaaggaaaataaacataatgtttactgaaattaactagaatggtgaagggtccccctcaccaatgccttggatgcatgactttgggagatatgtttcaattcagcaaagcaggtgatctagtaatagtggctaatgtgattagcacttgtgaaaataaggtcataaagcacaatttctaagatcttttagaaataacttgtaggtggttagaaattcaaagccattcttgagtctggagatacgaaacagtttattaaacagatattaaagtacttctaaaactttaagaaataaagacacttttctatcagtctcatctggtattaaggctaatgttatgtatccatgttacctcttggcatattggggtcaattcccagttatctatccaaaatagtaatatactggatcaaacccaatatctttcctgttctgaattctctctctgataacagcggtagtttataaaagagctgtagtcactcttaatgccttagagaaagaatatacttccaaaacaaaaatcaatgggaactttgaatcactcaagagtatcattttagccagttttttccaacatcttcctaagcaccatcctctaccagttctgctaaaagtagaaacattgattgatgtgttttatctccttccccctccactgccatcctctagcagagattctagaaagagaagaaatgccctaaagacaggttgcttgaggaaaatggagaagtcaaagatttgaattatatccacaaactggataatcaatctctaaagtattgaaagttgactgtacacaaaaagtgcagtagataaatattacagtttgtaagttgaagcatgtaaaatattgaagggaatgggtggaatctttgatgttacatgtgataaaccttggaaccaataaggttttttttaattatttttttattttttatttatttattttttaagttttaaaggtttgaaccatgaagttttaaatgggaatttcaaaaatttgcaagttaagcatccccgatgacttgttttagaacttcaaatttccacatatgcactcattaaaagcagagatgattaatcaattgtctcaagtgcatgcatacatgccttccatgtacatgactaaactaaaaatgggagtgaaggttgagaactcagtctgtgcaccacatgagtaaatcaccatccaagcatccaagcataaatttgcctgttgttgctgatcagtgcttgaattcatagtaaaatgacccacactgatcatttaacaaggtggttttttaggcatatatatatatatatgtgtgtgtgtatacatttgcctgttggtgccgatcagtgcttgaattcatagtaaaatgacccacactgaccattcatagtaaaatgacccacactgaccattaacaaggtggtttttaggcatatatatgtgtgtgtgtgtgtgtgtgtgtgtgtgtgtgtgtgtgtgtgtgtatgagagagagagaatcagcttcatcatggtatagtttacacaattctctctttagtttcctgaaaaagaatctgaagtttctaatgtgaactttcattgtttttgtcttctacaaagatgtattgtcaactatagagaaaagtgaacaaccaaaagttgtcataaaaattaaattgaaaataaaggaatctgaaataattattaataaatttccctttttcaagtaaatatacttcaaaatttaagtaggaaaaataatgactatttttttcaaagaaaaagtaaaggaaacaaatacacaaataggtaaattttaaagacgttcttactcaacatccattaaacaaatattttattgtgccaggaactagattctcattttcaatcctcaaaatttgcagtggaacagagcaaaaagaacaaaattacccatttttgtatgtatctactttgtgtaaagcagtatagtaggtactttccaaagaaaatgatgaaggaagggataaaaagaaatacatcaggactgtggttatagccctcaagcagatctaatctaattggagaattgagtaggcaactgatagtgtaaacaaaacagataaagcagattaatgagttctaatgtaatatgttagtactctgcttcttattagtctcctacttaatctactatttgaagtaataatgtagtatagtaggaagaacgttactctgtggtttccattcctggctctgttactaacatttgggctgaccatgggcaaatgacttaataacaggaatagctaccattgatttgattgcctgggtgctttgcatgcattgttttgttcaatcctcacgtcaaccatatggtatcattctgactataaaagtgactgtaagtccagtttgttagagatagtcctgcttttgccctattgtccaagtacacttgttaccagtgtcagtgtctccttttaccctcaagagtgctccagtttggatgatataataaattttctccatttgatgagaaacttgataattgcaatctaacaagtagtagaaacagatttgatccaaggctgttgatgcctaaagcccatatacatagccactctatatatgttcattctggttaaatagttgctgcgcttccttgtatatacataaaatgaagcctttaaagtaaatgatctccaggattccttccatctctgaaccctaggactccaagtacagacagacacatatgtgtgggctcatgatactgggatataaactttacatcaggcttagcgaacagaattaggaaacaatgatgaaaagaaggctagacagaatgggacatttaacacattatagaattcataatacaggtgcggctctgaatacttaacagaaagaaactagcatccccgggcaatgtgaatgagagatgaccctggactgttagttaagcgaagctgtatcttggtgtgtgaatgacacgttaagaacatggtataatgtggcatcctggttcttgtattttgaaaatacttgaatattgtttagagtcatttgcatctatttaaaacaagactaattgtattaaaacaagtctagttgcgtgtatttaaaacaagtctagtcgagtgaagtcttcattcaaattctctttttgctgaatattatatggcctacaaagagttgtttggctttgctgtgattttaaggtgcacttcagatttatattctccccagatgattatattttcctggggaatgttgatgcattcccgccagctttgacttctcatattcccttctttaccctcatcttattggatgtctgccatcaatattaaattgtcttaatcctgatttttctacctattgctgcttttgcagttggcactgattcttatgccccttgaaaggtacttgtgtggcaaaagattgaaaaaaaaattggcagttgttgtcagggttaatgtagaaaaataaatctcttatattgccagtttggatttacttttcatttttaatggccccaacagatgttggaggaatcctctacttcctgcacacttccatttttacagctggtactgcttgactggttcttgactttgggggagcagttcctgggtgtttacacagtgatttacaggcaccctctcactatagactatgaccatcctcttgtgtcttttttcccttgcgatttttcttgaaactgatgtaactctcaatgcagcacctcacaaagtttttctaacccagtgtttcctgagcaatagattctttccctactgtgcagcattctgaaatgtgtggtatgttagattttttaaaaaaagcataaaggggaggaggtacaaataagaggtgattttcaaacttagcaaatcaggcaatctatcctttttgatatctctctttgtatctttttcttatgttttcccaaagtattcatcacaattttcatctaggtggttcacttctcttgatgcttttgctttttcctaaaaccaccctcccttctttcctttcttgcttctttccttccttccttccttcctttccttccttcctccctccctttccttccttcctccctccctcctcccttcctttctttcttcctcccttccttccaccagcctcagtgtcactagcttccaaaaactgtactaatatcctaaggctactgtaacaaagtaccacacaaacaggaggcttaaaacaacagtaacctcttgtctcactgttttggaggctagacatctgaaatcaaggtgtcttcagggcacgctcccactgaaacctggaggaatcatgccttgcctctctggtttctggtggacagctgccaatctttgacagtccttggtgtgcagctggatcatccaagcctctgcctttgctgtcacatggtgttctccttgtgtgtcttcacattctctgtgcatgtatgtctcagagtccaaatttcccttttggtaaggacaccaatcatattgaattagggtccccttaatgacctcattttaacttgattagctctgcaaagaccctgtatccaaatccggtcaccttctgaggtactgggggttaggactttaacatatcttttcttgagggggacacaattcaacccataacaccaactaagaacagaattttcctcacacttgcttccgaaagaaatgttgacagcttttagcaattgggaagatcccgtgaggctgaaagtgccatcgccggctgctgtcttgtctgcgacttttctgtgctgttcacttgctctcttggtttgagagttcccgtagcagaaaaggcagagtcagacacaaaactctcataaaaagcatttgcttaagtgacagattcgaaccacagcctttcaagaagctctttagtgaactgtataaaatttgcttggtaaacatcctgacttgagaaaagaaaaactatcaagcattgtgagaaagaaaattatcaagtaccagtaacactagccatagttttattttcttcccaaattcttacgtagacgtgtgtcaaggttgcagaggataccaaaaaagcttatcaaccctcaactgtgatgccctgtttcagtaattaataaagccatttaaaaagtcttttaaattatactagggataggaaaaaaacacattagaaatgacatttcagaactattgcacaatttgcctaagaaggcttcaaagttttcttctaataacaaataatgtataattgtcattgtcacttctattggaaaatggaggaaaatagaacacttttctcaagcagatttcttggctcacttatataaggttagcaaggcaatacttttatttgaatgtatctttaagaattagaaatagccatgaatattcttgattactaataaaattgttttaatgtcaaaagaattatatttacaaatcctctattgttaataatgctgctataaacctatgtggaatccaaatcgtctctctcggaagtgctttactgaaagtaattatgccaaatatggaaagtatacacaataatttgtataacattctcgatattaagccagatcctcgcagttctcaaacaattcttcagtatgttaatttgatttaaatttttaaaaagttgattcaggaaactgtagaaaaacaaaatagttaagccacttgttcagtcaaaaccagtaattatgtgcctaaagtattttgtctcctaattcatttgctttgacatcacatagacctagtcttatatatggtagcttatactagaccataaaaggtgttacgcagtgaaatactaaacaagtcacattggacaaatctgataaaatcaatattctaggggcaggatttacaagatggggtcttagagtctatgatgaaatatttacagcaataaagaaacaggtattggagagaaaactaaaattgacagtcacctgcatgatcttctggggccaccctggaaagtccttgccatcctcctcagacaagagaaaagtcatcattaggctcccgagggtaattcaaccttgcagatgactattcctctacttggaaatagtttgactatacgtaagtgaaaaagactcttaagaattttattttaaaattttattttaaaaatctcaggacatttaaacgtatgcctgttgattttttttttcttttcgttgatttttcatggagttgatggagataaaaagatcagcctggcagcttgctggcatggaactggagtgtttagggtttgttttgcctttttgcaagattggtccacaagaactttaaaaggagaaaaagacgatgcaaattaaatacgttagaaacgtatgtcccatctgtttttatttcatttttagaataaggttttcataccttcttttatttttatattctatgataccacactataatgttggccacctcggagactaactaaattagctatcctgaccatatggaaaggaaaagctttaccagctaaagaaataaatttaactcaggcaaaaaggcctatgtgttttagagttaaaaaaaaaaaaaaatgttgctaagtacatagtaggggaatgtaacccacctgcataagtaaaatttgaaaagagatttggatattcaaaatagctgtctcttttcttggcgtcattcaggaatcacccatatttgaagtgtccttctgttgtgctatcatctggatgtatttgtaagtaaactcacaatcagagacatgaaggctccttgaaaggccatctatttctgcctctgcctctgagaaaaattaatcctaacctgtccggggataccttaccttaccccattatgggggttggggggaggaaaaaagcttcagtgcattcagagaaaaaaacttttcccctaatatctttactttggaacactgaataagacattcctttatagaaagatactttgtttcattctacaaaagcccatactgtcaagcacttgatagaagccctaggctaccattttattttacctagagagaagcttctcataaattcaccatgtaaaattgatgactgcttcagtaatctaccaatcttaggtttttatataaaccacagtgagggaatagagcttgcagaagtcaagcatatgttttgtagccacgcaaagagtaaaggagtgtctgcctgatctaggaccacttttgagttgacacatgcagttatttacaatgattgagaacgttgtagttcatgtacaactcatgaagacaagataaatagatgggtagagaagcttaaactaaaaaaaggtcaaccgaagtgttttctgtcacttgactgtaactctcagcacaggaccactcaacttttagagtgctgaagttaaaattctctttatttcaacagaataatagctaaacttataagtgaaggcatatgttttgagaatttttctgtatacattggaaagcctttttttctggacactcttaccagcaggcatttcaccaaagttcataccaactactaaaattacctgaatgtattcaagatgtgtctccatatattttttctgtactaaggaaggtggaattatagtagtaattccttttcccaaatcatgggacactcagtgtaaccattatctagcctgtaatataactttccaactctcagatatcaagctagtaggatggctttgaagtaccatattgttctccgaaactaaagccgtttgtttgtattagatgaaacaaactaatcaagcaaaagtattttttctttagaaaatgtagatgtcttagataaacattgatctagattttttaggttctttgattcatatctgtattaatattaagataaccagaagagacagaactataagaccagttaaaaggccatctcagactctagcagttgtgtttgatagtggaacacagtgttgatgctctgaactacataaataaatacttcctctctgtcgtttcttaggacatcttaactttcatattcaactctaatcattgtcatagtccagtttatggccaagcataaagaatgaatagtttccttaaaacctacatgatgtaattcacattatcaatagagggaggaaacgcagatgaattccacttgaggtatattacagcctgataccactcagccaccaacacagagctgatatatcatttgtgtattctcaggttggatgttataaactagacaaaaatggccatgggtttttccaaggaaaaaaatgttaaaaatctaaatagatatggccaaatatgcaattttccactatgagttagtaaaatgagccatatatcaaaaaatagaattttctttaatttagagcttgttttgtagttaaggaatacaatttttgcaaatgccagtggggggaaaaaacgagaaagcacaacttgtcttggattaaaaggagaaaaatcaatgcctactgaagactcatgcttgagaaagtaacatgtaaataaatactaggctcttcaggtaaagcaaaattcaaaaatattagtgagaaatagactgaagttagaataccttttttcactcacataataaagggccaacagcacacacatgtacacatacaatgctagagtgtctacttctgtgcatatttatcttcaaaatggccagcttataatattgtataaaggttacctgtttcacagtacaaatatacacaacagagtacaagcatgcacaacaacctcactactttgccatgtaatattttaccacaaatagttataaaacattaattcctttttggtttcttttgttgttgttgttggttgtttattttttttttggtgggaacatggatggagctgggggccattatccttagcaaactaatgcaggaacagaaaaccaaatactgcatgttctcacttttaagtgggagctaagtgataagaactcatggatacaaagagaaacaacagacactgaggcctacttgagggtggaggctgggaggagggaaaggagaaaaaataactattgggtactaggcttagtacctggatgatgaaataatctgtacaacaaactgccgtgacacaagtttacttgtgtaacaaacttgcacatgcacccctgaacctaaactaaaagttaaaaaaatcattaattcctagggaaaaaagatgaaaaagagttcagatagtgattgcacattttgtaatggtggaagttccttttgtaaaggaatttaggaacattgatgaatgttgaatgaaagtaatttttatctgatgtcctgataccactgataataagtgacaatgattttgaaaattaaacagaatgtaagagtcccaactcaggaatctccttcacatttgtcattatatcttatctttgatgagtgaactctttaaaaaaataaagattagctgccaataatactgataatataaataccaattattgagcacccattgtgagccaggccctgttgtatactcttttcaattattagtcaacagattcacaaaatgaattggcattgtattgacattttacagatgaagaaacagatacacagagcaggtagagaacttgcctatgcacatgtagctagtccactgttaattaccaggtatgaaccaggccatagagatgaaaatgaatagaatgtattattgaatcttcccaaaatagaaaaaaaaaaacacagctactgatctttattacaaaaagtgggaaaaaacagagttcttaactgctactccagaacccttgtcagtacccttatctgaaggtgaaagaatacacatacacacacacgcatgcaagcacacacacacgcatggacgcacatacacatacacgcatgcgtgcacatacacatacacgcatgcctgcacacacacacacacacacgcatgcatgcacatacacacacaagcaaatgatatttagaagatctcttaaacaggcccactgaaatgcctcaaagactacctaatgctttcccttttctttctaaaatgttattaactcatatcaacactactaaatactgctaatattccactttttggtatgcctatgttactgtgcacctgacagttaagtgaggtacttaaaaagaaaactatttgtttccaaaattattcacgttatttgtaattaatatacaaatacatcatttaattaaatattacatgaacttatgaaataacagtgttcaaagaagctgtcatttgtatgaaaaccaaaggtgaatgctttgcaagacttgataaataagttgctaaaagaatttttcccaaattagatatgagcaagacaactgtgaaaagctgcaaaagaaatcttaaaaatccagaaggattctgtacttggtttactttgtatgtatcactgaattggcactctaacgaaatcaaaagtagaaattatgtgatacactacagatgggtttatgggagagagacagcacaaacccccaaacttgggccttcagacaaagaaaggctttggccctacataagagtgttgccaactaaatatgtatttgctctaaacttaataggcttagggaggcatcgtgtatgtataaactatacatacatacatacatatgtgtttatacatacacaatgcctataatgattcttcacttaatttttcaaatttctcatcaagtattggtcttaattgttccttttaagagtgcttctgtaagtattaaatctaacttatatattccattaatttgtaatttaattgcgtgtccaatgtacagcagtaacaatcagaatcttcacaaaggccagtgccattttgtaaaatctttttaaaggattaattcagttatgttataattaagtataaacatcgatatgaatactttcaagtctccagttcatattactatatgtcaagtggagaattaatttttttttaatttggtaaactagtagtttagatagcttcagtgtaggtagtccctaaaaatatctgggtagactgtgaaattgtctcatatgccttgataatttcagtttttaaaaggagtagcttaatatttctattttctgttcttttactcagacattattattattattattattattattattttttattattattattttacaaattgtatttagtatgtgtttttgaaacacaaaactggcatgctggtgtatctggtgaatttactattaagcccaggtctgcaccagatgggcaggtgaaaatgtgattatgaggtgtgtggcgttatatccatctctgtaatacttgactctccaggtgacttgtacgtctgttacattcatgaattcactttacggttattcttacagatactgaaagaagcaaccttacaccacgcaaggtctatggaaaacaaaaacttccctcctttaacacaatcacaataaatgtttcataacaaccagataaatagaaacatgtcagcattttccccggcaggttcagaagtttgatgctgaaatactggtttgcacatctagaccaagactaaagtgagtttgctatttcaaaggaaaatgcaaattgaggcttaggctgcacctttctgtatcactgttttggtaagtccacatggggcagacaaagccaaacaccagctaggtggtagaattccccaaatattcatctgtgctgaaaccttcaaaagtcaggtgcctggagagctcatttaatgaaagggttatctctgccaaccagtcagtagttgatatttttttcaccagaagttgtgaaatattatttatgtatgtagaagacaggggcttcctgccgttgttgtttacttgtgtgtttgggcaagtttcctcctttccagaaagcaagttttccataaaagcaactttgcaatggccctactccttttgtttgataccccaggcaaaaagcttttcatggtattgaaataattttcatttaaaaacagggagctcagatgaaccagtcctttattaaaaaaaaaaaaaaaagcagtaaggtatccttggttaactttttagttatttaaaagtagcttgttgaagattgaatatttctatgtttcactagagcctttaaatataaaagagatatgagactatatctgacaccatcaggcatattatattaaaatttatgaacaacttcatcaaaaaccactttccctctcctgcatagagacagatttgctctgacataaacgttacatggctggttgcagcctcagattaatgcgaagaccctggcgattccttttagacgttattttatgaaataatacctgtcagctgctgcctgatcctagaaaagggggcaggttttccaggtcatcttaccatctgtcagctaaagctcatctgtccctccacattaccacctgatctgtgctaacaggcctcacggggaggcctgcttcattggcccagtgggaaccagggaaagagactgtgagaggacatcacctgtgatgctgagatttaattatcgctgaagtgatgaagatgtgcacacagattgaaatgcttttgaataaattcatggagcaggagatgctctgccccactctccgcttccccctcccttccttttctccctctttagccccaactcccagccaagtgtgcttcctagttccaacacaaagcttgcagatccccccaccgtggatatttccaagtacacccttggaaaacacatgcacacacacacacacacacacacacacacacacacgtgcaaagagagaaatacacttgctaaggtaccaacccaaagggagggaacaatccttgtactccggggaaaatttgcctccgctttttacagcaaccctgattattttctgccaaagttccttgttatcaaattttaaagccgtattgattgttgctggcttgaaaatcagatttcattgtgggaccagctttttacctagggttttactcagtttgtggtaacaccagcacagagttacctggggtctcctgtggagagttaatgtgaaagttcacagtggaggtggaagcgcggtagaatataaaaggtaaagaagggcatagaaagtccctggaaacccctgtgactgtgggctccctcacgttctctgaatcaataccctgcacaaaagttattacaggtccaggcctttttgctttcaaagctgcttaggcagtatgtggcattaattccctcctgtacaaaaatgtagttgataatcacctggctgaggaaaggatttaaggctagaacagcagatttcctcacagattacagaataaaacctagtttcttgggataaatcaggataattaactgtagtgaagtatgttacccttgttgattcatgtccatgtgatacctttgttagatgcaaccacagagaaacatttatgccattatgtgaggcgagatctgatttctaccaaagcatgctatgcagcacaatacaagtttttattttcttggttttggggagcctgccttcagtctggaggccagttattaagcaagcacttaactcaattgattcctaattataaagttacaagagaaaatgatacactaccaccagtcccctttcctgccaccttttgagcaaagttgcatggccctgaactgctcttgactctgtggctgtcagaagttacagaatttccttcccaccatcacttgcagagcaggatacccctttccctgagaaggaagacttggaacagccgaagaagacccaagggttttttctagcacagtggtaaactgaaattgtatatttcctttttctttttaagggaaatcatgagcaaacattgccttaattcacatttcaaaaatgattactacagatttcaagacatttatcatgttgtcattggaacctgggaaaggttattcttgtggtacttcaggtcacaaaaaagaacgtattattagaaactaacacataggctatccaagagattcctgaggggaaattagaggtccactggctttgacaaaaaaaacaaaaaaaggtgacaggaatgaattaggtaacagggacccacagaaacttatcatgctctgaatggtcagtttccaaagtaactccaatctattacatgatacagttcttgtgagaacacaccggaaatatacttacagtccctgttatacttttccaaatacttactacttttattctctgcaatggcatggatttttatgaagctgccattttccaataattttagagaaatgttaaatgtaaataagtatataatagaaaatattttaaaaagaaatattatcctgccaagtcttttgtcatttgatccacatcatcaactttcagaaatatattatttgtaaaaatatgtattgaaattatatcttctgaaagacttatatgtcatctattttttcaacagatgtagatttaaaatcctatacatacaattgagtgttaaatcctacctatatgatgtggcatgttcaagtaatgagtgtatctccacaatatatccccttagctcacagcaacacttacatatatactctactcatagaagacaaatgagatttattttggatagctttggatgagtgtggctgtttcagcagcttgaagtaatgctatgaaatcagcaagtgaagtagagatggatgaggtattgaagaaacataaacagaaaattaatgaatctgctgagagttttttgttttgggtttttgggagtatagaaaaaattctgtacagtacatatgtctctaatgatataatcttgacctttgggtgactggtctagttttcaacaaaagtcattatctttggagaattgttcagtaattagaaactttttttcaaactaactcattgtagatgtgcatctcaagacagaaatctccatagataaaaaaaacctcatagtcaatcttaaaaatacagagtatatgttaagtgtgtgtaaaggagaagaagagggagaggagaaggatgattttcagatacatcttagctttttcccctcttttataaaatacattgtttacaaagagatgatttaaagccttttattctaaaggtttctgtccctgttttcagttttggattgctgaaattgaagaaaaataaagttaaacctagacagctcaaagatctacccagccaaagctagcttcctctctcttttgcctagattataagatttagattattataaattttataatccagggactatcattgttaatattgcattttatgcattaagtgctaggtcttatatcaccaataataatttgtccactagatagacatcattattaatattattaagaagaatgctagttatccataatttatcttttagaaaatctctctagataatttacaagaaatcttatgttattacttaattgttacttaagaaatctaaagtgagctgggcacggtggctcatgcctgtaatcccaccactttgggaggcgaaggtgggtggatcatgaagtcaggagatcaagacgatcctgaccaacatggtgaaaccccatctctactaaaaacacaaaattagccaggcctggtgctgcgcacctgtatcccagctacttgggaggctgaggcaggagaatggcttgaagcttggaggcagagtttgcagtgagccgattgtgccactgcactccaacctgggtgacagagcgagactctgtctaaaaaaaaaaaaaaaaaaaaaaaaaaaagtgaaatttggaggaaggacattaaggtgtctttcacaggactgtcttccccgttgggacataattaaaacagaaacacttcaaattgctattaccgtacagccgatctgactgtaggaagagcaatctactgaaaatatctactcggcaagcaatacttctcagtaaacatttgtcagcattggcattcttatgagctggaggatggaacccccaacagggccatgtccatcctgcttctgtggtttaggaagacagcaaatattaagtgtttttctaaaaactccacccttttctaaagcaaggctattaattattggtgcatatacacagtgatcactaaataagcctacaatacatacaatgacaacttaattagggcttttcaaatggacttctttgctcatccagtgcgacacacacttaacttccatacaactttaagctacaacctcattaccattctgcataaactaattgactcttagcgatgaaagcagccacaaatatgctagtctgtgaaagagagggagatgtccaaggtgactcaagagctagtgacagccaagacaagaacacaaatgactctctcccttgttggaaagttgtaaaaaaagaagactgcaaaattgtggacataagaaagactaatgagaccatggcaagaataattgttaacagtgcaagcatggtttccaagagaccttgactctacattacagatgccttataccctctgtaagtcaccaacccagagggatcttttaatggtgataatgataaagagaaattctgtcaacctctcacattccaaatggccactttaatgactagtactgtcttctacctgcggaaaacaacagaaattaaaatatgaagactttcccaggttagggaagccatgtttcaggaataggcatctttttttaaatcctagttgaggacttatggtaaagtacaaagaatcatcccatacacttcaatgtcagttgtatttcacattttgaaatgcttgttagagttaaggagactggagaaatcctaggttacatgataaaatgagttttcagagagcaatgagacagtttattgatcagctgattatcttgctatgtcttatgaggaggagaaaaaagattccaagactccagcctgtatcatattttcaagaaaaaaatttgaaagtggtcgaaatttaccattcagaggatacagtgaagaaggcaaggagcaagaaagattgctatgcttagtctgaaagacactgtctttctggatcacctactaccacatttagcaaccaaaccaaacataaataataaaaattcaaagcacatagattataaaacgtgaataatataataattttaaaaatgatagttgtttacattaaaggagcttaaaatttattgaggaacagtcattactatataagaatatcaaagaggaattaaatcagattgtgggaggggagcatttcagcttgactttaaataattgagtagatattcaacaagcaaggaggtgagagagatttcaagtgagaatgagtgatgtcccaagtcaatagaaatgttccagcccctcttatatttctgacctagaactaagaattctctggtgaataaaacaaagtcgatgacttcatggtgtttgtggtctaaatcaaaagaaggatactaagcaaataattaaatattcacacatttgcagagagctgttcaagaagagtacaaagtacaatgggaacacacacatagttacctatagaagatgttcttgtgatataaaaagcaaaggaacataattagtgttaaaggctgtctccagcagtatctagtctagagggtgaaggaagactctcctaaggaagagacttttaggaaaaggagaacaagtaaccatgcatgagtgaaaagagaatctaaaaggtttacagatagaaaaagtatctcattcagtggccctgtggcaggagaaagcatggcatatttgaagagctagaagaggtctggaaaaagagaatgagaaagacagaaaggcataaggcctgtgaggtagacagaaacgtaatacaggtccctgtcagctatactaaacatgtttcacttttatctatgaacagtgagatgctattgatggttttggcaagcagagacaaggtgagttggtcctggtgtgcagggtacagaagtcaggtgtactggcagatgaagatgatgctagtcaaaatcagaaccagaactcaaaaatcccaggaaacacaagtacttccttcatactgcattaatcgatattgtggaactgttggtctttgtcactacaccctagacactgtcagcttctgagcaaatttctctcttaaaattttaccacaaatcaagatactttactgatgttctcatcaaaaacgaggtaaaaggattctgtgtttttagttttttttctgagtctattttattccgctgtgtttgggagcaacagaaagaaactaaacatttatattattgcttctgtacttccagaaaattcttccatttcaacagagtaagaacgttattagtaatatcagaatttcatgaagcaaaccatagcatcttctctgtgccataactacattttcaataacataccaaagagtgtaaactgatggccagcttaactcaggaatacagcatcacctgttaagggttttaataagcaatgagtcccccagtcaagtggtccccagagaccaacaatttaatgatgctatgacagaccaagtaaagtgtttggttcaataataaggagcttattgtgtgcgtgtgtgttttttaagtacgctccatataaatattccaaagaaaaagggatttaagtttttttttttttttaatctaaacgggtatctccagcttcctgaatggtttcatgaacttcatgctaaggaaaactatcctaggaaataactatccattggaatatctgtcgctcatctagatgcacattgaggtccaaatggctcaagcatattcagtcaaggagatgaagcatctcaatacccaggacctttcccaggagcacactggagtgcatttaacaattgtgattgtaggaatatgtatatagctctttgaagtctgtgaagattatttatatgaattatctcaatatttctaacctgcaacagtaaaggcgatgaggtatagtgaggcaatgactcacctaaagttagagatggaggaagaggaagaattctggaaaagtctttgacatttctttttgaaaatagagttctcctcctccacattatttcctaatttttcagtgctgcaaagagaaaaagtccacagactcctctttgccagttcaagggcaacctatgtacagatggaagtagatccagattcatggcaagagaatacaactggggtcagaagacataaatccctaaacatagtttggatgattatttcatctcaatgaagtagttgtgaagatcactgatttatgtgaacaataatgataaataagaatgacaagaaagacaaatatggacaataataatatgagatatgtatgtgtgtgtgtgtgtgtgtgtgtgtgtgtgtatatatatatctccaaccttagtttcatgtgataaatgtgtgactagtacttacatttctggtcatttgttttgcatgaacaattttttatgtaattttaaaaattgcttattaaaaaattgctaaatctcttagattctaaaggaagagaatataaagttgatgtattagagatactgtgtggaaacaattaatatgttaaaatattggcaaaaaaaaacgaagaagaaataaaatataaccctagcatttttacttgcagtcttctcatttttgcttaacttttttcataaatagcaatttaacaaaacctaacactttaatgtgacaaaaccaaacactttaagaaaaactgagctctacagtgtactatacctgataaggtgctggatgtcaccaacatcattaatttccactgagctgaaatttctctaacatgcaggtctatctcacaatgtttcatcttcatttagaatatttggagtagtcctctttaattatttgaaatgtatatagatagattcatatcttcaatgaattgattataaaaattctcaaagaaagcaagaaattatttttctgagtaactggatgaaatctgtaacctgagtgtagactctcatcattaactcctctctgccttgaaatgttttctttctgcttttactgaactcttaaatctgctttttaaaagtttcactattgtacaaaagtcccataactatgagtcatctttatttcatcctcccacttagcaaatgtaagagcaagaatcagatttcatactcctcagcctaagcagttagactccaaggtggactcaagaggtgctggggaaggcaattctgttttgtgatttaggcaaagttaatgtaccacctcagttatgggttaaatgtcaattgccataaactctaagagaattaaagtttcctagaattttgtatcctctaccattgcttaaactcagcagcccagctggggttttggaagctttcagctttgagcttttgtagttgctaactccgcttgttgtaaatgcaaacctgtatttccatctgcagtgttgttgatttcctccagaaaacactgaggcacactcagttcataggcacagatgactgggttaagagcttcctccaagcataatgctgtatatgattgaatgtaaacgaccaactctgatcatcacccacacagtggaatggaaataagagttgccgaatgatcctgaattttctggttcataaacaaacagaaaataacaaacctaatatattgagttttatgtgcagtttggccatgaaacaaactttcttccccttgcaatgtttaatgagaagcatccctctcattgcactttcactttagatttaaacttccctatctcaaataatcaattgtttataataaatgaaaaaaatcctcatttttttttttgaaatggtttctggcatctaattacggaggatttttgacctggctagacagataatgttaacacagcttcaatactaaacaagcctgaacatgtgtgtgcttgacttttattaaactcctactgaagaaacagattaattggaggctgattcactggtgaacaggcgttaaagacagaaggaccttctcacattttgttctgttatccaggcttatgccatctcaggttggcaaggagatcccaactgtagtgttttgaaatataactgaaagaaattgtagaataacaggtgcaaaaaaaatgcaaaccacttataaaaagttgatctcattcctttctttttctgttgccaactggccacctgacactttatggactgaggtactgcccagataacatttcacataataatataatgtggaggctgactatggaggtttgcagctgtcgtaattatcccttatacaattattacttttttttttatcctttgagacattttttctttagaagaagaggggtacaagctgtaagtaaaccatttcacttaggctcaaagagcactgaggcaaaaaaataaaaaaaaatgcccttcttggcagctttgcttctatctaaaaaagctggaattttattccctgaggtttcttttgttgtttaatggtttatgttccataagataagcaaagcaaaataataataataacgataatgataaagcaacaaggaactaagttgctggtgagttggaaaagggccttgtaatgtatttgtggagaacattacgatttacagggttttcccacgtattatctcattcataatatctctgtgaaataggtgccaccagatttttacagctgggaaaaaagcctcttaaaaaggttaagagacttcctacagtcgttcacagagtaagttaggcaaccagaactccaacccagaccatctgactccgggtctgcctagggcttttctaggaatgtgcccctctggaaagcccctcaagccttctggatctgatccttttcctctatcagataaggacattggtgggaagatgatcttgaaatctccttccaacttcaaaatgtgatgttgaaatgtgattataaactactacaattataaaaataagcaacagattagtcaacaaatatctgttgcaatttgactccaggcaagggtgatctgttcagatcctcaaagtcacatcagcacacacccaagtctagttcatatcactaggtggttctgtgaactggttgttttttgacaaagctccattagtatcatcattttcttctgtgtaaatacatctctgcaagccattaatataaacaatgagatgaatgtctgagtttaaggatttcagtgttatatttttttaagtctcaactgttagaaattaaatgttacaatagaaatttgggtgggttacagattttatcatattttaaggaatttaggcttaaaataaggagaaaatacaatttgttgaaagtgaatgattgaacttttaggtggtggctctacaggaggagtttgcacttcaaactactttatttgtaaatagggtaaaattcatttactttaaagaagcaagaaagaagagttatctagttgtttgtttactgagaccctgtatcttttcaccagagttttgaggtagtctataacttacatttttgtaattaagtgccctgagatcacctggtgaattatgagctatcacataaaaatatgcaagtgccatgcaaatcctcatatccattcacttcaaggtaggatacacatgcaaaattgaaatggacctatactagatatacagataaccaaatacgaagggaggcctttattttcagtaattacctttaggaaatacgttgactgtgctgtctacctttaacttatggatagggtgttccgtccttcttatttaaattttatgctggatgacaaatagttaagatgacatatagtagagaaaattgcagggtattgtttagtctcaattctccccctataggggagttgagtagacttttctatatatgttttcaacagctgattggggacttattgatttttgagtacatttcagtgtagaatgaaagtccgagaactcagtgaactttttcatctctccacattccaagcctggtaaaaccattccgcctgctaaatgatgttataaatatcaagattagtttcttctgaaatcaccagcgccaggtgcattccatttctcatgtcatataatattctgttaccagtgttcacagtttaagatttaaagaatgtgtagacaaaaaaaagagtaaggacacataaatgtgacaactatttacatatcctatataagatatgctggaaagcaggattaataatttctttttagttttgtctttgttttgtttaggtggggtaggatgaatggaggtagaaataaatatttataaattagctattatctctatcataaatagatagaaaaatttaaatatattacttgcaaaaccaatgttattgtattttgttagctgcacttccaatgcataaaaatctcagcactcaagatgtccccataaaatctttcactaaacctttgttttaaagtatttgaaaggacatcattccatgtgggaatattacatacagccactgattcaacagtaactgagaacttatgtacaaaacattctttacatattgacaaatatttctaaaaaatgaattggtattttttgttgttgagtgtttcatgagtgacctttacctctgtagacatatgcagttttcagttttttgggtgagactttcaaaatatttttttagagtgttcaatgttagcagtgacatttttacagtgatttcagagccttgtagtttagaatattctatttgctttatttctaattacttataccatcctcgttttaaatcctgtgcagatgtaattgacagtgatgatatacaatatgtatgaaatgagctttttcctatcggtggtgtgtgtcatgcaagactccattgcaatatttacagttaaactaaactttttagaacgagcaaaattgcatttgttttgcagatttgctcatcattaaatgtgaaacatttcacatttgtctttttgagtaattggctttttaaaatgataaggtgctctgaacacttgttatgtggataggtctgacgttgtatcccagaaatccatatgccatacagacagaacagaagaaagatattcacaagcatgtcacagattggactaaagcaagccaaaaacccaagtgccatggcattaacaatagcaccagatttactgtcacgatcacaatctgtgctgcatcacagacagaaggagaacttttgataggtaacacctcagtgtttttttaatctttttggcaaattatcatttatcattatatttttgcctgccatataatattattacaatgatataaaaaatgcaggatacgtttattaagccccaacaaaagaactgacttattcagtcaggccatgtaggattaaagagagaatgagaggcacagatattctgttgttttattacagatcaaactaaagttggaaaaatagacaacagcaaaggtactagggaagatttagcttcttctgagttcgcaaaaggaaatggcttattagtgacagagaaaacaaaagaattaacctgcttgggaacttgaaaactctgatgtttccaaaatatgtggttccccaggataaaaactcacagctaattttattttctaaattggaagggggggtgggtggggactattttgagatgtgaaactgtccaatcctttctgctctgtgtgcgtttccccatgatgcagatatgaagagaccacaattcacaggatgtcccaataggtactaaaaaaagatttacaaaatcacagcttgagaaagagcctcatgttgggctgattgaaggaaaaaccccagaaacactgcacagagattcctggcatctaatagagtagagaaacatcagtcgattgtttttcttaattgaaggtcactttgggacttcgatgaaaattttttttcacctgttagctgtctacctggctaaggacatttctagaggacaacctatatttttcttatagaagaatatattcttaagtcatctggttttgttaatttcaaatattaaaacctagtttctcaaagatttaaaaggattcaagtaaaacctttaaaagtaattagtaaaatgctaagctatacaagtatagctatgtggaaacaaaggaatatcaatccataagttaattttaaattcagttggctgaaatattatatattctaaagtaaatctagtttatatcattttcaaaccatatttttccaccaaaattgtaattattttttattttttttctttttagccttgaaaccaataagaccgtttgatttctagtcttgtattaatttggagacctgggtatattattttctttcaacactccacttgccaatgcctgtcttccttaaagctctgaggatttatttactgtggaccacttccagttcacatgcctcactttcatgggacttaatatatttcttctaattttcaaactccatcaactcaatttaacttatttttcactaactcagagatagattaagtattgtgatggttagaaagaggcacataatagttactattttcaaaaatacatatgtattactagggatcaaattagaaaaaaaaatacaacccaaaacaaaaacacaaccaatttcttaaactgtttttaaaaattgcataatacataataatggagaaggcatgcccagcaatggaagaaatatatgcgtgagatatgaaaacagaccagaaaaagactggagtttcagcagtcaagggaagagtgcatgtgtatacgtgtatttttctgtgtgtgtgtaattttaaatacaattatttaaattttgtaaaataatcgttctataaaatcactcaatccctttgattgttgagtttctattatgagtatatgaagctaacataaacagcacttaaattttcaccagagacaactatccatgcaagactctcgggagctgcacacttggtaccaggatgtaattttttttttttaaagaaaaggaaggggagccacattactcaagacatattcaagtgagagtagattgcaatttctctagtttaaatggaaaatccccataatgttaatatttactggctttggagttgttgagaaacatgatgtagctatgatattaaagttattaaatattcagttgttaaaaggaagggagtccaaagacaacatggtggcaaattttggcatcagtaggggttagaatatactgatgattctgaaccttgaaggacaagggaaacataagtgatcatatactgcaggcaaaggagatggagaaaacaagaatgatagagttcaagaacaagaattggtaaagacaatgatagtggcaatgatagaattatgaaagtccggaaggcaaaacattctatggaagaaatttgtattgaagaagtaaaatttgatagagaccctaagatatgtatagaatataaatgaataaattgacagaaacagatgggatcaaattatagcctgaaaatgttgtatgtatcatttaatctaatacaaaaatttatattttttcaggagcatgtttatcacctaaagcatgggtacttctaatttaaaataagtatctgatactgcatgtgtgggtttcctttaggttagtattagttgattaatatttgatttaaacagtctttgttcagcttaaataagatgtaaactatgaagtcatgtttgatttagtcattcagcagcaaacacttatgaattcctaccaggtgcctgacacaagctctagggatggttctgagaagctctggcatagagcaaccaaaggaagatgagtgcctcatcaggcaacagcattaaggaaaattggtgaattgcattgagtttataaaataagaaaaagtaaataacgggactcgtgatcatgctcttaaaattaatgaaaattattattacttaggtagtggtgagaacttacacattaaaacagagacagatgatattggcatacgcagtatgatgtttctcaaagcctgcctgagatgaaacccatattatcaaaatttacaacttctacatgaaaacaatctgtaggttagatttttctctctttgcagtgattccaaagtatgaaaataataggtgaaaaatcaaggtgaactttacaatgacagagttaacccttgctaaataatttgtaatgcaaataaatctttttatcaaattctatatcaatttaatgtgtgataggagaaagcattttatgaagtatattaagtaagtttgatgttataatgtataccttcctatagcaaaacaaataaataaatgcttataagccaggtgttttttttttctgcttttgcttttgctttatttgttttgtatcgtggccttaatcaaattttgcttatcattttgtgttttttatttttttgatttcccctcttatgagaattcattattcttacggttatccttgtacattttagtacttgtttcatcaacttcagtaaaatttactccctttataaaacataaaaaatttgtgctccccttttcacattgtcataaactacatatagatttattagttatattttttgtcaagttgactatatattttcttctgtcactctaattctcagtaagttttagcttaaggagtgtccctcattttatataacaactttctcacttgaagatgtttttaactgttttgattattgattggttggaatcaaatgtattacgagactcacattgtccaaggccatctttttgggtgcctttgtgtgtgaacatacacttgactacatacaaagtgcttgggtaatgcttcatttctaccaggaccctagactttctccatcgtttcttgcataagaatattgacataaagaagtctgaagtcagcatgttttgctctaataagtgacttcatatttctgccttgaggtccacaggacttttttctttgtccataaagtctggtaatgctgcaagatcatattttaggattttaattctgtggcattttttcctagaacacttacatcttatctacttgtaaattcaggtttttctctatttcaggggagttttcatctgtcagatctttgaatatttttctgtttcattttatttcaattttctttttcaattgtaccaatgatgagcatcttacatgtcttttgttgttttctcatatctattggctttcataaatggatgtacctcagttaataattttttactagtttgtattttgatcgtagaattttcaccacatgcccatattttgtaagctaatgttgttcaattttaagagtttataattctagttttaaagtcttttttaccaaaatattctttagaagagtgtttgtttatatgctatgacttccaagagaatggattcttttcagctatactatttgcttttaatttctaattgtaggacatcatagttaagaggtgtggctttggtggatcattgatactgtctttgtgtcttaagctacagttaatattttaaaatattcttctttatgatatgtgtagacaattgtgtttacatcattgtgttctttaaatccccatgttcctactttgtcaatctgtcaatttaagtttgtcactttttccatttatttgtcaatatatgttcaaatttatccttgtatttctgaccatttttgctttatatactttatttaatcaggcattattttattttctcacataaaatgcattttaccaagatagactacttctatggtagcactaggcatcataatacatgaatttcatattctcagtgtcttagcacaaagtttatttcttgatcatatcatagttcattgagtgtgttctctgtaaggcaatgaacaccatggtcatttagggactcaggtttctcccatcttatggttccatcttctattagtttctgagagtcctctccattcagctaaaggaaaaggaaaggggatgaaagttgtacaggagaacatcaaagggccaggtctggaagtggtggatttactgtccgtattctgttaagcatacataactacaagggaggcttagaaatggagtctagctgagttcctacatggaggaaaaaaatctggtgaaaaatagaaatatttgggctaccatttattcatgcttatccctattatatcttttgttttctgaatattgaaagtttatttcacattttttataacatttcaggagtatacatttgcatccttcattttaagcttcattgttttcttagtttaatctcttgtgaatagtgtattgatagatatctctctctctcttaactcagcctcataagctctattcattaatgggaaaatataacccattcatattttttaagatgaagtgtttaatatttctgtgattttattttatgctaattgttaaaccgtaagtagtcatcatttcctttcctattttctacctttagaaaatgtaatgactttttgggatctattttcatctatgtagtggtttagaaatatcattcactgaatgaatcaagattctgagcatgctttttcactcctcagtggaaatgaaaacaacagcaacaacaacaaaccaaataccctgggatgttcttcatgtagatattggttttttgttgctttgatggaaatgtgacaggagagtaggactaatgtttgtgttcactctaccagtaggattaaatccaatattctcttcaaaatctttgatttcattttttttattttgtgtattttaccctacctgtcattgtacctattctatttcttgcatttttagtgtattttaatttttggtataatttttcttgtaatactgaattcttttgggctctcagtatgctcgttttatatttttgccaaattatcttttcctttaccatttgcatttattcttgtatatttgtttcagtaggtccaagttttcctagaaaaaattgtgtgtgacattttctcctgttttctggaataatttttcttctggtgtgggtttttaaagtctgacttctgtgtgtgtatatatatatatatatatatatatatatatatatatatatatatcctttttcctctcactcttttctgaggaagtaaaagcaagagttgtaatgtctgtgcctgtgcctgagccccacacagaatgctctctgttcattaatcttggtatagaaagggttgatttcaatttcaaactatttaatctgaagaaagttgtgaatttttctttggacagtctctctccctctctcccttcctcccttcttcctcctccttttcttctctcttttcatattcttaatctgcaaactacttttaatagattttttctataaaaatctataaaatttttatataatttttttatataaattttgtgcgcttttctatatctggacttcttttccttcctcactgaaactctggaccacactattaagatctcttccagctttaggctgcatatatctaagcctactactatctttgagaacatgttatgaaatattacaaattatttcacatctaaaagttgagattagattaagaatttcctaacatctgctgtcttagaactcccccactcattatgctaatagttctcatatcatttttgccaaaggtgatttcaaacagattaaaaactccacagacattacttatactcttgaaatacatcagtattgtgtatgtgttcaagtacttctattatgtaaataattgcaaaaaagtaaaatatcttctttaaatatagatgatatttgaagcatttgattagaatgtatacatatctaaaacattcattttttaattttcataaattagaaaatatcaaacttcagtataattaaattaatattttaaccattcagctaataaaattttctgtggtttgggaaggaagaatgatagcttaaattaattccctttgttattttgagattttttgttcatttgggactatagataaaagaagataatgttctcttcctttaaagcttggattgaagggtgtatcttacatgtattataaacaatataaaatattctgataatgacattgtttaattatgagtgtttgacatagaaagcaatgatctctgacactttttattttttcagaataaattgaaaatatattacctggctacctaaccaggtgccaccatgttaagcaattttattatagtttcagagaaaagctagcctatgtaaagcatgttctttgaagatacaagtctaacacattgacacatatatcatacacccacacctaccaatagaaaacaacaacaacacaacaacctcattaaaattaatgaggcaaatggtgctatttttgatgggacactaatgagagaatcttttttttttaaccaaatagaatcttattaatttatgtcagaaacagaagtggagacacagtcatattagaagtgttaattccgcaagggaatatctccaatggtcctttaactgggcttaaccacttatttaatcaaacttatttagcttcatgttaacgttacatgatttaagatcattcctatatcatagtataagctctctgaaaaaatgttattattcacctatatacccccagtacaaagaataatacagtcatgcactgcataacaatgttttgatcaatgacagctcatatatgtggtggcagttccgtaggaatataatacagtatttttaccataccatttctatgcttaaatatattgagatacacaaatacttaccattatgctacaattgcctgtagtgttcagtacagtaatatgctagactagtttatagcctacaagcaataggctataccatgtagcctaagtgtgtggtaggctataccatctaggtttgtgtaagtgtacactctatgatattcccacaatgacaaaattgtgtaatggtgcatttctcagaatgtatccctgtcattaagtgatgtgtgactgtactttgaatgctgtaggagcaccctttcttcccctattctaaaataaaaatatattttgtttcacttttatagtttttgaatgtaaaaaaaattaaataaaactgagatgttgatcttttaaattgaaccaaaaatctttctgaaaccagtgttggtacacatcattttgaagggtactatataaataaataaaaataaaatcaaattttaattaaattttattataccaacatattaaaagtaatggtgaattccattataaaatggtatattccttgtaatgtgaacatctgttatttgtcttgatgacaaataagatgtcatcatcacatcacatgaagatccatgtgatgtttcatcaactactgatgtggacacatgtgcatagtaacaaattcatctttgagatgaatgtaaaaaatgtgcttaatatgcttattaattgacaccaggctacgtgattgtctatcacaatacacccacttttatgtcagcattttctcatatttgagatagaatacctatagtctatcctggaggggaagaaagcatgcaaaaatgcatgaacattcattctgcaaatacttagttgagcgcctactttgcatcacagagtggtatacatatgtgtcgagcattaagatatgtactgagaaatagcagttaacatacagaaaaggactctgctcccatggagtttatatcctaatttaatgagactggaaatgggcagaaaaataaaatatgtagtgtatatgtgttgctatgacaacaagaaaattaaaacagagagcagatactggaaatttaaatagggtggccagagaaggcctcagaaaggtgacatttgagtaaaatctgaaggaggtgaaggttttttttttttttttgaaaaagtatagttaggttttgttgatgacagggatttatatgatcatgatagcttcaatcagagtaaaataaaaaacgaaaatatcgtaggaggccaggcgtgatggctcacgcctgtaatctcagcactttggaaggccaaggcagacggatcacctgaggtcaggagttcacgaaccagcctgaccaacatggaaaaaccctgtctttattaaaaatataaaaattagcagggcatgacggcaggcacctgtgatcccagctactcgggagactgaggcaggaaaatcacttgaacctcagaagcaggggctgcagtgggccaagatcatgccactgcactccagcctgggcgacagagcgagactatctcaaaaaaacaaaagaagaaagaaaatatagtaggaaagggtacattaagatacttataaaactatatattttaaagaccatagcaggattcatattttaggaaccatggcctttagttctgtatttaataaatttaacagaaaattattctctaaatataagcatttaaagtaatcattaacttgctgtttggagatatgcacattaatcaattacttttctatcaaaacaaacaaagtttacatcattgtgacatggactttgcttccgttaacttctctattatagttaccatattgattactagttatttgtgtgttttgttattattctatagctttattgaatataaggaccctatgtgttcatctttttcttgtgtacaaaagcagagtaacgcatggcactcagtaataacttttgaataaattgattcattcattcaataaataagtattgacatactactgttttaagaactggagatacattggtaactaaaacagaaaaaatatctggattcatgaagtctacatgttagtggaaaaagtcaataaatcaaataagcaaaaatacatgtcaattaaaatctattataagaaaaatcgagaaagtaatagcaagtagtgagaaagtatatactctcttaccttttatacctcccagaggcagtgatattgaagatgaatcagaaagagagggaataatttgagtcaaggggattcctgaaagaggaaaccagaagtccaaaagctcaggtcttgctcaaaggcacagagcaagaggctgaggtttgagaggagaggggtcaatatgataggcaaatggtcaggtcacataaacctgtaaactgtgatcgagtgtttcaatttgaaccagtagtgtgtttgggccagagaagtgacatgattctgtttatatcttttaatgattgctctgtcagcttggtaatgaaattgagtgtaaagggttaggaacggaggcaggtggaacagttcggaagctctatgtcgtgtttttaagaggtggtccctgtgttgatctagagtagtagaaacaagggtgattaagaacaaaacggaaatggattaaatataatagtacgaagggaagcgtcattgaaaatatctggttggacttttcaaatacatgatttcttgtaaatgtattgatatatataatggtgatatttgaattgtatcactatttggtagcttttaacaaaaatttcagctatcaaagtgaaatatttatcagaatcaacctcaaattgttattgaggatgagtgctatcttttcacaggtttcttgtgaaaattacttttaattgtagtattaactggtaatttattattgcttctttaaattaaaaatcacctttttggggagttcttctaagaatttcttggtctttagtttttgtatttacttatggtatagctaggacggattttttaaaaatttatttatcctggttgaggtttgtagtgatttttgaatctgtggcttaatgtgtttcagcagctttgaaaagttctcagccattaggtttaaatacagcttctcctctctctcctcttttactgagaccccagttatacatctcaaaaccttttcttatatcttatgctgttttcacaattttccattcttttgtttctctgtgctccaggtatgcatgttttattctgacctattcagtttatttttctatgtttaatctactatcaaatttctcttaatttcaactattttcaggtctaaatttttattttattggttatttccaattagctgccaaaacttttcatcttacttatattttgaaaatattgtatctatatctggatcatctagatttattatggatccaatttcatcaaattctctatttgttgtcaattgtttattaaaaatctttttgaatcaagtgtaagacattacatattaaaaagtacagagataatttaagaatctggaggatgatattttattccagaaagaatgtgtttcttttccattttttgcaggccctttaggttaggagcagatcaccttaatccgagtagagatgatgtttattcaataccgggtttctgcctttgtgagggatggtatatttctggtttgctcttctgtttaaggcatagtccttcaggatcccaactgaatgcctcagggcccctttaccttggtagaatataaacggcaattttgtttctcaagccctgtgaggctgccatcaactctgataagcttctcagcctatcacctatagcttttaattaatttttattgattgattcagacagtcaatcaataacagctgtaataatagctcaccgtaatcttgtgaactctttcacttaagtgatcctcccacctgaacctcttgaataggttggactacagctgtaagccaccacaaccaactaatttattttttatgttttgtaaagatggggtcttactatgttgcccaggctgattctgaactcctgggctcaagcgatcctcccaccttgacctcccaaagtgttggtattacaggcatgagccacttcaaccagcgtactcatagcttttcaatgcagaatgcctcaggagaagaagcaagaccaaactgtgagctcatctgtccaggattccattctcttcaaaatcttggctcacatgttttctatgtgttgttagctcttgagtgccctagatggaaggtaggtagttgtgtgtgtgtgtgtgtgtgtgtgtgtgtgtgtgtgtgtgcgcgctctctggcagaaagttaatctgaagctagtcagccattgcctgaaacgttttgcttgatggaaaaaaatgacagaatacaaaatatttttagaggactattaatcaccttattgcatatatttaggaaacaaaaaatatatatgtatatgtatacttatatatgtaattaaatatttaaaaggtataaaaatcaaaataaccccaaagaaaatgtactaaaaaatttaataaagataaaagccaaaaacgaaatgatgaggcagcaaactaaaaatgaagcagatttgatcaataaaactgaaaagctgttcccttaaaaagaaacagtagtaacattgaaaatatttgacaattatagccaaaaagagcgaaaagaaattatactggagataagaaaatggctacaagtaagaaatgtcttacaaaaagtatttgcataaaactccattaataactcagaaaacatagataatattaattatttttaggaaaatttaagcctagaaaattaactcaagaaattgaaattttctcaatagaaaaaatttgaaaaataataaaatatctgtacctgaaagagcataaggaacattttttatagatgcatattaccaaaccttcaaagaccaagcactctccatgttatataaggtcttacacgtagaaatatgaaaaacaggcagggcatggtggctcacatctctaatcccaacactttggatggcgaaggcaggtggatcacttgaggtcaggagtttgagaccagcttggctaacatggtaaaaccctgtctcttgtaaaatacaaaagttagccgggcgtggtggcgcatgcctataatcccattacttgagaggctgaggcagaaccgctagaacctgggaggcagaggttgcagtgagtcaagatcacaccactgcactccagcccgggcaacagagcaagactctgtctcaagaaaaaagaaatatggaaaacatcccaatttatttatgagaattgaataaccagaaaacaaaatcaagcaaggatagcaccaaaaaggaaactaactgcaggctgatcatgatgatggtaggatttcaaaatacaatattagtaaccaaatcttgttgaccaagtgaaatacttatattcagagtgcaagtatctctaacaggatgaaatttgttttggtatatcctaactaagacacaataaagaagaaaaatcaagtgatcatctcattcattgtttaggaaaaaaaattgataaaattgaatacctgattttagagaatagtggaccacaatagaaatagattatcataggaaaaaatgacttatgtaaacaaattttaaaaccataaaatttaaaacctctttgtgactaaagatactacaaagaacataaaaaaaggattggcagatgaaaaaaatatatttgcaaggagggaaaatataagacagcacctcgaaatgcataagaaatatgccaatagataactaaaaaaaatttaaaggcaaataattaaaattttgaataagcttatagaaaaaaaagtttaactttactaagagtcagggaattgcagcctaaattgggacaccattctcacctatcatgttgataaatattaaaaagtaaaaagattaatcatgttccgttttaaaagaatgctggtgaaaggcattcttattcaagatgatgtctaggtgaaaggcaaagttatagcagcacaatttgtaattgcaaaaatgtggaaccaaaccaaatgcccattaatcaacgagtgggtaaagaaactgtggtatatatatacaatggaatactactaagccataaaaatgaatgaattaatggcatttgcagcaacctggatgagattggagactattattccaagtgaagtaactcccgaatggaaaaccagacatcgtatgttctcactcataagtgggagctaagatatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatggaaataataattaaaaaaaaaaaaacctagatgatggattgttagttgcagcaaaccaccgtgacacatgtttacctatgtaacaaacatgcacatccttcacatgtaccctggaacttaaaataatttttaaaaaaacaaaaacaaagggtgaagttacttggtctcgtggcatataaaataatagtctgtattctccaagtctttcatttattctttcaataaatagcactttctctttgccaaactgaattaaaggtcctggggaccctgcaagccataaagaggcaaaattagagtttctgtcctcatagagtttgccttctaaggagaatccttgctggtttcactcgattgcagttggtctggtctccccgttgttctttgtcctctgttactctgtcatgcttgcctggattttgttgttgttgtcaatttgctttggtttgttttctagctggtatcaagctgctcccactgccaaagttggtaagccctttcttttgttttacttctgaggtcccttctttctccagcctcttggtcctgacctcaggttggagcttttagtgcatctgtaattgttctcacgggcacagcaacgcaaacacagtaacacaagccatttacagactgtcttagtcctaggcatagaccctgcctctgcccttgcttccctgcctgccacttcccccaccacccccccacccccacgcccccacgcccccacgcccccaacaccactccaccagaagcttaggatcaggcaacagatttctctcagcatactgtctcacctctaacccctcttgggatgggggtcaggactaccaattcgcttttcagggattctggcaggcgttttcactctaatagggattctgcgaagtctctgtggttgaggtgctcctttccttttttgcttcttagaagttgccattgaggtgaaaacttctttgaaaaagttggtctaagaggtattggagaatgtagtgcctgagtaagcagaaagattcaacctgggtctcggggggtcttaagtcaggtctctttatccccttctacataggatttaattgctgcagcctacaataatatgctcattacttgtcacattttctaattgcattttgtaatttatctgtgcctgatgatcacacctgtgcattatggagatataccacacatgcttatgcataggtgtgaacggttacacatactttcttctttctcctgccattcttttgaagagtttctcttatttcacaaaatgcactaggagaagagcatctgggggaagtaaaatgagaggggtggtttcagatacaccttgttctgtacttgtctgtacttaatatggataattagatactctttactaggtactttgccacagggttttcatggattgcatttaattgttgccacattcttatgcagtggctaccctttttaatctctacaggtgagacagaagcaccaagtagtgaaatgacttgtgcaggactgagcttgtgaatgacgggcacagatatgaccaaagtggtatctgccaagcccatatgtttcaacttgagcgatactgtctcttgctgttctgctacttttatgttctgcttctgcactcaaagttataggctttcattttgttagacattataaagatgtaaaagaaatttaagccatagtccaaaaattgagaatgccatatgatatatccaaatgtcataatattacatgactactaaaaagattgtttatgaagagtttatagtaacttgagaaaccaatttttggataaaggtaaaaacctggatccacaattggatgaaagtttctgcaactgctgatggagtagggtttcacctgccatcatctgtagaacaagaaactcaaactaataggaatagtatattttgggtacaataatactattttttattgtcagaaaatttgcatggctttggattagtaccctagtagcacctgttagcttagagtcaattgcagagactgtgtcctgtgagaaacacatgctacaggcccaacaacaggaagaggataaagggatagtggcctcactggagtcatcaggacagccccgtggtaaatgatgtgatagaaaaattctccccatctacttgtgctgagcctttcctttcttggagttgtagtttctcttttgctgagacacctgttgtcctcaagttcttctccaggcctctctcaaaattccatttcaaatacctaaggctaagtgtaaatattcaaatgaaactgtcaaaatttactaagagatataaataaaaccttgcaatagtgagacatactttcttttctgaggtggaagtcttactagttttaaattttttgttcgtcccaaattaatatagatataatatacaatcttatcaaattcccaataggatcttctggaggaagagaagaaatatttaaagttcacataaaagatttagggtccttcagatgatttctaagaattaaaatataaattggaaaaattacaaagaagtaatacctaaagcttacaatggaaaaattaaaaataacacatttatatgtaaataaggttgtcccatgaacaatgtggatttgaattgcaggggcccattaatatgagaggggtttttttcccaataaatacaggggtctctctgtatctgatgtttccacatctgcaaccaagagtgcagagggaaagagcagtattcacagaatatgaaacacctgatattgatggctgacttcttgtatcgaagatttgctttgggctaatggtgggactcaagtatgtgcaaattgtggtattcacagcagccctggaatcaagctcctttgaataccaagaaacaaaaataatttcattaaaagtgccattcaaaataaattggggaaaatttatgtggtaattgtcaccaaaatttaataaacttccttaaaactgcattccaatcttaaaaatactaaaacttaaaaatgtgtaagcacattagtaagaaattctaagaaaaaaaaaccacaaatgcctaattataaaagaaatgcaagcctaagaaaaaaggagtttcttataaaattcacaaagtatataatgtgttacttcagagaaaatatgaattgaaatgggcttatgctttaaattttggtgagataatacaacttggaacaaactttctagaaaatgattagtaatgcatttcagcagcctttcaaaattcttttatttgacctagtaattctatttctaacaatctcttctaagaaaaacaaatcagaaatcttaacaaaaagtcatgcttatgcagcgtgggtttatttaactaaattgtggaaaaataggaagacacttcaatttattaaagtaaatctctataacaaaatgttaggaagtcattaaacagatgctttcaaagaataatgccatggaaaagccttcatgatatgttaaaaaaaataataagatacgatattgtatatttaatttgacctatgtatgacctatatatatatatacaaacacatatatatgtatataaacataacatatgtattaaagagtctgaaggaaaatacattaaatactaagagggatattttgagtactatgattagaagtgtttttagtttttatacatttctggttttgcatattttaagtcttcgagtatgcatttatattcagaaatagtttgctttaatatattttcctaagaaaagtaacagcaatatctaaacaaaacagcaatatcattgaaaatgtatagaaaaatatcatcctttcacttaattgttttaaaggcttcatctaaaggaataacttaattaaaattccagaccttagacggcaggtttagggaattagtttgtcatccaaagaggcttcttaaggctcccagaatcacactacatggcaattgacagtactgccgatataagttttaaggtcaggtcaggatacggttactgaagtctcacttacggacaatgtggggaaatgcagttcaccaatacataggcatttacccaagtttctcaaatgtagtggcagttttagaacacagcaatgataatgggctaggtggaggagactcaatttactcatttttttgagcctgcaaattttggaaaataatgacatggggaaagaaagggatgaacagaagatggaaaaagaaaagagagcaatcttagagcagcaagcaccttgaattgtagtcttgaaggcagcacagaagaattgagatagctgggggaattgtattgtgtatctgaagtacaccagctctgtttcataggccttgtgccatcacatcatctgggttacattacaaaaacactctactcctcacatagcataagtctctggtaattttggtgcaggaaggatgagtaatttttactatatttaattatcattgtggtaagtgttctctgaaagccttgatgtagctgaagcctctgcggtaatttaccaagaagtctttggagtccgcttagaatcttgccatcctgggcccttcgatgaccctgactttttgtgattttgcttaagatatcctatcaggtatctgcctgatgtcatgggagcataaaggcatgtgttgatggcaagaagaccatggagtcttattctctgataatgtttattccacatctgtgatttgtgtcctacaaggctcttgggacttaaaccacatgtgctatatttgcattaatgggaatttaagaaggagaggccataacactattaaaatgtttagctttcgctcccatcacacagacacatgctagtaactactcccagatcttgtatcatggtgctgcaggatgcaacgtggagtgcactcattgtttcaatacaagggacttgaaaacaaatagctgccatctctgtctctgatagtttgccaggcttttaacttctttggtttttccctctccagatcatggtgaggtatctcagatgtattccaaacagcacattgccccatctttgtttcttcttttataaaggaactcttgctttaaggtatatttagaaaacctagagtctaagccaaattctgaagaaccacatgataattctactttcaaatggcaggaaaggacttagtgcagaatcacccacacagggttattgatcacccaggcctaatagtcacaaacgtgacaaatatgctggaagtttttcctaggtttaaatatccaactgttaaattacatatgaagatattttgaagcatcttataaacagagaggcagggagggtgcagggtgggaagagaaaagaaggggaagggaaggagggacaaagggactgggagagaaagagggaggaaaagagaaagagagcacatcaaggaacagggcatgaagatcacatcttcattactccctaggccagagtttttcaaattgcaaattctgtgatcctttagtgggtcacagaatcaatttagtgagttgggaccagcatttttaaatgaaatcaattaaagaaaaaaagaaaccaggatagaagatatattacatcacatatagtaaagggaggtattattaaataaaacttttgtttcaattatatgatatatatacatatataaatgaacatatgcacatggtgtatatatatatatatatatatatatatatatatatgtgtgtgtttcattattatacattgaataatagatgaatttatgtgtagaaagatacctagatgacagaaagagagagagtgtgagagaaagagaaagggggggagagagagcaagaaagaggtactgattggcaatgattacttcttaacatgtttcatgaacaaaaatgtttgaaagccatcaccagattatacctccaggacagtggcttctttaaatttggaatacgttcttcccttagtgcctcctccacctgcattcaggtaaattaacaagctgcatataagtctcatctaattaagccacaaacttttaaagaaaatgttgtggatgaaactcagtgaaatatgaatccaatgctgtgagcctcaagggtagcagattacaaacccaatactggttctcatgatagaaaaatgtcctccttaatgtcctactccccaggatactagagaatgataaatggcacaatagttgatagtaagcctcagaaattgagggagaaacttactatactgatgatctttagatatcatttattcagggattgggattattgtttgagatcatgaaaaaacaagttaatggcaatggaaccatcttgatgaagcaggcaaaaaactatagttgggacaactactatggaaaagtttgagctgataatattggaaggaagtgtgtcttctggacagaatacagaacccaaaaagtaagataacaaaattcagttcaggctgttagggtgtgagttccaaccagaaataacaaggatattttaaagaccattggatgattgctgaatacactgacatgactcattttcagatattcttataactatggtgccttgaacgcaagtatggattatttcttgattacatgtgtaacaattcagatgggtgaggcagatggaaggtggatttaaagaactcagtgaggtgcaatgaggatcagggagatgctctgcagagccccagttcctaaaagggggcctggcaaaaggacactaccagccgagagagtctggtatgtgagataaaccaccagaatagggaaccacaagccggaagcaagaagaggatacagctacagaaatgagctttggcaaagacaggatatccaagactgtgcattctcaactctcaaggcctgagatcacgtcaagtcactttgggttatagcaaaggtctttattcaaataccaagcatctcaaggtggagcatctaacattgaaagcagagaagcatctgttgagttgtgtaaaagaggaaaagatcaggaaccagaaagagctggagaaaccccaggggcccatggaagaggtattcttcttaccaagatggtgtatcatcttttcagatagatgcattgatacaaccttagaaggcagtggtatgttgacagttatggaagttgcaatatagagccagctttaagaggatgtcttccccactgtgacactgtggaatagctcactaatacaggttctcagtgactaatcattgctttcctctttactagtataccaaataaaatctgttttctacatttcataagcctttcattatgtggataccaaaaccctttagtattaacctaagccaattgagctatcattcattctatacccctttattgagagctggtgctattccagatacttggctgaatgcagggacatgtggttttgtggtcagggagcttaatgtgtagaaaggtcaagacactggatgtgtacagtagtgagatgcacaccattatgaagttagtacaaactgctggagggatacctcttttttgacctctagatgttataaaggactttccggaataggcagtgtctgagtagtttcctgaatgaagaggtggagtttgcaaagtccaggagacaatcaatgaatcagtcaataagtgaaatcaaataataacataatattttaagtgctaagtatgtaccaggtattatgttaagttcttctcctggattgtattttatgtagcccttataatggtcctatgatgtaggtattattgtttttctcaggttataggtgagaatatagaaacacaaaaattttaaataaattgttcaaagttatgcagttaataagtagaggaattgaaaaggttagagacagagaaattatgaaatgttttgcaacatacattaaataattgaggttttatccttgggataaaaggaatccattcagtggcttttaagtggcatgtgacagatatggatttaggtagatcatctttctatggtctagagcagcagactccaatacagcataattttcaaatcactcgtggagctctgtaaacagacagactactaggccctatctccagggtctgattcttttaggtcctagtgaatgtgagaatcagacttacaaagatctccaaggacaaagttgatgtcagtcaacttaggagtttactgatgagtggatgtaaagaatggattgtaactataccatctgtcattaaggaggtcagaccagaagtcacattggtccgaattgcaatagagttacacattagggatctattagttttacaaatctaattttttttaaaaaaatgagaaatggtaatataattctggagcgtgtctgtaagggagaagaatcatgtcttacaggaaaatgtttggtaacaccaccatttaagggatgagtgaagggaaaagattccacagagagggcatagggacagcttcttcatgtcctttagagatgctgtatactttccttcctctgaatctttgtacaagcttttcctttcacctgtgttgtcctcttaccctgccttttcttctactaaatctcatccatccttttaggatccttctccaacattcatccctgggtcctccattataccctcaaggaaagtttgatttctttcattgaaaaccattatgtgtcccatcttgaatccttatgtaattgttgtttctaatgttttcacatgctggtcttttctcacactagattagaagcttcttaagaggaagggtcactgctaacttttttgtatacctcacagttcttagaattggaccaatgacaggtattcactaggcacctaaatggttattaaatgactctcagtattgtgtgtgttggctagtgatccatatgtcccagagacacaaaataggcctggtttataccagttgtcctggtgtgttattaacagtgccttttgccttcagcattatcatagtttcaacaataaattatatagtcaccctactgatagtgctaccaatacattttttaaaagtctagcatctttaagtggtaacatttcaatacaaatgtcattttgttttggggagtaaggagtgttaagatatttttgcacacatttggcatggagtgatatgtcattccagatgtctccttattaggtgggtggcctgttgctcaattgacagatgtcattgtctattatagagtcacaggtggtttattttaataaaaataccattaaattatctctatttttctgttgtgctctctttatatatagagagaaatagaacacatatgtacacatgtactatattacatattatatataactttatagtatgtatgtacatatatgatacgtatcactacatcatatgtcactatatgtgatatacctatatatcatatatagtgatatatatatgaacatattacatgtacatatgtactatatgttttgtaaaccactaactatagttttagaaatgtcagatgctttttcatgtttggtttaaagataacccttttgagtaaacagttaggaatgttctccaaacagcagaattacaatttttccacattctcagaagaaaattttcaacattttcaatttatttaagcctctcattcatggaaaaagaagcattactactcattcatgaacatcttaattacatagatagttagtttcattcctaatgaatgatcatgctctttcatggagagcaaaatctagattgtcaagctcttggttaaacacaatttcaaaattatgagacaccaaaagtaagtttgtagtattacacttacttcttgaattatgcagtttggattctataaaaaagaattcactggttaatttccaaatctccacctaatatttgttcctctccccaaagtatataacttgacagcagagaaggaaatagataccgttctttcttgtgagccacacactctgcaagggccattcctagttctgctatttcccaggacagagtatcaggaatcatgtgggaatagttcatatgtgtgtgtgcctgggctaatctgtgtttactagtgtagtacagaggggcactgtttatgtctgagaaaatagttataaatcacacttcttctgatcacaaatactcatttatctttagactatatcaccacctgagttatttttatgtaaatattgcacctcttaaatataatgatgataatagaggctgtgaatccttagatttgctcaagtgttccctttttcaataactgaaaatatttaaatcccagaagctttagcatcctaagagaagtagcagacagatgtgtcaatagagtgagacctacagaagttgtgagtaatgaataagtcagagtcatgggcttctgtaagggaactgcggtgcatttcctaggttggtatgttctggctatgctgcgaaccgtagcccagaaatgactgactcagagagagtcctcagctgctttgctcctttcagctctgtcatcacatagaaaggtctctttggcaaagtgtcggaaacaacacaaggtgggcaagcatctgcagatttcctcactcagtcagaagaccagctagagtcatccagcttctggaaatcagtaaagagaccaactttgggtagcgagtccccaagatcacagagaatctatgttgtggtggcatcaccattccttatttgttggcatccttgtctggaaactgcctcatttggctataatttaacttgaagattaaagcacagattttcatatgtatcttctgttctctgaatgtaaaattatgaaatacacctacattcacttctaagtggcagtattgtaattgagcagatttttgtttttcactgaaacctggagttgaattgtcttgagccggaaggcattcaagttgctgttttttacttagctatatttctctataagcatctaattgtttcaaaaagtgaggtaaagtatgtgaaaacctgaatctaatgcaaataagtctgtacagcactaaagctaacaggtgttctcattaatgtaagcagacatggaacaattcttgaatgttttataaacactcataatcatggccaaatatgttacaatagcataaagatacatactgtaacatcttttattcttgttgtacactctcagtacttattaataggagactagtggcaacaatacctacttctgcttaagtcactgtatcataaagttagctaatacttctaaataaaattaacaacgtaactactacctcctcccacagtttgcttatttattaatattaacagtgttcttgtaaaattgctacaatgctgatggacagcaatgagcatctttgcatcactgagtttctctaaagacttgacccattaacctaagtattagctctttaaaattttgaacttatgttccagttcccatactgtcaactcccaattaccaaagcctatatttagggtgagattcttagatgatctagtatagatgatccctgtaaaatacttgggtggctttggaatataatcaagaacgttctattttagagatatgcattgaaatatgactcttgtgcttcccagcccttccaagtttaatcctattgtctgatgtctaggacttgctgactgctgggaaaatatagccttcagactgccattatcaatcttcaaaatagtttgcctactctactcttatgaagtgttttcagtagacgtcagtattacattacttatattacctgaaagaatgcaattgtattgcagccttcaaaattttatgacaatagagaatgagttaaatatattatggcatatcaaacaatgcaatataatgcattcaccaaaatgaataaagtagataaggtttgtctattgattattttcttagtgttccttatgtgtctgttgttcagccatgcatgtagacaattgtcattggcctcaggattattatagcatagtggggggaatggaaagaccaacaaggcattgcaacataaaccagtttgtgctaagataaaggagaagcaggatgttatgagcgcacttgggggaatatctatttcaaagaagcctttactgaaaaggtgacatctcaaatgatttgaatgatatgacagaggatgtcaaaggggtctaggcagcaggaacaacctgctctaaagtatgggacagctggggaaccaaaaaaatcagtatggctggattgtggaaatgcagaggaaaatgtggagcagcggaagtgcagagtgggtcagtgccagagcacacaggggctggcatgccaaattaaagagtttgcactgcactgcaacagctgtggggagcctcagaatgatatcaagcagaagaatgggatgatcatatccaagtttcagagggatcactttggctgcaatatatagtatggacttgaaggaaaaacatggatgagacagtgaggaaagcaaaggatattatgactaaattctcatgagagatgatggtagtatatatagtaaaaggcacaaaaattttcataataatatacatgatattttcattaaactgtaaacatacataatgtttcctcgtgggtcaaaaaggtatgtagaaagagacaacaagtcagtgtatcttgaaggaagggagattctatgtttgttaatttgaatttattaaaacttttaaaattgagcattacctacataaggacagtaataataaaaataataccaatttgaaaacaatgggggcagcagattcccaagtgtcatgtgactgtgactaaatgagtaattgaacacagtgaatatagctcaggcaagaaggtgatctgtggttggcagggagtgactggtgacaaatcccaggatgattcatttatctacagacaagtacacccccccagtttaaaaattaagagcaataaaagtctaagttgatatctttatacaccaactgctttgattagtctctttttgagtcgtttttcatatgagcaccacaggcaaaagttttggtgtggctgctgcaaaactgtggaaattgctaaactatctactaattacttggatagtattctttcatgaatattgagaagactgtttctcagtacttaaaatattttaacacaataaaaagaatgaacatgagggttttttttttttttttgcttgtttgaaataaattttgggtttagatatttgttaataaacagaaagttagagtgggcaagtaatatggggtgtgaatgttcactacagggacaattttattatgcagaacaaatctctgttgtacgaatgcatggacaaaattatttgggtgtcaaagtacagctcaatttcacttaaaaagcattgtttcttgaaaggttggccttaaaccttagattttggaatgtactggaggtctgtcatgtacgtaacccgacattgtttactttccattaaataagaaattgcttacatgggcaggttattttgatatgatgacaccactgagggttccaataaatgtacatgcaaatcaatcaaccccaaacacattgaaaacatatccaataagcgtctggaaactaatgaacgcacatttgttaacatagggggagttgtggaaatgctgagatccattggtggcctggcttatttagtagcatgtggatttaggaacatttcacggagtcagaagaaacagagtaattataacataaggttcaacatctttagatatgtagaacattttccgttgcttaaaacaaatattccctaagaaagtataaaacatttttctgacttgcaaagtttttgcagtctatcatttaaattacttaaataaagggagctttactgctccccaaagctgagaatataacaccctccatgcatattagcttgatcttcttgacagaccagaaaagtgtttgtgtgtgccaattaaaacaaaaatggatccctagtggcttgttcctcatacaacttttgaagactgctatcattgtttgctagggtaaccctggataaggctgctatccaaagtaaacaaacttttcaaaactttcatgacagatggggattacaaatgcattttaataagagagttgccaaagtaacttttttttttttttttgtaatcagcatatatttacttaacatctagcaacattgggaacacaaggcagatactttctcacaaaatgctttaacaagtaacatttttggaaaggcaaattgaagaccttttacatctaactgatattttacccttagttttattttaactttgctcaacatgttaagagaaatgttaggaattactcaaaccagactgtaatttgagacagacattcagcctgatagtgtaatttctttggtggtcataaacacctttgagaccaagtaatttagctattagtataaccatgacaaccttcatttgatcagctatatgtggagtgatgcaagatgaaaaaaatgtgaatctgtgtgggttttgtaagcattattacttcgattttaggtcttgatatctccctatcatgtgtatattttctgctgggagtactgaatacagatatggacaaaattactatcacaaaaataattcatattcacttcaaataaagttagtgtatgttgatataactttttatttttacttaatttaactcaaatataaaaattatatcatgaagtccaaagtctctctaaacataatagcaattaaattccattcctcttatttatgtctctctagaaccactgtagccatattatttaacatgttttagggctctttggatatttggcatattttattatgcatttcctgcatactatttcagtttcactaaaatggaataatccctccttaggttctaatcaaaatgcgaaaggtatttgttcaagtgtaggattgctttagtcctttctaggatttgaaggagttgtagataacccaattcagtcttagatatattttttcatagcaagagagtgcttgtttttggaaagaaaaatcagagctaggattttgcatgatcttttaaaatcgggctatctttagcctaactgcaaggaaagaagcaactttgtctaaagttgctattccaaatttcataactgaaaccaaattatcacggcccttttcctgttcaaacacacagtccttgactgtatacaactgtttgctgagaactagtgaactagaaatcaagatctttgtaatctcttaattctatcatttaaaatgatgccaatttgatagaatggcattctcattttcctcatttgcttcattttcttcatttgcaaaattactttatgatagtggaggaaagctgcatttggagaatgtttattatgtgctttgagatcattaaagctgatatcactttgcataccaagtggtggtattcatatccttaatatactgaagttctgatacaatcaacgtttaaagaataacgtatcatgaccaccagtttatgcatactttcatgatgtaaatgtgcctgcagtaactactccttcctctgaaatcttgacatgagcattgtgtgtgctgctcacattgggactcagtatgagccattttctattgttatttatctgtatatgcatatgtcctatttatccaaacagattgtgagttcttgagggtgggggctgtgtatccctagcttctagcaatgtgccttgtacttaatggatgcttaatcagtcattgttaatgattagtaggatgttctgtcatgaacgcatcctctctattcttctgtacatgaaattatttgtgggatttattctgcaatcagaagggtggggctctcaaacagggtagcaccatgtcactcattatctcttacatctttggtaatctccccatgtgcatctgaagtcagttggaagctggtaatattttaccatcaaatatgttttgctgatgaggtgtatctatctataacattgatcattatttctgtttggttattatttataaaagattggcaataatgaaattaaaatacctacaatgtttactttgtgtagctatgcataattttgattctttatctttatttttcccaaattctacacaatgaagtattattcttagaaaaaagaagttctaaaaaaggttttgtttatattctagtaaacaaaagtatggaaatttataatggtataaatgccattctacacattaatttctcatttaaattaaaaaatctaatagcataaaatcttactgccagaatgaatattgatgagagtgttacttaattgacaatatttaaaagaacaatacttaaatcaacataaacactacttcttaaaactcttttaagatgttttaaattagcatagtaaagctccatttaattaaaatctaaaacgcaaatttcttcgctcttcatcagtgaagtctggacttgcatctacctgcctccatattaagaggaaccgtaccaaggacacagactattctaagcccacgtgaaaactattgttgaattaattcccaaaagccttaaggaatgtgcccactctgcatgttgctcagtggacacgcttctataatttcctgggcataaatttcttaccagcaagaattcagatggacccttatttagtatgaaaaagttcaagacaaatttccccagatggatacttaaagatatgcattattgacactgcacacttcattaaggttactttggtgccctgatatattccttcaaaatacgacctggtgtggtaatgagggatttcaagaaacatttgcctaaattaggtttctaagcaagatggagaccagcagctcttatctaaacctgttatgttgtctataagttcttccttcatccccttaccccagcatctgtcacggaggcaaaacatatagaaagagtacattagcacggcttaatatcaaagcctttatgtctgttatacatcattttagattgtcatcataagttgttcaatcaaaagatttagtcagagctaacattctttactgatgtcttttttccccaagagtgttggaaattcgattgttcaaagtgcaaatatgattcagcaaaccatttatcagaaatcctaaagaggtaaaataaaaaagcgggttgaggaacctgaattaaatgggctttaccagtcaaagattttgaaactactttcctgtgagtgactggaatagagcagaacaaagtcaattactgactgtaattaagaagtggatgcatttaaactgtagagagcagtagcagacttctccagactgcctggtaactcgaaagattagtgggaagacagaggaaaggatgtgaactgcatctctctgatagtatgttttgaatgaattgcattcatatagctctctgatctagcttctcaaaatgaattcgtaaatcactgattatgtatgattaatgcagtaatatatttggacaaaggaacttttaaaatacattttgcttttggttgtgttagcaatataagatcccctttgcattgcatagcatgcaccaaaaatgcaaacgcactgctaaagtacttatattttatcactgtttgaatttactagactgcaagctgaactatgttggctctttcgtaaaccctcataatatagcaaatctaattatgtttgtttctcgtacttcttaaatgtttctttttataattttaataatggtttatttatactggcagagaaacattacattgtacattgtgctttggctaattcatttgtctttgtgtatgttaacaaattatgatgttagaaatacattcataatcaaaatatttcactacagattaggatgaaggtagaggtctaggacattactagttttcttgtgttagaaatgaccttatatttttagattactatttcttaggcaacactctataaagtaaatatttggaactttatctgagtagagaacattgcaatggtgttcagataattaggcaaacatcacctgagctgtcttttactggatacataaaataggaggctgttttgagccatcctaaatcttatatgcagtttcattttaaaaagagagagaaagactgattggcctcagtaatctgtcaaattctagtgtgggcaattaaatctttttatttttaaatctttcacttcttataattgtatacactttagacagttcttctcacagttatagagacaacatttgatattggaacccatctcaatcaagaatggttactttgcagtactgattaatattgaatctctatagagtttttctaaaaacaaatgacaaatgaatatatatgcacatatgtaacagatttctttcaaaaccccaaaatcattgtcattaaatgttgccatgagaatccttgaaaccttcagaatgagccatttggggtagtaattgtcactttaatgatagaattatagagatggcctaaagcgtgatttgtgattttctgaacctgtgccacatttcagcgttcacctcctgtttagagcaaggaaggctgagaagaggtgactggctcctgattgagtattttgaaatgtcagtcctctaaacccctgaactctgtgtgacagtagttgggaaatgttcatcttccagttgcaaggaaaagtcaataatacaaagggaaaatcttcacagttcagattgatggccaaatacaaaaagcatgtccacacccactctaatcaattttttctctaagttgcccgttatgtgtgaaactaagagtattgctctgtttctgtagggtcgtatccttttctcacaagtctggggagaaaaagattcactgtaatgaaaaatggacagttacacgctaaatattgccaactacttagcagtctgagagtcaggaacctgaatgttcatttgataaatactctcccagagaggttcaaatatgtaaatgaacttttattttaatatactccttttgtggggaaattggtttttttattactttcctatagatctctgataagaaagtagaaatagtcaaatgttattcatttcaatgaacttttggaagtctgcaattagtgtttttggtaaataaactgttttagagctctccataaaaggaaatcaaatatagagatactattagatttgaaaaagacagacaggaaagaggcaaacgtgcagaatgaattctgacacacccgggtgcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattggtatgtatttgttttggctgttacctttattaattaaaatgtagtcatttaaatcttattgctcaggcatataacacacacactcatttaaatagatcctatggactgagagggattaagttcttttagtttaaatagaatctactaaaaaccttttcagcagacaggatttgtagaactgtcgtttaatttctctctttcaaaaatatagtgcattctttctttttttctgaaataacatagacattcatttactggaggctgtaaaaagcacacaagcacttaataactactgatttttttttcattttcagtttatgcagtccatactacatactcctgtaaataaataacatatttaagactcactgttataataccaataaataaataataaccctttgtactgatttttattattcttccagctaagctagattgttcttcttatgaaaattacatatctagaacttcatgaaattatcctaaaacatacattcagagtatgttttctaagaatgaacttatttaaaaccactcattccatgctgagtctctagaacaaacatttaattttatgacactaatatttgcaaaattttgggaagaaatattcttaatacggaatacaacacaatagtaaaagattttctgtgtgattttcttgatacttaattgcaagctttcattataccattttgggattaacactttaaaaagtaaaataacaaatttactttttcctgttattagtatattccccttaaaggggtgtgtgtgtgaatgtgtgtgagtgcacatacatacatacacacagtttgttgccattgaggatggactctggaaccagactgctagagtttgaattctagttctatcatttgttacctgtgtggccttaggcaaattacttgcctattttggcctcattttcttaatgaggaaaataaggataataataataccacctactctatagaattgttgtaatgattaattgaactaatgcatgaatagtgcttagcatttagtaagtaccatcatatacatatataaactattattagagtattgagcttagcatagaggacctatcctcaaataattaccttacttcaaatttccccataaacagcaaaattgaacacaaaattctatggtgaatcctttctttctagtaaaattattcagtctaattatttgctgtttccagccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaattagatgttctccaaggtcacacctagttctaatattctaagaattaaatttagagtaaaaagaatggtctcactacttacacagtgatcttgagtatctttcttaaccattccccagactgcttcttcctcaatgaaaaggggttattaaaatatgcaacacatatctcactgagttggtttgagtctcaacctcctgaaagaaaaggtagacatctggctgggcgaggtagctcacgcctgtaatcccagcactttgggaggctgaggtgggtggatcacgaggtcaggagctcgagatcatcctggtcaacatggccaaactccatctctactaaaactacaaaaataagctgggcatggtggcacgtgcctgtaatcccagctactcaggaggttgaggcaggagaattgcttgaaccagagagtcagaggttgcagtgagctgaaatcataccacagcattccagcctggttggcaacaaagcaagactctgtctcagaaaaggtagacatctttggaaccagagaaaacctatttcccaaagtcttaaaaattatagtattttgggggagtcttctacctggctgaccccaatcttgcaaatcatcatttttttcctgctatttccctctgacaaaatatcagtatactgacatcctaaactttagaatttaaagagaactcagtaagttgagaagagctgctaatggaatatatgtgtacatatatacatatatacatacacatacacacgtatgtatgtatgctagatgattatttgtacgtgtacatatatgtgtgcattaagaaatatatgtatatacacatacatgcacacaaagactcatacacatatgatagggaagagagaagctatttatatgtgataacatatttgccaaagttgaattactgaagtctacaaatctagaaattgcatgagaatttaagagtagaagcacccttttgaaattaagtctttatgcaaaatcccatgccataattttcaacaactgctagacacatttacttagccagttgtgctaagttggagtttaagattatcagtgttaatgtctagaaaatgcatggtttatttgtggagagttaatgccatttcaaaagacttttccataatggtacagtttagaggtatttcatttaaagaatgttttcctttcatgcctgatcattgtcttcttttacttcatatggtttgagacataaggtaagatttcagaattgggattcagttgggagtatatatttagtgttaatcatatagacattctgtagtacatataaaagaatatgtgatgcaatgactagtaggtctggaatcttagatataattgctggttcagagaccttaagatgtttctaaaacctgagctatggagaaaataaaggtttgcaaaaatgtatttgagaaacattgaggataatgaattctctattaagtaacagtcactttaaaagtattaagatgctgctgaaaaaaaaatcttagatagaacactcactacttctctttagaatctatttttaattggaaaagacaattatttttctactttgagcttaaactcaatcctacttaaaaacaagggaggccaggagtagtggctcatgcctgtaatcccagcactttgggaggccaaggcgggtggatcacctgaggtcaggagttcaagaccatcctggccaacatggtgaaaccctgtctctactaaaaatacaaaaattagccgggcatggtggcgagcacctgtaatcccagctactcgggaggctgaggcacaagaattgcttcaacccgggaggcggaagttgcagtgagctaagatttcaccactgcactccagcctgggcgacagagcaagactctgtctcaaaaaaaaaaaaaaaaaaaaaaaaaagggaagagatacatgatttattctattcatttcaaaatctaactaattgtacagtgacttcatactcaccttttactttgaagttaaaaaaaaactagaaaatatgaaacatttactgtgcaccaggcactgttccaagtgcttgtcttatagcaatacatttaatcctctcaccaatcctatgaggtagatactattagttaccttattttatagaggagaaaactgaggcatgaagaactaaggtaatttgtacaaagacaagttatggagacatgtttcaaacccaagcagtcttattttagagcctgtacttttaatcattacattataacaaagtgaacaagtaaaaggtaaacttagtttatatcgaacttagacttggatagaaatattatgttaaaaataagattcatagaaatcagtaaacttgaatcaggacccaaaaacttattggcaaaaataattaaaactgggtgttttctttcaattttgatttcactattaaaataataatttaatctttaacactagctctaattttagaaaatgattcttttctgtatcttggtgagtatgtatagttgtaagcctttttttttagggccagtatgttttttgcaatgtaggacacagttaatatccatctattactttgaattaagttcattcaatatgtatgtattcattttcatttgaaaggcataatgattgacccacccacacaatatcaaattagaccatgcatttgaaatagtgattgacatgttttatatttgatgctttgtaaaatatattttttcaagtaggaaataccctgtgtgaaacccctctgatctcagtcctagatttgaacacccaaacttaggtttcttaaaacttgcattcgcttttatgtcaccctttggagattaaataattatatagaatcagagactcaacagtatcctcttccttattagtagtctaagcacaaactttattgtcggttttctgcctttggcttcctgtgcccttgatgttcccatgagttttgccgccaagattgtagacagataaagccagaattacttttttaaaaggcatgtgaacatcattagcagctaacaggtggtgatttcgttgtccagtttgtctatataacatgggaaaaatatgttctctcaatgagtgaattcagaaagttatgtttacatatacttttcttttaaaaaatatgattctaacctgccaacactattaagaacgaatcagatattttaagatatcagttgagtctaacagacaagaagccagaaaatttaatgcaagggccaaatcactgtgggaaactcaggacaccagcctgggatgagagtaggagagcagctctccagggagggctgttatggaaagtggagagtcaatcaaagaagatgtgaacatatttctctgaggaaagagaattgtcttccactgacagcaaagagggggaaggcccaaatataataaatcttgcatcagataaccttggcgaggtttcttaacttttctgagctttactttccacatctataaaaatgggtctaatactgtccttaaaggatcgtgtgagaatttgaaattagacatgtaaatacttagctcatagcaggcactcagtaagtaggagctcttattattatcctccatgtccccaagcagatagcactgagacagggcttgagcctggtggtggttgatgaaagactggagcagggcatataagcttgccatcctactccctgagtgtatgaaaggtagaaaaagggtaccagaattggatatgggagtcatagctgcaaaaaatctaagtacgagcagctggtctttcccctggcaactcccatgtaaaaggggcaggtagggcattcttgggagcagcacaccaggaaacagtagaaaggagccaagaaacactcttgattctcctaaacccagaaaagcatgccattcagaaattcaagttgatgggaaggattcagcattagccatctcactattcctttacacaaagttctagtttattcattcatacacacattaattcttttttatgaagaaatacaactaaaggtatacaactaaaattcttgatttcactcatctgtgctttcaatttttaaaaaataacttttgtatgtaggttatgctttagtagtaatatatctcatacctatcaattgctaaactgtaaaatccatgagtgtggagaccttggataacttgaaaataaaactgacactttagtattggaaataagcaccctgaaatgaacatgagttagaagactaaagtcaaaaggtaagagagctaaaaggaaatgggttttcctttagctgtctcttgattaagttatcataaaaaacaaatgtgttctgggtgaaatcctaaatgcatatgtggatttcccaaatctacgttctcttaatgacatgtgcaataagggtatatgtaatatgtttctaataattagggtatatgtatttaaatgtgcatttcccagttccatatccccttaatgatgtgtgcaataagacaacagaaagaaaaaacttgaattgagagagttacacaataaaaattaaaatgctacggacttttaacttgtctttgtttaaaaaatttgcctgcaaagtatcatgaccatgccaagtgatgaaaacaagtttgatagagaaaacattaattttttgtactaatctaaataattataatactggtcttctacaactataagtaggctatgttctcaaaatccaattgtaaattggttgcttagacctggtatgttttcacaaggaaaccatgtaccaagccacaaaagcacacttgaactttctgcagtcacttacaatgttgtttctagggaacaactcattctgaatttgctgcacctctggccctgagagctaagacttcccagtagcattgctttcgatctagtttccggtctagatccccacttctgtaccgtctccaccaaagcgattaggagactcagaatggcttttgcttttgctaggattctggtgagccctgaaagtccccagtagtggcagggagggaatttaaagcctccgagccggaagaaataatagaaaaaggagagaattgaggactgggtaggcagcttttgtagcattaatgggaagtgagtccttagcaagacagatgttctttgtaaaaagtatgtgtaatgacagattaagtctggaattgtcccaaatataaacatttgatgaatctaggtggtgcataggcaagtgatcatgatcctattgtttcatttttttttgtatgtttgaaaagttctccagttaaaaattgaagtaaacgcacatacccacacaaaagtaggtatgtccatgtgcctaattcaataaaagaatatacatattttctgattatgacctgaacctttcaaagaaagatcaaattttctgaatataagttacattaagacctctttacatgaaacattgataactcattgttttcctattttcctccaaaaccaatatatttttttcctgtgaccattgagacctttctgggaactatgtaattaagaaaacttttaagatatttattattatccaaaattaaaaagtcacacgagtttcttggataaatatgtaattatcaattgttaaaacacatactgtgaagcctgttctggaggctcatataaatacatattttaaagttttttcttattaagaattttgtgtaaaacagtctaatcctgccaatgtatgaaaataataagatgaacaaaccatctgccaaggaaatgaaaacagtattaaaattgcacagataaaccatatctagttctgaagaaatggaagagctctttcctggaaaaacaaaaaagtcgtgacatttttgtagaatatcatgggttattatattatcaagaggacaaagttttctgatttgggtgagagggtcactcacccttttttttttttccccaaaataactagcgccactctggtaccagttttattcaaaaccctcttgagaaaaataaactattgagctaaaatgtggaaacaaatcacttcatattactatacttataagacagacaatatctaaagaatagttgagtgtcacttgtcttttcagttgtttttcacaggttgagagttacttatttcaaaatagttggtaaagaaaaaaattgaaaaattataaatgacatttatgttgttaaagctgcaagatgtaaacatcatgagaggaaaagagtaaaaattagacacatttgatagtcaagcatccacattaatttatcagaatagtattatgcatgaaggtcccaggcttcactatggccctgtgtgactctagccattgttctgacatatgttcccaagcagcagtacctactttttctgggacccgtagattgcactttcttcaaaacattcagttttcaatgaatcatttgataagaggacttcattatgagctgagcaaagaatgtcctgattaatctcttctttcccatctaaggggctgatctcgccctctgacctgtggatgtccattgtcgtgtatctcatagcatcagctactctgaaagtccacctaaccctctcagtgctcaagcactagatcaccctatcttccttctgaccctggcaataacaccatgagcatatttccccttagatgaactgcatttaatcaatttctgatttcattaggtcaaatggcatcttgctttcaataatagggcaaatccagagggctctttgctctaactctcaagcaatattttattggcattaatacactactgtgattgtaaacaaaagaaaaaaaaagatctttggtatcctcagaaagtgtccttttgtttattccatgactttaaaatgggcgtatattaatgttttcttataaagttaggcatataatcatcattcattgttgtcacagcagatttaaagaatctttgctaaagctgacatttaagcatttaaggtgtttgtacagtgaatccatgtgcagagcaaaacattattttgaatgcaaatgatcacctctttctgtatacaggatttatttggtcaattcctttttgtttctgaagtatggtaacttacgctactttccttcaaaattctaaagaagtaatttgctttttgatggatttatttggatgtcccaaataggcctaataacatgcttgggggaaaaaaaaaatccgttgttaacacatggaatctttgagattttcttgtaaaataagtttcttattactcatagtatagccctcactaaacaaaatcagatattgctttcacccaaaagtattagatgaacccagaaataccagatgttttcatcaaactttaataaagtgagatctgtaacattaggattcctagctttcttcaagaaatggctcatggatgacttgagaaacctaaagcaatctgccaatacatctttctttggttatttaagtagtacctgaaatcagttgttcctgctacccaattttcctaatgtaaataaatataccctatttgtatacaaaattaattggcctaaaaaggtagaggactagataggaaatgccataaccaagtagaaaatataggactgggattttgctgtcagataaggtcttctccaaaattgaagtcaaagattaagaacaattatttttttttttttttttttttttttgagaaggagtctcactctgtcacacaggcttgagtgcaatggcgtggtcttggctcactacaacctccgcctcccaagttcaagtgattctcctgcctcagcctccctagtagctgggactacaggctcgggcaacaccacgcctggctaatttttgtatttttagtagagatgcgatttcactctgttggccaggcaggtatcgacctcctgacctcacgatctgcccaccttggcctcccaaagtgctaggattacaggcgtgagccgctgcacccagccagattaagaacaatttctaatgactgcattggaattattgctcttggaattagagtccaagtttctgtatagaaagctcattatgatctgtgccccttctccagttttttttcatcactccctgacccataatttatgttccaggtaaatagtccctataatacctgatgcacactgctacatgctgacttttaccttgaaatcagggttatctctttacaaagttaacatcctttaggactcagcccagatcatacttcccaatattcccatcatccattctaacaccctattttatttgaaagagttactgtgattcatagttattcttgcagctcttctgtgggctctgacttggaattttcaagtttctattggaggcaataaaagaaaaagaaactctgtaatatataacaaataattacagtaattttgattatttttataagactgagaatacttttctctagtgtcagcttatttgtaaaaatccagtttaacacaaaagttatcaaagtgttagccctcagaaccctgttcaaaaggttgtatgagattgtgtaagaaatttgagtctgagagtcagaaaatttgagtacagttcttaactccaagatatacagccatatgactttgacaagtttcttaagtttcttgaaattgagtttccagataaatataatatatattttatataattataaaatattataaatgtaaatgttgattatctaaaaagattatatatgtatttgatctagagaaaatgtatatagtggatctaaaatatatcaaataactttgtagattatatattatgttataaaatgatttccatctgggtaaattctgagtaaaataatcatgacttttgtttgtttactataaatctaccaatttagaaatatagcaagaatgtacttttgcaactgttgaaacagttgccaaaatgcagcataaacaaatgcgtaattttttgaaggcttaatttcttaatatcttcattattttattgactctggttaacatatatccttttaccttttgttttcttaagggatcctaagtgtcatggggaataaatgcttggttttgtcattcctgagtgtgagcctgacacgatggcaatctctagagattaaagtttgtcaagtgtctgttgccatttccattcttttttttttttatttaagttttagggtacatgtgcacaatgtgcaggttagttacatatgtatacatgtgccatgctggtgcgctgcaccccttaactcgtcatctagcattaggtatatctcccaatgctatccctcccccctccccccaccccacaacagtccccagactgtgatgttccccttcctgtgtccatgtgttctcattgttcagttcccacctatgagtgagaatatgcagtgtttgggtttttgttcttgcaatagtttgctgagaatgatgatttccaatttcatccatgtccctacaaaggacatgaactcctcatttttatggctgcatagtattccatggtgtatatgtgccacattttcttaatccagtctatcattgttggacatttgggttggttccaagtctttgctattgtgaatagtcccgcaataaacatacgtgtgcatgtgtctttatagcagcatgatttatagtcctttgggtatatacccagtaatgggctgggtaaaatggtatttctagttctagggccatttccattcttatagaaaatagtaaaataatacaagggtagaattttgacagagagttatgtaaattcacttaaaagcaaggaaagattttatttaattttaatgtttaaataatacatattagaatcaactcagtgtcatgaagcatctggtgataaaaagatgggttttgttgactaaagtaaacatattatacaaatcacatggatattgagccacttataaggagtaaactgaaaaccactgaaagtctggtctcaccaaactatagtgtattgatcagctggcaagggatgcccaccatgttcactgtatcaaaaggattgtgatatctgagttctggggagtaatcctagctgacctagcttcagtcattagcttaaaccaggaccactctattccattagactgcaagtgcctggaggtataagccaagaccttctgctaattacccctccctatccccatcactcagaacagagtctgaaacctagtggtgttcagaattattagcttggctcaaaagtaattgcagttttgccattttttaaacctcgtttacttttgcactgacgaataaatgtctgagtgagtgaggaaacaagtgaccgagagcatgagaggggaaccctgaagaaacccttacagattttatgcatgaggaatgaagggaaaggctgaactgtgaggcactgtcctgttgatgggtgttttggtttgggttcctccagaagcagtccctgagacaaagatttgatcacaggtaatatatttggaagtgatccctggacacacataggtaggggctggcagaagagagccagggaagagaacatacctatgaaggagaataaaaggtttatggagtttaatgctgctgtggaactctagcagtttttcagatggagaaacaaggaatgacagagaagagcatggatagacttttgtacaggaaggaaagaaccatagagcataaaatagttgaagagcacaatagattggtgaggctggaatgtgcaaaacattggggcaacaactggagatcaggttggaaatgaagagtgaaccattggcaaagggtctctcacggaatgctaaaaaattaggacttttcactataaataatgggagcctagtgaaagacttcaatgcaggcaagagacatgaacagatttgatttttagagtaataattttggggaaaatgtggagaatggcagagataggtagcacagagtgagagatcagaggtaagaagatgaattcagagatcagaggtaaggagatgaattcagagactattagaatagaccatgtaccatatgctgcaggtccaaactaggcagtaggaataggtgaagaagaaagattccagagatatctgacttgatattgataggttttcttgacatatattgtaagtcttggcagctcccaaatacccattgcctctgtggtttggaaaacaaccatcaggatgccaaggagctaagcagaatctcattctttcaggagcctactagattcttgttactctagatataatccatggaccaacaatgacaatatcacctaggagcttgttagtaaatatggcctctccagcccaaccccaaaccaactgaactgaatctgcattttaacaggtgattcccatgcacattaaaatttgaaaaaaacattaccatatgacataaataacttctttaaagaggtttttgaaagtccagagccaaagggtggcctttgggacttggacaaaagacctactcatataaaagagctatcttgtcggcctttgtgtaaaataaccctgcatatggttattatattggtcatgctatgacaatgcatgattttgaatggtggctatttaatctcatcaatcccttccaacccatgattacggactaaatgagaaagaaccaagacttacactgccttgtaacttttgcctgtgccacacctaagtcagaaattctgaactcccacatcaaaaagtcaacagtcccagccaaagaacagcaacaatatcaaaaaatgattctgagcctaaactaccctcaccaaaacagacaaacaagaaaccaaagctccaagcaattccctggaaattatccattaattccctggatagctcaatgtgcaaaatccatttgaaattctacttatcccttatcttccatttgactcttcttttcggaacacataatctcacatgtagcctctttttgttatttcccttctcaagcaagaataatagtatttgattgcttaaatttctttatttttatgttgttcttgagtacttgaattcatttcccattggcctttcaggttagatgttaaaattctggatgagcagcaacgtagctgttttactcgtagactaagtttatttgctgcacctgccaaaagaatcaaggcccaccaggctgcacttcagtcaagctgttttgaaaaattgcaaagaaaacaaaagtaggcccacaatttcacaatttagttatcaaaaaatagaggaaagattcaaaataaagtctgattaaccctcttagtagggtgagatttcacttactgggaagaactgataatgattatttctgaaataaaacctcattttttttcatgtctacctttttttaattataggaaatggaaaccaaaatgggcaaataatcattcttttctcagtaagaatctttctcataaatttgcccctaaaatgtccagtcttttaaaaatgttttggacagtaatgagacaggtctgaaagagatgccttaaaattttagtagtgcctagattcacttcacttatttacctttcttactttaagacagcttacataagaataattaatctttttttttttcctagtgagtacctgggtttgttattgaggtttcataattaatctttttttttttttcctagtaggtacctgggtttgttactgaggtttcatgcttttttttttttttttaaatcgggcataaccataattgatttccacggaagggtttggctgaagacccaaagaatttttgcttaactcatttttattgaacgaaatccagaattttagtcaagaagcattagatattaatcacatatgagtggggtcattaaaatttcctttaccttccagaactgcaggtcattatggaatcataagaagcagtgagctcacttaatctttacaattacataaaagtgattattttcttaagtcttacaagaagctcttaactattagttgaagagcatgttggaatattagaacatctgtgttgtgttattatagatgtgacttgtgaattaaaaaaaaattctctgactcaaaactcttagaagttaccctttccagcttgaatagttttaattctttaacacagtttgggagtatatattttttacctcgcaagtagagaccttgttgctgaaatataaattccagtatcatttcttaattattacactctcaactttatagaaaatcagaggaacttcacaggttctaaagattaggaaaaaaagaagaagaaaattagaggagaaatgcaattttttttactgcacttaagaataacagttggtgacaatttaaggtgagtcagtttagggaaaaactgagacaaatccatcctctaaattattgttgcctgtctccatctttttcttgtaaccacttctcatctttgactttgaaacccaacagtttaaacttggttcttatttcagtgggctaatcccctttcataaatcttgctcaagagctgaaataatttgcacatcatttaaagagtatttgctttgaaatattcacctcaagcccttttgtatatcctctctctctaaagatttgtagtatttgttttgttctctgaggtataaaagacctggataaactttattcctgttgtttcaagattagttaacgaaaatgcatattaattcagcagggacggaaataaacctcagtaaagatgatcatacattcgcctctcggggatagcaaagtacaaaatgtcagtcttcaaatctccttggacttgctcaaaagagcatttggggatttaaatttccagaatatgtctacaaatgtattttctttgttgtggagaacagaagctatactgattatttttccccagaaaattgattctaatttgtgtttgaacaaaaattaagccatctagaaagtagcacttcaagaagacagaggaaaactgccactgaaaaggtaaatttaacattaaaaattatattcttgataagccactaaatttttagtttatttgtcatcagatcccaaatcccaggatagtttcacagaatttctgtatttttttctatgaaaaaattagaattgaaaggacctcagaaaatcaaaagtagacatatttaaatagagttaaatgttcctctgcatttataagctcaaattttaaagtttgttggtcagctcagaaaaaaaatacaaatttctctagataatatatttgtttcatatgttaagatgtgccctgtgtttttcttaaactgaaaatgaccataaacttttggcacttaagtgcttatccggaaatgactaagtggattcaggagtaataaatcactcatatggatccagccacccacagtcttgttccacttctcttctttacaagtgtagtaatagacatttccacagtcctcagggtgccgaactttgcaccattaggaaaatctgcaagtagcttgatttatcttcctcactcagttagctaagacccaactaactaaaaatcagcaggaatgaacttgacttgttaaacttttttaatagggagatgcaacaattacaactttcctcctttgccacttcaatttacattggatgtgaagcccctggtgaaaaatattcagatgagaactcaaattataggtgcatggctggatgatgctgactctaggttttcattatacacagagaatcgtctgctgtttgcaattaatccagacacaatcctcttggtactttgggaggaatgcggaagaaatagccattttataagttgtaaactcctaaattaccctaaattagagacactattaatcgaacactttgatataggtaggatctgcttattgtgtaggctcatcttcccctgatggagcaatcaattaaatatttaggatgtggaataccttccgggttggataatgcatttcatttaaattatggccctccaacccgaaacattaaaggggatcttaacggatggaagcacattactgtctcttggattgggcgcattaacactttaaaaatgaatgtgcttcccaggatttcctatttgttccaccagctgcctgtggatgtgccagataaacagtttaaggataagtatgtaaaagatgcatgtgtaactttttgtgtgctgaggtgcacccttgtagcaagagtcctcaactgtggcccctttggatttttttttttttttttgtctcaatgctgtagcagtctaaaatgagagtgctcatttgatcatgggagagtaggagggaaagccaacaaaagatgtaattagacttctgacaaaggttctgtctgtgtttaatcttttatcatttctacctataatttatcctaataaatagtgattattactagaaaatattgggatgatatagtagaattcaaaataagcataagctttcccattctaaaaatatttggcataaaggaaattatttaatttttacccaaggacaattactatgtcaaatttatgaacagtattgtaagaacagagttgttatgtctcccataccacggaagcatggtatagatatggtaaatactttagagagcttaccaggctgtaggcagcattctaagcactttaatctactctcattgaatcctgtcaaccctatgcagctcagtgacattattatcatccccattttatctattaagtgactgaggcactgaaaggttaatcaatttacacaaagttatataattaagaagtagctgagttagaatttgaaaccaagcagtctaacttcacagcctggaaccacaaaccactgtgtagcatccggcttctggagtgaggttgatggtttctgcaatttactagctctacaaactttgagccagtcacttaacctcactaagctactgttttataatcttaaaaatgtcaataataatagtatctacctcacagagttgattggaagcataaattagattaagtaatgtaacgtttatagcattgtttgggagaatgtaagtactcaataaatgttaatcataacgttagtacaagtattttcttttcttccatagtatttggaaaagttctcctaatttggttaagaaaatgttatcttaaagataaatgattgaaattcctagagattaatgtattttccaaaatgtctttggacttacaggggaaaaatagtatattgagtgccttacagaaggctataaacttcctgaaccatgagtctgttttcattcattttccatttataaaagtcttgattcactattaacataatacataaatatatcatattagcttactgagtgaaaacaaatttatccaatcggaaaaaaaaaaaaagatgttaaagataggggtcaatttctttgtttcccagagacaggcttttcatatcaaatctgatagaacacatgcttcagaagggagcagaaaactcagctaactggtataattatgtaactcaaatggtcatattgagagggttaaactttggcaatagaatgtggaaatacaaagttcaatgaagttgtaggaatttaactgaaaagaaattacttatcagcattttgatggggaataaacaaacaaaagaaacaaattggtcctttcaaagttgggtggaaagaatgttcctgaagccttccttagtaatcaccgtcattgagaggccctgaggactcgtatctgtagtaattgatacctagtcctcatgctcaaggaggaagacaactggtatttatgggcttgtcaagaaaggaattagttggaattcctttttctactccatctttcactagtctttattgagccaagtttattgtaagttaggggtgaatcatacagatacctttactctttcaatatgctaagaaaacaattgggatgaaaagagaatctgatattttaaacaccaagcaatgtgttttatttggctgggaatacagtcttatgggcaatcactgtatatttatctgtttgcttgtttatttggaagtcctaccagtggagtaaagctcctcatctattgagctctgatcttcttccactgaacagatagaaaggaaaggccttagacagaattataataaaggtgtatgaggcaactcaggctcaaccagaaagatcagccaatcaactctgaaaaccaacaaagatgcaagttgcacagagcaatactcctcctaatatttttcttacgttcataatatgggtggattaataatttttctgtgttgtaatatattcataatacaagcggattaactcagattaaaatgctctatatctggtgaatgagggaagacaaaataggccctaaaaatgggaatgcttatttagggaacaaacaaagatgacgtaaactctaaaaagctggagtactcagagcaagaactcagttcacacattcacatcacagacatttgtaggggagttgctttgtgcatgcactgttttaagcactggagttaaagagactccaaatgttatcaattccacattaacaaagagagtttgttactggaaggggctcccaatccagaccccaagacagggttcttggacctcgcgcaagaaagaatctgaggtgagtccacagagtaaagcaaaagcaagattattaaggaagtaaaggaataaaagaatagctactccatagagccgttctgagggctgctggttggctatttttattgtcgtttcttgattatatgctaaacaaggtgtggcttattcattagttttcaaggaaagaggtgagcaattcccggaactttttagaacatgctaaaggacatactaaaagacatttagcatgctgatgcattatagttagtgtataaggagcagtaaggacgaccaaaggtcactttcattgccatcttggttttggtgggatttggctggcttctttaccacatccttttatcagcaaggtctttgtgacctataccttgtactgacctcctatctcatcctgtgactaagaatatcttaaactcttgggattgcagccccagaggttttatccttattttacccagccgctattcaagatggagttgctctggttcaaacacctctgacatttatggtcaaattttaggtagctatttcccattctctaacaagttgatttaatttaaagatgattatacacatgatgaaatactgttaaaatattcctgcttgattttattaacaaaacgaatatagtattttgatctaatttacatgtctagctcatattgaattttttaagaaatttcgcatttacattaggtccaaactctcatctatggagtattaagtagcgccatgaccacagtccaccaaagtgtttaaaaggaaaaaagtttaataaatcaaaatgctccaatcttgagtcctggtgtctttttttaaaatcccaaatggtctggaggctgacattatttcctggctggccctaggagggaggatctgtcacttgttagtaatagacacagagttaaatgacctggagacctgccattaggaagcaaatactacccattatttaagtccagaggagggcagctcacctgagtatccagctgcactgtaataatgacgaatctgggtggtagagccagaagcctcagcttaaatcctgacgctgccagaacctacatttggcttatgcaaaatttcctcaaagactggcagtgagggctaaataacttagcccctgaaagttctcagaatagtgtctggagtatagtaagttttcattaaatgttggctattaacattgagacttctgttagaccaaatataacagtccatacaacttgcagaatattgaaaacaaaatggtaaacatataaatgacagagggcaacttaattggaggttgtagagaaatatttagaatcattaaaaatgaaatcattttgaattttctattgtgttacatactaaaattaacattaggaaacaatgtgaagtaaaggtgtagagtgaaatggctaaacttattttcataaagtgaaagcatttcccttccaaaaagaaaaaaattgtaatcaatctatatatattagtatcagtatgaattaaaaaaataaaattttgtattcaccatgagctgttctaagcatgtagcatgtattttctcatcttcaagacagttatatgttaataattttatattcatttacagaggaggaaacacagatatttagttttggagtctagattataacttcagcagtctaaatcagaacacattctattataccttttataggctttgtataattttccttttgtaacttgcctttaagttttatttgttattatatataagtaattatgttattaaattgtgtacatgtgttttgaaagacagatttgtgcagatataatgcatgtatgtctatagtatataaaaataaattttaaggggcatattgacagatggaaaaagcataaatgtcaaagaaagttgatttagaaattaatatataataaaaattaaactagcatttattaatttaacagatggtgagttaaaaagtaaaaacaaaatctcgaatcgtaacttgatttttacaattagtgtgattatttcacaaacttattcaaaagtttgctattttcttgttctatttaaaagaaaaaagctcccatctcaaagtttccaccaaataatttactactttcatttaacagattctgttcagaaatctgcatatgtacaaatgagcaccagaatataaaatttaatcatagaccaacatccaaaaaattatagtggatgtaggtgaggcatgctagctcatgcctgtaaccccagcactttaggagatagagactagaggatcacttgaggccaaaagttaaagaccagcctagccaacatagtaagacccagtctccacaaaaaataaaatacaaaacaattagctggacatggtagcatgcacctgtagtcccaggaggctgagggaacttacttgagcccaggagtttgaggttacagtgattatgccactgcactccagcctgggcaacagagtgaaaccctgtgttgtttttttttaatatatatatatttatgatgtaaaactatattttacatatttatattgttgactaatatatattataatttatactataaatacaaatattggacattgtttttaaatacccacagtatttattattaactatatactaaatccacaaaattatacatgcaaaaattattttaaaatgtgatctgtgtaagatataaaaaattgataacaagaaattaacaaaataccccaagtaccttattaatttaaaaattttctgtcaattgcttttgtcttaaggataaatccaatatcaaatttaatagtatgcaaccaaaataatattcagaggcaaatgcatagtattaaatgtttttaatattaaagaagtaaaacaattacataagaaatattttaggttaactaaacataactaaagaaatctgaggttagaaatgataaaataaagaaaaatcaatcacatgtaaaacaaaaaaatattattgcactaaaagttatttggaaagtagtctcttaggaatgaaataaaaataactctgaaaatctaattttagagaacataaagaaactagaaggacataagaaaaactagaatatttgaacatacatcttcaaaatctccctcaaaaaggtcccaggtctaaagatttactagtgaatgatgttaatcttctaactggtaattttcatgtcatttgaaagcacacaaataatcagtgagtaaaattttcaaatactcaagtaatgatcaaggaactgaaaaataaagcaacagacacatgccaacaccgctgtgtctgcagctatagtgaacggcatcaggatggtctgaaggcacttgaaatctaagtaggaccagagctttgacccttgttttccaggaaattccttcagggagacagttactgagacctgcgcaatgactctgcgcactacctgcagtgtgttcagagaccatttaaagggaaggagattcctgctgaagggccggtgatcatgggccagaggaaagaaaaatctgaaagttcttcgtgtccttgacatttgaaaatggactcttcaaatggggaacttgagaactctggctcttgtcaattaagatcattaagatagacatcattcggatgaatagtttagtgaggagaaaatttattccctcctttataatgttttcctctcctttgctaatgaaccattacattttgctttgaagttatgactcagctgttttgacattttcatagtgaccaaatatgccaaaatagagcaatttttttggaagaaaatatttgcaatacttggattgtgatcagcttgaggtaatatatgtaaaaaatggtaaacttgtcataatgcttagggtcacctgacctcttaaatgtagctgtttggtacatgatactaattttttttcttcttaatttaagcaactgactagaacttctttagtctcagtgaggtcatgctctcaaaaggcatattgccagctggtctcaatgcttggaggcatagttgtaaatttttatacagcaccttaagagtttttaaggttgctagtggcttcaattaaagaccacatttaatagattaacaagggatgccagattaagacttgaaaactttaagcaagtcacagtgaatttaagaaagttgcagtggggtataggaaatagaatgatttgagtagctaatgaaaaagagttgcaaagatttgtttttgccagcatccaatccaagttttaggatcaaggtaccactatctgattaaaatgccaaaatggtgcatctggttaaatggggggtggggggaaggatgctttatttgccttgtttcccatccttctcagtaacatttctaatcacaaagatgattagctctatcatttaaaaataaaactaaagtaagaaagtggcatattaatagttttcataaatcttatcaactactatatttcattgcatcataatcatgtagatataaaagcatgtgtgtgcccactcaggggtgtatataagtattttatctgtattgcatacctatgctttctgtatacaatatttggaaatacacactgaaagccttagaaatatgtgtactcttaattttttaaaaaaaagattgtactcctcaaacgatttcagttcttaaaatccattcaaagaaaactaaaagtctgaattgaagtgttttttgatcatagtgaaaaatttgaaataatctacctgtccaacagtgggcctttgtttaaaaaatcatggtgtatccctatgatggtatatatgtaatcaaaaacatttaagttttcaaagaaaattgtggaagcataattctaagtatgaagcatacttagaataaacgtgcataatgtgaagtatgggagagggatacaaaacttgtttgatatgaagtattaaagcagaggcctggtctgcttggccagagatgcatccctgcataaagtaagggctcattaaatatctgttaaataagtgaatgagtataggatgtaaaagaaaaatagcaacagcaactctaagtaatacagtgatcatgggtttactttgttttcttctctagtctccctccctaagtcttctaaattttccataataaatgtttgtttccaatatcagaaatagtataaaatatagcacaattgtgatggatgatgagcaagattattagtggaaatatatctcacaaagtgtgtactatgttttgcccatgaatatttggctcttctcttctgaaattcaaaactctgaggtttgctcacacgaatttttttccccacacttcaccagcccttgacatgtgactacaatatgtattttttgctactagttttattcatttcattttatcctctgcattcttgaaggcatgaatgacagacatctggaaaatatatatatatctagacactgaaaacataatttcttatcaaagagctggaatataaacatctagaagacaaagtatctgaataatgttaaattagaatctttattttatactaaccagatctcaaatatgaagcacaaattgtggtttattgcttgatatgtaattgcattagggttatcattctttttaatatcattttttccctcagttggattttatccaagaagtgatataatgtgctaggaagactttacctaaactttgatgcttttaaacaacatgtatgtgggactcctcctctctttgataagaagaaaatgggaaaatgaagagaaagctgaaacattaccattttaggggaaacttaggaaaggaacccagagtgggcagcttccaggggcagtttcaccattcttgtcagaagggaacagacacatagaatgtaaataacatacccaatattgactatgggaatagaggccccttctgccttccttttatttgaagtaaaatgtttgccccttcctcaggcttcaaattgcttagagcatctagaagacttggctgggcatggtggcgcacgcctgtaatcccaacactttgagaggccaaagcagatggatcgcctcgggtcaggagtttgagaccagcctggccaacatggtgaaaccctgtctgtactaaaaatataaaaattagccaggcacggtggcgcacacctgtaatcccagctactcgggatgctgaggcaggagaatcgcttgaatccaggagacagaagttgcagtcgcaccactgcattctagcctgggctacagaatgagactctgtctctcaaaaaaaaaaaaaaaaaaaaaaaaacagaactcaagcccacctttacattaaaatccttaaacaatttcttttgatgtggcgtattctattagactactcttatacgttgaacacaactgtggggtagtgaagttgtgatgtagaaactctgtttccttgaacttagtgctaactttagggagcacagatattaacatttcttcatttgggctaaatgttataagaacaatataaacactagaggattttagcttcaccaccattcgagaaaattggttttactcccaccattaaaaggaagcaatctaaagtaaaggaatcgatctataagtgtaagaacaacagcaaatttatcaggaaaatgtttaaacagacaaattaaccatttttcagtgtccattttcttcattatgaccaaggatatccttgactgtaaagaaaaattcaattatttgccaaaccgtaggtgctaatcctgtttctgcagttgtctgtaaatagaattcccctttgcagtgccgttttctgcatggtaccttaaacaaataggtcttagcaatagttccaataggattggaggttcaccattaaaaatagacttatcggcctgctgctgtggctcatgcctgtaatcccagcactttgggaggcagagtaaggctgatcgcttgagcagcctgggcaacatggcaaaaccccatctctacaaaaaatacaaaaattagccgggaatggtggtgcgcagctactcggagtagttccagctactcaggaggctgaggtgggaggatgacttgagcctgggaggcggaggttacagtgagtcaaggtcatgcctctgcactccagcctgggcaatagagccagaacttgtctcaataaaataaaatagacttattaccaggtgcacatgatatgtaaagttggttgtgtaaagtaaataaagtaaactataattgataggccatctccattctgctgggaattgttgtgttcacttgtttctaaaattttatttttgtggtggaagtttgcctctacaaaaatgacagcttacagttttaaactattggggaaaaaaaataaaactaaaagactacaaagaagaaatgattcctgaccattaagtcttctgcaatgccatgatagcaaaaaaaaggcacaaagttttactgaaggttagatacacctcacattcccagtagatatttacagaatctcatacatctattcattcaataagtgtgacactgtcctatgcactggagatacaataaacaaaatagatgagcgtccttctccaaaaatgtctcacatatgagggaatgctaaccttaaaatcaaagccatgtgcattgagtgttgaaaggtaaccaagactatacctaaccaacctacttttacaaaagacaaaagttagaccaaacagtcattgtagaatcactctgggttcaacagagaagcagtactactactagtaagatgtagtaagatggatggatggatggatggatggatggacagacggacagacagacagacaaaaagatttttccagttgcaggagcttgctatgcaagtctgaagttcataaagaaacagttagaaagggaagacacaaagtaggctggaactcccaaggcagaggctatttggggtctctgagcttagggaatatctaaaccaggcttgcttgtccaacctgcagcccctagtcctcctgtggcccaggatggctttgaatgcagcccaacacaaattcataaactttcttgaaacatgagatatttttgtgatttttttatttttagctcatcaactattgttagtgttagtgtattttatgtgtggcccaagacaattattcttcttccagtgtggcccagggagccaaatatactggaaaactctgataagcccactcctaggtagctcacctggcctagtctgatatatccataatatatatatattataggccgggtgcggtggctcacgcctgtaatcccagcactttgggaggccaaggcgggtggatcacttgaggtcaaaagtttgggactagcctggccaacatggggaaaccctgtctctactaaaaatagaaaaattagccaggtgtagtggcgggcacctgtaatcctatctactcaggaggctgaaacaggaaaatcactaaccctggaggcagaagttgtagtgagctgggatcatgccattgcattccaacctcgtaatcaagagcgaaactccatcttggggggtggggggggaagatgtcttatagataggggtgtctataataaatcagaacaggccagttgcaacctttttatctaaccatccatccagctatcctacatcttactggtagtggtactgcttctctgttgaacccaggatgattatacaatgcctttttggtctaaattttgccttttgtaaaataatataccttctgattaacttaaagtctgattattagagactttaatttcctctaaaaatttcttcacagcaccacctaaattggtgtgtgattgaatgactaggctatatagttcaccctagctaggttgacatattaaaaagccattacaggcacattcacttgcccagtgtcacacagctgtcaagtggctggaactaaaactgactcatttcctccccagttcattctgtgatgggcatacctatccaacattcacaccctccattctcctgttcttgaagacatctccattcaacagtaaaatgttgctttcaactacctcttaccctcttttcaaagaacaagattataaaatgacctgtaatagttggcatgtctataaatttaattatattttagtcaaaaccactcatttagctttgaattggtaaggctgatgacaaagccagtttggctagaacttctagagtctcggaaaaaataggctatttttctataagaaataaggtaacctatttattaaattgatagagaatcaaggtcaataattctttattccattttatttattttaatagtgacctagtaaagtagatataacttgatagaaataaagaatagactgaaaatataatcttatggaaaacaggtgtctagccttggagaaacagaacaaattacattagcgatttaagacatacaacaacatatcctaaaaagaattcttattaacatggcaaacattgccttaaaaagcataaataaataaataaatcctctgtatattcatgtaaatttggaaaactatgcttagtcttgccagacaagttatttatattactaaatataaatgacagaaatttctatgacaaattctagtcaagacaaacttctgttgcagtgaaaatgatgtaatcaagccgttttgcctctttacttgctgatagtcaaaacatctcaagaagtttgtgttggaggataatgacatttccagagatttctattataggctgtaccctcataatttttttgttctaattttgtctttatcataggtaatcatgatattaaaattctatcactattctttggattcctacattcccttaaagctttttattggaaaattttgctttatcttacataaaaatctttttcatcttatataaggcaattacgtcgtttttcacaatcaaatatttattataacaagttttattttttaaacttaaaaaacacccttcttttaaaatagttcctcacatgaataaaattgtttcactctttaagtgttgagactgaaagcctttctcccatcagtctctcaaaatgtttctattattcctcccttttaacccattgctattttctttccttcttccttaggtctccttaacctcctcctgttttttattttctctggttttccattaacattttaaaatacactttaatgagcctcagccaaaggctctaagatgaacaaaagcctggagaagagaatcaagagagggaggacaagaaggaaaagaggaatagtgggcactgctctcagttttaaacgaatttctgtggctggctctcacttttatagctggacctgaatgctacagcacttactaaggccactaaatcatagcaaagtaagggtctggctattaagaattggaccgtccttaaatcagggattattactgtaatctttacatttaaatattacatatatgggctattgaaaatgtagcaaatctgctcactgaaggcctttactctgttgatatctgcattttcagggtataactggcagtccttttaaatatctgttgtatttattttagcataaaggtaatgctttgtatttttttccagtttagaaatccaaatgctaatatatacatgcatatattacatgaaaaaagcataaaatacttgaaaacataattaccttttagatgctaataaagcaagaaaaataagttttttttttcttttcatcactactttttgacatgtcggccaataaaaatcaactaaagtttaccttctgttatattagcatcagtgactttctaatttgcttcactttctccatttgtgcttaggtatgacactttttgcaattccaaattcacatcacctctctagttcctctcttccaaaaagacaaaaagtcccttgcatgggttggatactctatgtctctgtttagggattcatttaacagataccccagcactgccagtaaacaaacggatgccttgaacagtgatggtttacaatggagactgacttctttctttatttccctgcattccaaaattttttttttttattttctttgtagtttgcctttgtcacattggcatgcagggtgagctcgggtcccagcaaatatccccaggatggtaaaattagtccagaagagaagttttattttgattggctattgtattttcagtctgtcatggttctctacttctatataggaggacaaattatttgggccaaacaatacaatgtggtttggaaacaattggcttttatgggcacaatcttattctttccatatccatttttttaaaaattgtgaaaatcaagccaatttttttttcagaactatgcaatttcccaagactcatggaaaagacagcttgggttgaattttttttttcaatttctgcttatggggaaaaagagttggttgtataaatcagcatatatatttgtccaagcattcatacattgtgtttggagtattagtggaaaagagtattttacataatgggctttgtcttctggtttagttcttcaagttcctgactcctagtccaatactcataaatcaagcatattcaggcaaaaagcaggtaattgagaggagctattctctgggtaattccatcctcttttttgtgcacacatttgcaaatgtaagtggttttcatctgtgcagacacccttgaggggctcgtctatcctcacatcatttttagacatccaagaagtttctttgtaaaactcttattctgtgatgccagatggttgatgccaccctacaagaccatattttgagtaaaaaggaccagtttagcaggtagatgaaacaacacccattacaattattgttgcatctcctgattcagtaatggcaaaatgtacttctcatcacatgttcattccaaacacaaaaatgagtaaaattcatatggttttccttttactctaagaattgggcacagctgctcccttacaagcattaaaaggaaaaaataaaggaaaaacgtctttaatttctcgtgtttttcagcatctcttcgaaaaatatcttagtgatacatggctcaacagcctgaaaatacctactcttgctatactcttaagcatagttttccttcacattatagtatgacagagggaagatttctaatatatagactggggaatctaaggaggagaaaatgaaaacttgaaataatgcttagtcatgctattcaattactccatggcctttttttttttttttttttttttgcagtcttttgtttgattcctgatctatgcagtctctgaaatgagtgtacaattcatttaccttgtctgaaaaaaaagttagtagttacatatgtggcaaatattgagtaaagatgaacattttaagtacttgttagactttcaattatttgggtttttccagaaaattaaaatgcattgatcacaaatgtaacagtacttggtttggggttgtataatcttcaggaaattatatgtgcaataaattaatgcatcaatataaccaataagcatttgttactgatttaaaaaatactaaaataaacccaggtacccaaaactattgtctgcttccatcataaggattgactagaaatttcccgaagaatatctttagatgacaacatagatataatacataattcaagttattaacttctccatttaggcttatagatcttatagacacaactgttttaaaagaagaacaagattttcatgcaaaaatatgaattatacagtagttttactgagtctattgctaatgcacatggagttcagaaccataatgacgatattgggcacttaagtcattagcctgtcatattacagcaaaattatttgtactatataatcattgtttccttttttatattgcacagatctaagcttagttcatctatctttgccatagcagtaccactttattgttgtaaatacctattttttaacaatgatttgagtatgttcgttgtagtttaagttcatgtttattagacctttgcttccttaaagctggaaaacatgaagtttacaatctgccatagggtgccttgtttgattgtgtattacttcatagcatcaattactgtatagtttatattttaagtacttgtatacacactaaaaatttcaaggggaatgggaacaagttttttctggttttttttttctagcaacatttccatcttattcatcatatttaagacatgctcttattcttaatattaaaatggaattctgtttgtagtcaactttttttcctttagggacttttaaagatgaacatgtataagtgatctctgatgactattttcaataagaacaaaatcatttgtggaaaaaaaagctgaaactgaaagcttcagctgcaactcatttgtgaacataaggtgaatatggctgtggttttcagaactggttccagggtttcataaaccttttagaaatggatattgattattactattcaactaataaaactgctttctcagaatctgttttgcttgtatttgatgccataaaggattgtttgccctataattaaatcctagagattatagcacaatataactcacctagcccataggttgctatgggtttctttgtgagagagagagagagagagagagagagagagtgtgtgtgtgtgtgtgtgtgtgttgtaaaagttaagaggtgtgcatacttctgagtttgaataagttgtggctgagactatttgaattgatttcatactgggaaatggcatacaagtaaaatcagtagtctattcaaatcattgtacagtcaagtcagctaaatatatggcaatgaagaagtaaaatcaaacctcaaattgaacaaaaccagtctattctgtagtcaagtagacactatgtctgtctctctaacttctctgcccagaccaaaatcatgatttggagaatgcactgtaaccagacaatgcctatccagcctttcctatattaaaaaatagatcatctggaactgaccctttatgagaatttatatttttttactttgccatgagttttcaagaataaaatattgtgtaataagagaaaggatcagataagcattgccactttagaagctttataactgtctcaagcacagactataaacttcaaatacccaggacccctgagaacctgtagtcgacccattcacacctgacagatatattttaaagtctgggtataaatataattatggagagatgactagcatgagtgaaatttcacaggtagcatgctagaataaagcagcgcttgaaaatgggcatactaaaattcagaaacctaatgattgcagataaaagaatgaaatgcaacttgtacaacctgctctaccgatgtgagatacaaatacattttaaaactttttcttcttatacacccctgcccactgccatagtgagcctatcgctgagtcaggccactgtgccaactgtagcaatgccccacacgcgagctccagtgggccagttctttgtattgacacatacgcaagttcggacatgacacccagaggcttgctccagacctacaccatccaataagaatgttactagcctcatgcaaacactgagcatttgaaacgtggctagactgaattgagatccactttaggtatgacttacacacaagatttcagagacttagtacaatgaaaaggatatgagatatctcattaacaaattttatattgcttccatggggaaatgataatactttggatagattgagtgaaatatatttttaaaattaatactatttctttttaatgtggctaccagaaaatttaaagttatatatgtgccccacattgtatttctatatggaaagtgctggtctaggggtctgagacctcagccacatgctggactaccctttccaagaacctcaatctgactctctcactctctctctttttttttctctctctctctctccataattgtcagatacagagaattctctttatcatcctcatcctatttattgtcattagtcacacaggactcttatctttacaatgttttcctttgtcttccattcaccttgccaatgataaagatgacttagaatgatttcagtatatccatggatgtataagtatccttaaaaaaaatttaactttttttattttaatgtattctatttttctttaagaaagagctcaacatgatttggcactagtatctgtgaataggtcaataaggagaaaaatactacaactctttctaggtgttcaaggttttggaaaaaaaaaaaaaaagggaactgagagcctggatctcctctaagacctgttgtgtatataaactcaaactgtcatttagtgataattaccaatcatcagttcccttcttcataaaacattaggtggtttattttcttagagcatagggcttttccataaatgtttaaatgttagaaacaagagattaagagttttcatttttctaaaaaaggaattcataatattcttttgttttatatatatatatatatttcattctgggaaatagcataaaagtagtgtgtgtgtgtacatatatatatgcatgtgtgtgtatatatgtgtatatatatacatatgtgtgtatatatgtgtgtgtatatatatacatgtatatatgtgtgtgtatatatatatgtatatatgtgtatatatatgtgttgcctgggtaagcatccaaacctgtagatggaggtgattggttacacttcttgtcagtcattcatcctactccaaacaggttggcatatatatatatatcctgctccaaacagtttcgcatatatatatatacacacacacgtatatttatgtgtgtgtgtatatatatacacgtatatttatgtgtgtatatatatacacgtatgtgtatatgtgtatatatgtgtgtatatacacacatgtgtatcatatgtgtgtacatacacacgtgtatcatatacatgtgtgtatagataaagaagatatgaatatgtgtgtatatatgcacacacacatgtgtgcatatatacacatatgatacacatgtataaatgtatatgatacacatgtgtatatatacacacatatacacatacatgtatacacacatgtgtgtgtatagatacagaaagaggatatgaatatgtgtgtgtatatatacacacatatatgtgtgtatatatacacacacatgtgtatgtgtatatgtgtatatatacacacatatatatatacacatagagagcatgcatttatttttgtttgtgtatatatgcacacacatactgagcacttttttgcttaaagattatctgggaccagagtctctagaactgagactagagtctctacaaaactaagtaattaaaaaattggcaaaaatcctgctctgggaaagcctctctaatgggagagaagaaaaaagagatattattaaaagaagtaaaatacatattagatagtgatgtttagcaaagtaaaaacaaaaacaaaaacacagaaaagaaaggggatagagggctcctaagtggggaaaacttacaattttaagtagagaaagaacctaggagaggagggaatgtttggggacaggcctgaaggaagtgaggtatgttaccatgtggatgtctaagaaaagaatgttcaggtcagaggaagaagcatgtgcaaaggacctgaggcaggatgtgctcaagaaagagcaggaagaccaatctgtttggagtaggatgaatgactgataagaagtgtaaccaatcacctccatctacaggtttgaatgcttacccaggagacactcattttgaggacccatcttttactctgctgttcagagctaatctatctgaaaagtgacggaaattaccctatggcctgcagaagcaaagcaaagggtctcctgcctactaatctactcccttacccccaaccgtactcacagctcagttccttggatctttagattctccccagagctgacattccatctgcaattaatcaagtgttgtgttaaattttttttaatatgtaaaagatgtttcagctgtgattatcaaagtatacaattgtgtgtcctaaggctacatggcatgggatatacatctgatgcaattctgatcattatcatcactacataaggtaacattgttccacatttatcaaatcagacctcctgccatttctgtttgggtagacacggcataaattttaaattaaggtgtataaaataaaagatttctatatatttttttaaaattattattaggagaagtggtagtagtaacccacaccatgcattcaccagggagatttatactaccagtacatttattgctatcaagttgcaattaacaaacattcatgcagttggagaattgggtatgcaatgcgtcaaaagtgtgagaaaatgtactgtctcaacaggcgattcctagggctcttcctattcaatatgaacatgactttttaatgagagctagtattaatataagcttaatttaattttatatacttattccaagtttcttaaattattcatatcctctttctgtttagacgcatcagtattgtgaggtttaattgttagctcccaaagcctaaggactatctctatttaactcacttttcagctaagctagtgaaagctgtaaattatgatgatgatggggggaatgatgaagaggaggaggaagggaggggaggactgtaatctacttgagtatatataaagcactgtgatattgtacatcatagtatttaatccttgcaacatggcaccaagatctttttatccttattatgcagatgaggagactgggctccagggaagttaagtcacacacttgctaagtggtagacccaggactcaaaattagatctcttaatgcgcaagcctgtgtgctttccaccatacatcttgctctgatactattcaattattaaacatttttattgatcaccgctacatactaggcttgatgacagacagtgtaggaaccaccattaaactccaaactagaacgtgaagacccacctcaccccaccttcagcctcacctccagtttgcattccaacaacattttatttcttgtggccatgaaatgagaaaagaaatatttttgccaaaccatcacatgactcagagaaattctcagctggccattgacttgcaatggagcaataaatttccattttcctttgcaaaggcccacctaagctccatgtttctgtccccctctgctttccttagccattgcattccccagcacttgttcgtgttttcacactaacgttcacaggtggccttttcttttttctgctgtgccagagtgcaaacagctaaactttctttctgatgactaagtgaaggaaatatttcctggtggatatttcctaactgaactgcttgacaaaaatggggagggagtcagatcctgccagaatatttctcttttactcttggttctgctttgacagtttggaggattaagggacaacaatgacagtagttcttgttattagccatgtcttaccgtgtctttctcaccattcacagtgtccctgttggaataaatgctgatgactacatctgttgtgttatttaaagtagatctttaagtcaaaatgaggatgtgtgcgcactgcctcattttgagtttgcttaatgtttccagccatattttagaaataaatcccaaatgcttttttgctaagtgcattttcctttcgattttaaacctatgtgtattttaaaggtcatttaatctgtgcatttccaattcctccagtcttaaatcatcactgtgttattttatgtaagaggtacttaatgtctcaagaagcttttggaggcctttaaaacccaaagacttttcttttccaagaccagaagttccattttgtgaagagtaaacaagcctgaagaagaccgaaatctcagcccgttcaatagtccaaaagttcaagtttcagaggggttggaatttggcgaaatgaattttcccatccatagctcaatcctctatattccctcctagcttaggctgaaacacatggaaattatatccagcaggcactcttctcagtgacatctgcatctgtaggggtgtcctggcattcagcaacaaaatcctcttcccccagggaaaaggaagactcaaaaccccaaataataataatctattacagatttcaggttaccaaaagttaaagaaatggataaaagcaaaacacttagcattgctacatgtcaaaaggaaggctactgtaatcaccccccacccttgaggcatgtatttttcaggttattatgcataattatgcatacaaatttaaatatatttccatattatattcaaaactgcccaattcttaaaaaatgtaggataaaacaaaattaattgatggcaattactgcatttagatttaaatctaaaattcctggttactggaagaattgggccagtagtgggcacctcgaacaacagaactgtctcttctggaacattcttctggatttaggaacagtgtttctctaaaattaaatgtgagattagagaggcataaagaggtgctgacagaaaaccagaaatggtgattaagaaatttggattgaacctttatttcttactacgtggccttaaccaaatgatttaaacaatttgggcgtctttttcttcatctgaaaagctaggcgcattcactccatgctctctcaagttccctccagatttaatatttcatgtttctgagactccaacatgaactgtgcccaagaatggggttatctgacggtcaacaacagaaaaaagcttggcaatttgattacaattaactcatttaggaaagaagtaaaatatttgggataacactggagttttggcagtaagtaaatctcccatcacaatttttaaatggaaggaagagttaatccaaaagggtggctggaagcagaaagtagttccatttgtcacacacatggtgaccaccatcaccatacagcacccagagggatttcaaaatggacaacacataaaacaacctatatccagaccacatcaagtgtcagaatgatgtggatctttgtggggcttttcctagttttctctccttctttagaaatgtatgttatgaattatgattattgcaatagagccaagtattcaccgggctccagctagatctttgtttagtgagcataagctccctgccagctgcaaactgcagctgtctgtcagcatttgtgaggacaaaccaccccactatccctgatcacttagccgtagacgacatactgtgtcctcagatctgctcagagcaccccttgcatttttcaatacacttcctgtgggggagggcatcagtgcttcgcacgcacattttggagcaaatagcttaaatcttatgtcaaaatgatgcttttaatagagggttctgtcccaacaaaactattctgtgagagactcactgactctggcctgacatttccggatattcgatgtcctgaaaaaggcaagggaggctaccactctgacaaccaactgttcctcaagacacagtgggccctacagagggtgccaagagcatgggccccaggccaggaacctgtcttacagctggggaatgtgggggtaagaaggccatggcaaaggggtgaagccagaggaagggcatagcccagggtgcccagagcagccatcctcctgggccatagcttacagccagagacaagacccaaaggaatccttatttcaggagaaatcgttgtctagaacattcaagtaaacttggaactctgcagttttagaggggctttgagggatgatacatttttcttgactctcatttgccagcctcctatgcaatttattttcctttaaattgcaaggcatgctcagaatgggagagaaactggcagcaccacaccagatttaattaaagcattgttggagttaaccaagagtctcccctgtttttatcaaaagtgactcatgtgggtgagaaaaatcatttttagaggggtgccaatttcaggaataccctgagaattaccctcggaatttaggaatactctgctttttccaggcacttgtatacagtaaacttggggtttcttaaaggataaaaactattgctgaagtttctttgggctctggggtacttctgaaacactccaagaagcctgagctatggtcccctagtacttgtggaaaagacttctttgaaacatgtttaataataatattttcaagtaaaaaaaataaatctggaattcttcctactcatgggggtattgtgagaatgctctttgttatgtaagagtactgtttcagtaagaactgtgtccccttgggaagaaaggcacaatgcaaattcaaattaataataaaactgtacaatatgtagcatatgcccaaagttggcttaagtcacataatgaagaaaacattctaaggtttgggaaaagactcagccctatgcatatgtgtgtgtggagctgtatgtgtttatgggcaggagagcactgacccaacataaacactttctttcccacaacttaaacatatacacaatacttaaaatagtttctttcaggagtagaaaccatgagagtcacagggtcattaaacaatagcaaagctctgttagtccatgatctttccttattcaagaggattataaaataaaaacaaagattctgcaaggaatcaatattttgcaaacacatagcaatttacagtacaagagtatttggattgctaagtaccttcacttctgtgttgctgtttgctgcttcattgtgaaacctttttgctggatgtgttacatgcgatgagcttgggtgttataataaacagagaggaaggctgcaataatgtatttcagttaggaagaagcacttgaaagaaattgcttttgctatacacatgatgtgagccaatcaatagtggtttagtctgacaagccctgtcaatatccattgtcacagttcagaaagtcgttaatggatagttcttcaaaacccaatgattttaacacatgttcaaagtcttgaaatacactctacctggcagaaattaatcacaggtaactcttgggaaagtatacaagcatttttttaatgagagccaaatcatttacacacacacacacatgctcgcacacacacacacacactcgcgcacacacacacacatatacagcagctaagggtctaatctaataacaacagatgcatagtgaatgctcagtaaatgttgaaaaagtgagagacactgggatggaggctgagaagggtcctttttatacacctgttctgtaaatttaatgattattacagtggtgatgatgatgcaggatgcctatcatattttaattattaatcatattttaatcattaatattaatctattaagattaataattgcttctgttaactacatatgtattatacattagacattgagctggatgtttttcctatatcagaacatttaacatacacaaaaatccttggcatggatattattatccccatctaacagatgatacaatacaggcacaaaaaactggcatagcttgaataagatacaacgttaagtgacagagttggaattcaaaatccaaagcctatattattcaaaaaagaaagaatgggtaggagagaaaggaacacacttgaaaaaaaggaagaaagaaagaaaaaagaaagaaatggcattagcaattggaaggaagcatatcaatggttcttatctgcttttccccaagtcctgatcctgaactcttacactcagttcctgtgaagcaaccaggaacaaaacaagcctctgagctctggggttgggcatagagaagaatgggatttcccagtttggctgaaagaagaactaaggagtttgcagaagtaaatgtattcacttacactgttgtgggctaagtgtgtgtctgaaaaagattgtgtgagggcaggggtaaaactgaaagacacagctaggttgctagccatttttgcctgaaaggaacccccaattcccacctacatctctccttctgtgttcattgttgtcttgctgcatagagcaatctggagcatggtgagtgatttgtcttctgcccagtatgcatccttgcagcagaactcaattcatgtccatggtggttacagttctgtcctacccagatgtattcttcaactgttcttattggcaatccagagagtattcagccaccagctccactgttgtcccatgattcactcatcttacctaagatgactctttttctctctcagccgtacaatgatacacaccacatggatagtttcagtaatcagttcatggtaaagcagatgatttaagaccttaggttgcaagtacttgagtatggtgaggcaagggggtgggggacattaccatctctctatgtccttagacacggtgacagcattgccacacagatggacaggcagggccttagggcagggaatcagacaccacctgagttgtggttctgccactgatttgctacttggcttaacttctctgaacctcagatttctaatctgtaaaatggataataatggaacctaccatattgataaggattaaatgagatcaatgtgcttagtaaattccttattatatagcaaataacttcaaaatattagtcattattataaatatgacattagaataatccgattgtctagcaaaagtggaaattaagactattttagaagaattatgtataacttataatctaagaaacattttcccacttcttaactattgattatttggctttaagacatttctcaaactatctgcacatgtcatgtatgtttttctgtcctggctgaaaattttgtttggaaaattaaggatacattatagcatattctttactaaagatacattgtaacacacagtccaggaatttagagatttaaagaagaagcctcaaaattactatatgttactcccctctatacctgctgagaatgtatctttacaggcatttttacaaatgtgcaaacaaatacgtacatatgatatacagtggtagctctcactatgtatgtatacatggaaagagtatttaaatgccactcaactgaaatactgctaatgatggttcagaatctgagtccatacatcagtactgaaatatccaatattcttatatatgcatgtgttttattctccaacttgacttacttttttgcggaaatctaagtgttaatttcgtagaaggcagaggctatcacctctctggtggaattaccacgcctacaactctttttggggttttttttttttctcttttatggactgatgttcacatttatatttaaggctcttctcatttgatttggctgtggcctgttttctatcactagaagagaacccattcctgtatttaatatacaatctttcctcatggaaaacatatttctgcttcacagtgccctttgtgtggattgatgccctatgatattttcttcttttttttagtaattcagctttcaatatcagctactgccttagctcaataaccacttactttattagcaaatttatcaaagttttgaacagctctcaagtgacaaagttttactgacactatatcaagtcataagaagcccagttaaaatatataatcaatagaagaatgtctaaatgatctgaatctttacattttacactgtatctcattttgttttaaggaaaaaaaaaatgtcattgtgtttctctacatacaagataggttttgctgtttaggtatattttccctctttttattgtttttctgaaaatgtagtattttcataacctgtgacgcaaaaaaaaaaagtcattaaactctggcttataaaaggaaaccagataaatctatagtggaagggaaattaaacattgtgatggtatacttaatatttgcagtatgggattgaagttatcaatcatcattattaccattaaaagtactcactatgaaacccaaagctatgctaagtgctataacaaaaagagtttaaacaaaacaccctgccttacactatagaaatacattatcaatgtagatacacctaagatgtattacgagcaaaataaaaatactaagtctatacatgaaaagacagtgaagaatttacatcatagacaaatgcattagaagtagaagacatggatacataaattcctgagaaaagtagccatgaaattttcctatggctgaattgacagtagacgccagctgttcactgatatcaaaaatgcaaaaatgtggttagatttaactacttaaagttgataatgcagtctaaaagtaaacattttaattgtatgaattttcacttctccttaaatgggtagatagcatgaatattaatcatggaatagatgatgagtacacacccttctgttatgaatctaattgtctattttgtatttccacaatgtctaagtgggaattaagtggttaaaactgagcactgcagttaaagtgcccagcattccctctttcaattatttccagatttaatcatgatttgtgttttgagcaagtcacttaaagtttcaataacttagtttttcaggctgcaagttggggtttgaaattatgacttctatttacactgagcaagtgaaaaaaagagatattaaatgaccaacagtacattaagcccaaacttaccctttctgcccactctgacatagggagttatgtgcaaagttctgggagctctgaaaccacaggcgggggaaggcaaagcagtatttattacagccccatgaattagcacaagcgtgaatgccctggaaaggaataaacaggaggctggaaagaaatgtaataaacttgatttctttttttcaatcaatttgggataaggtgctcttatttatgtaatttggaaagtagttaagcagggtaattccaatacaagaagtttgtgttggaaaatgtgagtggagataattcagtactttgttatgtaatccctatgatggtgtgagaagagttttggaacctctggggattaagagcctgacaaaaccttattttgtcttttttttttctttgatttcctgctctgaatactgcagagtggtaagatgatggcactaaagctactgttgccagctttgcccttgatgtccttttggaattgaattgaaatgtttagagctcctagctgctaacaaaactatctacctacactgatgttgatctcaatgtcaaacctcaccgataaagtgagaacaagtagtgtagaaagctgtgtgtaatagcttttctgaagtataatgactccactttcctttagcaacatttctgaaatgttggctgtcccagcacttccaaatttcaaaaaaaaaataataacaacatgtaattgtaacatgggaataccgcgagaacagcagtttggcaggaaaagaaggtatttcaaaataaggtccccagaaagagatgttctggcagatgcacaattttggatcatattatccaaaccgttgaattctggaagatttgggggttttcttttttggttcccataccctaaatgggagtagatattcgtcgtccatccagagggcattgtttccccttcctgttactaaagtgagaaaataagtatactaagggcacccatttacagtaagcattcgtagctctagaggtgatttttaatagcacaatagctgtgtcaggtataacacttgtgttgggctaatgcctattctcatatgtaatactattaactgaagatcatcttagaaagcccactatcctaacatcttagaaagcccagaattctaactcccctctggtgagagcagttttagcaccaattaagtctctcaactggttaagaatggtatttaaagctaatgcctttggcctgtgtgttgagatttgaattgcctattgttattgaaaattctcagtctttgaaaagcattctatttgttcaggcttgacagaaaagatctccaatgggaaaagcagaggaaaacataaaggaaatataagtaaattctagaatacctggaaagctagtacatttcaggttaaggttaatgtttatggaggtaaaaatacctaggattaagagtgattgctctagtctcttatgcaaatcagattaaatatttcagagtttaaacccatatctcttttggctctatttattttcaaataaaaactcaaagtgggaatggaaaaaaaaaactactcgttggcttaacataaatctttaaactgcaggaagcttcaccctcaaaaagtagttgaatctctgagggaaaagaaaaggctgaattctatttttcataaatgatggattattgtaccacactgtgtattttccagtaaagtgtccttttatttgcactgtgtgattacaagtttctaaaagtatgtgtggggtcacttgggtgctgtgggaaaatggaaggaacactgttctgttaaaatcagtagtgaaatcagaagcaaactatgtcccgattatcacaggcatgtgtttaaattttgctttccttaattggttatgttgtatttacttaaaatgaacaatttggcaagtttttctcccttgacaacagaaaagcgtaaactgttttataagtttggctgttaaaatcagatttgtaaaccacgatattcaaagacttttacggctgtttacagggtcccagtgatggaccttgctttatatccacgcacttcttaacatttttattttgtatttatagtgctttcaagttatttggttaataaaaagtatgctatatattatagtcatctattgacttcaacctctacataactcttcttagaacaaaatgagtggaatgaatgatggcacaggccttgtaatttgacttgtcatctgaggacaattatttacggcatcaggaaatggaagttgacgttctagtctgtctccaggaaagtaatcattagagccaactttggagagtttggctacgttaaaaactgtctaatcatgtccaagactctgctagtttctcagtatgtatgagaaggaaacaagataaagcatttaaaaacatattttcattttctttgaaaaaccaatgcaccttacacgcatttctcacatgtggagccagatggtggtattgaagacaatatgatatacatatatatctctctaattaagaatactatcaccagaatacctaggggagtttcaaaaagatataactcataccgtaattattttcataatctagcatttatacgtcatgtgtgtatattttaatttgcaaagtactttctaatggcatcgtttttactagttccaaatggaagaaaaaaaatataccgtgcttggccctgcatttcttggtattctatcatgggaaatggcaaggtttttgaggtgagaccagaaatcgaaaatattacttttgtaacctgtgaaaacttagattgattattctgtgtcattccaaagatggacttgaaaccaaaattgccctgaggcagagttattctgaaggatgttaagtgtttcttcagtctccaacactagaatacagacctatgggactttgactacagctgtcagttgaagcagatcatacatgactggtggtcactgcgatgactggacctagaaggaaagttgttaggatagcacataaacacactttgttaagatgctcagaatgactcttccaactatacaattttgaatttgttaatggctgatattcaaggtcttgtaaaagcaatttttgtttgcttgggttctcagggcacttgatatttctccaaaatgacctgaggtcaatccctcctcttagatcctttaatctcttacatttccatttgactccttactgtgctgcattataattacacaggccagacaggcggccatggtggctcagacctgtaattccagcactttgggaggatgaggcaggaggatcacttgaggccaggagttcaagaccatcctggccaacctggtgaaatcccacctctattaaaaatacaaaaattaggccaggcgtggtagctcacacctgtaatcccagcactttgggaggctgggggtggggtggatcacttgaggtcagaagttcaagaccagcctggccaacatagtaaaaccccatctctactaaaaccacaaaaattagctaggcatggtggtgttcacctgtactcccagctactcaggaggctgaggcatgagaattgcttgaacccaggtggcaatggttgcagtgagccgagatcgcaccactgcactccagcgtgggcaacagagagagactccatctcaaaaaaaaaaaaaaaaattagccaggcttagtggcacatgcctgtaatcccagctactcgggaggctgaggcacgagaatcacttcaatttgggaagtggaagttgcagtgagctgagattgtgccattgcaacccagcctaagtgacagggtaatgattatctcaaaaataaatgaataaataataaaaataaaaataaataattacacaggccatatacatgttatccacaacaattaaacccagcactgccatgtatatagtaggtggtcaatttgtgtttattttttattatcttccagcactgtccaacatgaaacatatgtataatgtaaaatcttctggtagccacattttaaaaagcaaaaagaaacaatttaaataataagatattttatttagcagaaaatatccaaaaattatcatttcaacatatggctcaaactgcatgtcaagtgttcaatagccccaagtgactagtggctagtacattggatagcacaagtctaaagcagtgcttttcaaactattgagatacacagagacaatcatacttgtataacacactggtggaaactgctcatagccaaagaatatacagtacaactgccacaaggactcaggctgtcttggtcttgcctaaattaccctaagagctgaggacatctgttaactctcagacctatagtacccattttttaaagtttactttaatttaaaaaaaaatttttaatttccgggatacatgtgcagagtgtacaggtttgttacataggtatacatgtgccatggtggtttgctgcaactatcaacccgtcatctaggtttcaagccccacatgcattaggtatttgtcctaatgctctccctccccttgcccccaccccttgaaaggccctggtgtgtggtgttgtcctccctgtgtccattcttaagagccccatagctgggaagctgtctacctttctcacatgatagtcactgtacttttattatcaattcatttaaaaaatagatagctcatgacaaatatatagatagatggtagatatgtatgagattgtgtatatatacatacacacatatgctatagatatatagacatttatttttcttttcagagttcttttacattttctcaatgtatagatagaccttccaccgataaatgagaacttcagatggccctataatttttccaatcagtttaaggcaatgatcatcaacaggaagtaattctgtaccccaacctccaccctcatggacctatggcaaagtctggaggcatttttttttattgtcataattaaggagggcgtgctgctggcatattgtgggtacacaccacggatgctgttccatatcctacacagaggacaggcctctacaacaaagaattgtctaccctaatatgtcaatagtacaaaatttgggaagcaatactttaaagtaatataaagtattacagattttcaggtagcaagaattgtctcaatttagtaatttacagtacctagtcctatgtgataatccaaactttaattgaaaaataaaattccacccttctcccagctaggagataagcaggatatttttctttttctgtcattctcagtcttgaacttcaccttaattccccattttgctaattcaagtttgagcctgctttgtagtcaaaggcagggaaagcaggatgcaaaaattccctttctttgccagttatagagaggtttctcactccctggaccaggtagattttcaaaagcatatctatatttattaaaaagaatacctaataaagtatcccaaaccctctcattatgtcaacaattgaatgaaggcagtggagcgttcagttaagatatatatcttgtctacagacacaacaaattactatcagtaattaataataagacaccttgggccaggaacagtggctcacacctgtaatcctggcactttgggaggctgaggtgagcagatcacttgagcccaggagttcgagaccagcctgagcaatgaagtgagatcccatttctaccaaaaaaaaaaaaaaaactttagtcaggtgtagccagtagtcccagctacttgggaggctggggtgggaggatcatatgagcctgaagggttgaggctgcagtgagctatgatcacaccactacactccagcctgggtgacagagcaagactctgtctaaaaataagaggaggaggaggaagaagacatcttggatgtgtttagaccatgcttaatgaaaacccagacctcatgtattatattcatccccgaattcacagcctttagcatggagcctgattagtagacattcagcaaatatttgttcaggagtgaattttacacacacctgactttgaagataaatctgagaataggaaactgaggagaggggactaatgaagacatggaaaaagtttgaggcaaattatgtttctgaatttcacatagaactggtagtaattatacatcaataaggagagtaagaaatacctgcttcagaaaaataaatcacttcaggttaatatagaaaagaagattgacaagtttattcaagcaagcaggacctccagaaatgtctgcattagctagggatggtatataatcatatttaattgaaatcagcaatgctaaagagttgtctcctgtagtttagatgaatttttctttactctgaccacaattttgtgcataaatacatggaattatccatgtaaagattacgttaaatataaggaaatgaaagtgaaaataaattgtgaatatatggaactaatcccattctcattgtacattcatgctgcaacaacaggactaatactttcatgtgggcaaattttactcacatggcttgttgtagacagaagagcctgagctattaattcaggtagttgtttcataactactgttttctattcagatttgcataaagtaataatcataaaggagaaatttaccaaaagcctctgatttttttaaatcttcagtgttcagactgcatcacagtgcttccgatacaagcgacaaaaatcgagttaaaagcagattaaagaagtttattacccgaagaccttccctgaaaactctgcaagaaaaaggacttattaaaggtacaggtcattttatacttgtactataactgtgataaatgaatgtgcctctgtgttcatagctaatcagctctaaaggaatattagaatattttattcttcttaggttgcttattaaattttctactctgtaacagagaaaagaaaaataattgtccagaaaacagatcctgagaaaataaaggaggtatcatggggccattgaacaatatacctagttttgcccacagaggatctgtgttctgcactaggaacagagaaaggatatcctagtgtcctgctagaatgataccatgtcctcctgtgtctgggtggttccagttcacagctgggttttagtaagtatgaaccagcacacttaccaacccagcccttttcactatcagaaatgtccagatttggataaaaggttatctgatcatcctagtcatagtctgaagtaagtgctaggaagaaagtctaagacaaactagtgtcatgaaaatgtatggatattgagagctggcagtctaaaaactcaatccaaactgaaataactaggtagttttacaaatatatgtagagggcagaatagatgattgtaagaatagatgatggccaccaatcatggtctctggcattagactaattagatcaccagtcactcattttgacattgatcaagttatgatcttctctgtgcctcagctttctcatttgttaaatggggatacttatatacatcattgaaaggaataaatgacatagcctatgtaaagcattcaacagagtttctggaacaaaagtaaatattctatgaatgcccactgcttattaatataattattcattgttgttatcactgttagtgtgtcaaatgaaaggatgaatggatagatagaaccagtgattagtatatttctataactggaaattatcttacagaatatacagactaaattgattctttttaaaaacaagaaaacatgaagttcattattctctgtatttttcaaattttctagcttatgtgtacattttgaaaattaaatgtaagaaagaatttgaaattgggcgaaaagaaactcctaaccctcagaagaaagctgaaaggctaaactttatagaaatcgagaggtgatttaataagcaatcatttctcatgaagagggcaaagcagatcctaatttcagcattacttaaaaagattagcatttaaataatttataacaactgttcaatctatcagtttccgtccattttgaaacaggtgaacagatctgaaaaattagctagcactttgaaccaattgtagaaggtgaaatttcatgaagcaaaagcatacacattactaatagaatagaaaattcttaggatttaagggtaaaacgaggaccttgctttaaatcagagttgcctcagacttttactctccgatgcataatacttttctgagttgtagacagtaattgaccctctacagattcaacttcactaagtagtattactagtaccttcagttctgccttagaattcatcctatagatgatcattttcttggaaaagattcagttgcaggttaactgccatcttgaaaaatataaaaccagctaagcaaccaacaatcctaactttacataatgtccgagtttttcacgactgggacaaaataaaaggggttttaattcagtggcagggtctggctccacatgaaatgctgaaggattaattactacagtgctctagaattggtctcagaaagcattaggaaagctggatgcctaatgcagttttcataccgaagcaatggaaccgctaaacacactctgattcatgcatttcttatcttagagctccattaaattttcaccataactgaccaatgagtcagtattcattagtagggctatggaaaatctatgtaaaattctgatttgataagcttccattgttgtcttcagtagaatttttttccacgtacagatcaagttatgcaaatgtagtcacttcttgggcttgtttcagttttagctatgaactttttttaaggcttttactaagtttttgggtttttttttcccaactcggtaaaaggcattaaaccaatttttaaaaatacctggctagtcacacttagtactttaatccatttttttcttacacttaaagcaaagacttagaaaaacaataaaatcagtatttttaatcagttaagaaaaattgcatacaattaatgattaatggttaaatggttagtttttgcaagcaaaatgacttaactctttcaaagggaagaattatttagaaagaggaataatggctttagaattgttctgcagctcacttggccagataatctatatcatactttataaactgtctaatcttccagatcggcacaaaaggcctctattaccaaggttcaggaaagctgtgcttggcagtttgggccttaacaattgtgcttcctgaaacctgggagggattctgcagcgacatgtcagttttctttttctttttgtttttgtttttgtttttgttttgtgatggagtctcgctctgtcgcccaggctggagtgcagtggcgcaatctcggctcactgcaagctctgcctcctgggttcacgccattctcctgcctcagcctcccgagtagctgggactacaggtgcccgccaccacgcccggctaatattttgtatttttagtagagatggggtttcaccgtgttagccaggatggtctcaatctcctgacctcgtgatccacccgcctcagcctcccaaagtgacgggattacaggcatgagccaccacgcccggccggccatgtcaattttcaaagtgtttattctttcacgtaattcaccagtaggttgaggaggctgggctttgaattcaaccagcctttattgagcaccacgatgggggcaggaagggctaatattttattgaccctataacgcccatcagagtcacgtccacaaagcacttaatgtgaaaagagatttaccccaatatcacacaatctaaactcaatcacaagccctttcttcaaaacctgttttatatgtggtttcattagctagaacctagacttggaaacagtcccttgatggtgctgtattttcttatttatttatttatttgtttgtttatttttttgagacagaggctcactctgtcgcccaggctggagtgcagtggcatgatcttagctcactgcaacctctgtgtcccaggttctagtgattctcatgcttcagctcctgagtagctgggattacaggcatgcaccaccatgccccactgtttttttgtttgtttgttttttagtagagatggggttttgccatgttggccaggctggtcttgaactcctggcctcaaatgatctgcctgccttggcctcccaaagcgctggaattacaggcatgagcaaccgcacctggcccatattttctaatttctttaatatgactaaagagaagtacatattaagatatcaaataaagtgggccagaaaaaaattctgaatgattgctcaatgaaaagaaatcttaatagctcaggtgggtgtagcaaacattgtaccattgcagtggtagctttggaaaagttctccaagggcattcaagtttgccaaggaatggtgagccctttttaaatatatgagtttattaacattgagcatctcattgggaacaaaacttgaatccgtttaacatataaattataggcaaaagcgtccatttttgggtggtaggagtgtttataaatctccttggcctgcttttggaactgaagtaacagctctttagttttagccagactgccttatgtaatctttcaaataacagtattgacatccaagtttaggtaatacagtttttagagaagataaccattgtttggctttttaggagcaattagtatgcccttatgtcaaaataatagcatcagagaggatttagaaatgtttagtgtttagaaagtagtttcattcatcctaataaggacaaaaccatactggatggcattagtagaaactgaaattagtatcatattacttatttttgaatcagtatattataaaacctgcttgaagaataaatagcacacctcagggatttatgataaggagaagtgctttctagcctcatcttagttttgctccctaaaaggtaccactttgaacagtttctatttatagttctggtgatttggtccatacctacatccttcttatttagggtaaaagctggtttgtttttttgtcaatgtccttcttatcttcagtgttgtaatatcttactttatcagtcttagacagtactttaggtttctactgcaataggcgtgaattttactcaactacaccaagcctcatcttagctttttttattattattatttttattttttggagatggattctcactctgtcacccaggctggagtgctgtggcatgatctcagctcactgcaactcctgcctcccaggttcaagcaattctcctgcctcagcttcctgagtagctgggactataggtgcacaccaccacatccggctaattttttgtattttagtagagatggggtttcaccatgttgcccagcctggtcttgaactcctgagctaaggcgatctgcccgctttggcctcccaaagtgctaggattataggtgtgagccaccgcgcctggccctgcttggttcttctcctcgccagatacttacagtcaaatacagctcatcccacagtctccattagctttctccacaacttgcaagatgcctacatctctacttaagttttgttaaccctagaaaattgagcgctaagcctccattggtaagatgaagaatttacagccaccttctcctctcatctcctctgcctcttctcttctacttctatgtcatacaaacttattttactttacttgtttttataagtatggcttatttataggtaaattttaaaagttaaaaaaaacatggctgagcatggttggctcatgcctgtagtccaaacattttgggaggccaaaggaaaaggactgcctgaggtcagggttcaagatgagcctgggcacgataaagagaccctgtctctctacaaaaagtgaaaaaaagttagccaggcgtggtgatgcatgtctacagtcccagctacacaggagactgagatggaaggattgcttgagcccaagaagtcaaggctgcagtgagctatgatcacatcactgcactccagcctgggtgacagagtgagactccctttcttaaaaatcaatcatccgggcgtggtggctcacgcctgtaatcccagcactttgggaggcagaggcgggcagatcacgaggtcaggagatcaagaccatcctggctaccatagtggaaccccgtctcttctaaaaaatacaaaaaaattagccagccgtggtggcgggcacctgtagtcccagctactcgggaggctgaagcacgagaatggcgtgaacccctgaggcggagcttgcagtgagccgagaatacgccactgcactccagcctgggcgacagagcgagactctgtctcaaaaaaaaacaaaaaaaaccatcaattaatcaatctatcaacattcatactattatgcttacataagattgtttactgtagcaccacatagacttcctttcctgtacttataatatcacaactcccgtgactctcaaagggtaaggcccctgattattgtggaaaaactctccttttacatttgagggatatattaacagttttatgctgtttcacgttacctccatggctttttcatattttggactaaatggtgaaaaaaacaataatcagctttattttagtcatgtaaatactatcaaatctttggccaagttatatgccagattggttgaacatatccatgggtggcatgctgtgaattatgggccactccagttatactgttcttgctttcaaaccttatgctctatcatttgcttataatcacgcttttagtctgattcatttttccattttgaatttcctgcacagtgttcttcccctacccagagtttcatttttttcttgcattctgggcccttatgtcattatgtgctttcattctctcaaactgtctgtgtattctagtctgccactccttgcttttttccccctgagtatcttcttctaaagtcctttcagcctctttctccaatttgcactggttgctctccagctgattgccctgtgatctccttccactgctcctctgtgttggatccactgtcttcggcatcccatgccttcccttctattactctttaacagtttccatgaacccatttggaaagcatgagtcctcaacggtctaaaaaataccttcagtatgcccacacactcgatcagtagcttagttgggtataaaattccattgcctgtccaacactgagttgcagattccgctcttaaaattgttttgcttgtaccattgttactttgaatttctctctctcagaatcattggggggttttggtctttattttgagattctggaatcaagataatgtatatagtggacaggatttttaaattttattctgcttggcccttaattttaagaattatgattctttcttcagtgctggattttttatatttttgttattacattgatacattcctcccacctgttttctctgtttcctattctgaggtcttttttatgtgatcattagatcatctgaattgatggtttcattcagtgttatcttttctcaaattttgaaagaattctcagttttgttccccaatatttatattattttaactttagcaatcatgttttcaattttctagatttgtttcccattcttctttttttgcacatctcatttctcacataccatgaaaacaaaaactgtgttgaccactctactcctatacaatagtgaggatggcacatagaactcaataaatattcggtaattgaataaataggaaaagtagatattttttaaaagctatctgaggacatagattagaatttgttgttgttttggagtcttgtttttattttttattttaaattgttctcttctggtctttaaatgatcaatttcatctatggtccttttctttcctttatttgattcattctatttctatcaaattagtgactttgcccaaatgtctgatgggcaatagttgtccactcttattaaagaatgagtctctgtagagaatgactagagctctgaaaacatgggtagacctggccaatgatatggttttgccttagggtggtctgctggtgcatcccacactaatcccatacctcaaatatcatatattttcaaaggatacagaatgctttatattctcttgataaactgaatcaatcttactgctgatagtcaatttttcagctccattttacaattaagaaaaatgaggagaaaatatctcagattatttgaaagtatagcagctttgaaatttgaccaagccaggcttgaagccagattctttgatttaccagctattaacttaatatctggttattgactttcttctttatgaaatttacattgaaagtttaaatgaaatgatatatgcgaaaatggtgctcagcttatcttggccatcccacaactgttttctccctttcttttttgtttcttcctttcttctttccttcatttcatcttgcctttcttatttttatctttctttcctttctcccttttcctcttctttatttaggtgcacagagtaaattatgaccaagatggccctaggaaaccattctgttaagtatttgcttaaagctcgagaaatcattgaaggcaagcatctaggaaaggcagcagtaattcacttacttcaagaaacatacactgataacttgggcttggcttatatttctctttttggtaattttaatcatgatgctctttatacataaatgggcatgagctcatttttctaactacactcacttatatagtgtcatgcaactgctggaacatttaagtaattacccacacagacataactgattgtttaaggtgtctgccataaaagaaaataatgtctttgaaaaattatagttcttttaaaaatatgtcaattatgttgagaaacaaaaaaaagatttgtcattcaaactgcaaatacaagctatcagccctagacttaacagtcatgtttatgaatagcaacatcattgagttaagagaaaagtgttttttaaataatttgttagaactgatatatgacagagtaacataattgtcacactgttaatttaagcaaaatatatatgatcaacactgtaaaatagctttgggtagagacatgctccaactttgccactttatcagtgttagtctgagaataattatacttgaatttatatactagggcatgggtctatcattgcttgggtctgaaatactctgacaacttccacgatatgcactaatgtgcttaaaaatatcttgtaaatcttcttttttaaaaaacttctttatggttcaaaattgaactgtgatctttacgtgtgcgctgtgtcatgatttaatattagccaaaattaatagccaaccttaagcttctttatctcggcctacaagcttcctggttcctttgcatttatagttctcaggcagtttctgttatttaaaggctcttgggagcaaatgtgttggtaatacagtaccacatagttagcttttgttcaataataagatacaggacaccatgcgagatggagaaatgttgagaaaagggtgcacctgggtagcaggttaagcccatgtattttaaaagcctgttgtgcacacaggaaacaatccaggtcttgtgagatattaaaagcagaatagctttggagcaaactagagaaaatgaggttcagaaatgggagcaaattaggtaaggggaaaaagaatgagccagaatgataaattggtttccctgtggttcaagaatttattttcttatggggacagatctttttatacagatgttagtgagaatgtaatatttgagattgtgacttacatacacttgatttttttaacctacaaaatggttttaccagtaaatttctggtatgtaactcactatactttatgtgttagcaaacaacaatgataatcattctccttttagttcctttaaattacatttctttcacattaaatcaagtcctcaagatgtttcccttttctcaagtaaaagaaatgccagataataccaggcttcagccatgaaactgacccaatgcctagtaatagctatgcttaatgctgggaatgtaaaatgaataaaacccagttgattcagccagcatattggcattttgtttttagccaatgacccctaaaacccatactaaattttgccctggcaatagatgctggttttattcattctgtggactatgtatccttaaaagattgcccagaattctggcatgccctatagggttacatgaatctggtgccagtttgaaatattgtatttgagccttccagtttgaggactgacaagcttccacaaaataggaagaaatagatcatacacaccaaaaaggaagcagtaacaagtggaggcaggctttgtttcatcttatgactctatgccatgttttaagcatactctgtgctctaactcaaatcttgtgtgtgtgtgtctaaattgtaaaacagatacaaaacctccccttccacccccaacattgcaccaaagttgatgtgctctcgaaagcatatcctcaactagttggagacaaccaaaagtcaggctagggtggtagttcctccttgtgttagaagtctgctgcgctctggagagatggcccatggctgtttcagtcctctaatcacatcctaaatctttcctctgtgaaaccacctgatgagaagaaaaagatgcagggcccttgtcagtgttcaaaagaatcccctttttaaaggttagcatttattattgataccctgctgttctccagcaggtgttcttgtaccgcatagttccctcctgactcctaaagccagcttcacgagcagtggaagattcttcagcttagttcttgttagcttttcagggcctccatagacctacgaacagtatccaaagccagtgctggatgctgctttcgcctctgtcgttggtataattctactgctcacactaagtactagatggtgatttcattgtgtggcgaggtggataactgagggagaagaaagcagaatttcattctgacctggagattgattatttgagcaaatgtgtgaatgaatgcttcttatatagtgagacaagttgaattttccatgctattcaaggaaggaggtctcactccttcctcacttatgatatgaatgggattttagagttcacatggtgtgtatgttgagtgtgtctctaaagatagtacatgtcagagctctcataactcagatatcctcattagggaccccattcagcagatgtgttagactgctacgagcaaaggaaatattaatatccacaattcattttgacatatcctaagattaagagagtgctcttttatttcctttagcatcactgacagtttggcctacaaatcttttttctccaaattcatgtctattataaatcaacaacatttcataaatttctaagattcaaaaaaaacttgcattattttatttcaggggcccaaattttgtccgatattaaaagcatctctctttggacttcttaccccacctgattagtgataacgaaaattaactgggcctctgtaaaactgagtcatcaggaaaaataactccatgttgtaaaagtgctattcctgcattttctattcttctctgtgggagggaggcaagaggccatatcagaatttggatagtcataattggtggtctgtcagtattagtgaaattgcaatagggagaggtatatctcccagcttttctttgaaattgactatattgctgtaagtgtgttttatcaaagcattttctggggcaacagatctgaaaacataaactttatgtagcattgctcctccttagatatttccctttaatatgtcttttctttttgaagataaaataaaagtacataaaagagttctgggaataggcagctatatgtcataaacaccattcactccccctcacccagagctcccaccccccaaaatttggaaacgatttgattgaagtgatgactgccttgatcttgtttgaatactccttcttcattgtcttcttctctcaatgggaggcaacaaccctgtcacagagacattcctgggagggaaagaggtatttctagcaaccatattttccaaacacaaaattgagacacatggcctgacaatgccataatatttgaagtagggactgtgctcaaagatccagaacatatggtggaaagagttttcttataaaaggcagccatttaagacactttctagattcttattcacaaaaggctcattcccccatcccttttattctcattaaaaaatattacccacagatcagaagactgaccagttttccctcaaatttgcttttttgccagcttgagaaccaccctattgactaaaaagttaaatgcacagccatccaggaagaaatgcaaaccagactgccaaacatattatgaatatattgctcttcttaaaaatgctagttggtttttcatactggagtattgactaactgtctgtgtttgatgtatggtttaccagcctgatgtcgacttatggttagagcttaacttgttagttctgcttttgcagccaattcagaataactacagatgcctcgagatattaaaattgactgctcaaatggactcagtgcgggagtttcattggttttaaattgataacagctgaaagagtgaatgattaaagtgtaaatgggcataggacacagctctttcatagaaacacttgtgaacagacttcagtagtgtgggagttttttctttctttttctattgtagttatttctaagcaaccttgagttaaattttaaaagtgctcaggaatattcaggagcctagaggagaaataattcctgagaaactgagataaattttgatgaagtgggtttctattctacagggaacatttaaagttaagtagcattccataaggtggtaattgtgtctatttcccaggcatttaagttaagtaagctgtgtaggaagtataaactgtcataatagaagggttagagtgttgtgtacatctctttcttcaactcataaaaaccaaagctccaaagtgccttatcacagataagtcaaagaaagcctctcctttgctttcttattctcctaagaacaattattattattttcattatttaaaaagatgttctgaatactttcttgtcgcatggagaaaaagaatacaaaagagaaataaaaaaacttttctccccctccttaaatcagcaatacttatataaaacaggctttatgaaaacttactttcaccatttaatagtagcttaaggaaaaggcacagtaaagagaataattaagtgaaatgtaaagaaatttatgaaaaagaaatatctgtttataatacagccctttttcaacttaatatctttctaagagttaggtgtgctcattatacaatattgtgacctagctcctttctgttttcaaatgtctcttagtattttatctttgatattccatcaggaaatatttatacattttttattttatatatttttatatatacttttttaatatttatatatgaagaactttatatagctaactgattaaaagcatcaatctacagtaacacattaaggcaggatttgttgacaaaatataagtccatatagtatgtactaatttcacatattcattttaaaaaaattgaatcattgtgcctagctagtatgtccccacatatgtagcaaatattcaccttatgttaattacaatttgtggaataagagatttagatatatttgacagtaacattagtgaatagtgatatgtatgttcagatgtaagaaaatcaaattatgaaggatgctctgactttaaaacaaaataagccacaaatatcctggtcaatgtttacaagaaaatgtgttatatatttatttactgctcaaattttccccaaaattataatgtatatacctggaccacatcttaaaattgcagactcaagttgccttcatgaagcatacagccgttgaatcatgcttttgttgtgatagacagcttatgcagatagccgtctaagaaactgctaccaaggttgacattttcacaagatataattcctttagatatgtagagcaaaagagagaaatttcattctctttcaacagttgttcagctccaattttgtaatgattttttaaaatctatccatatgagacaggagggagattttagaagagatgtcatccaaataaaacatatgtgagggtcattaacttgaatataacactcctaacatgtccctttgaacttggaactcagattcataggaggaaagaaaagatggagctgaaagaggcctggtctgggttaacctcacagtaaaggaatctttcacataacaagagactgagaaataagccgatggtataaaagtgatatcttgaggatatcttaatatggtgagattccgaatactctaaatttcagaaaaaccattgctcccttggactccctcataatttgtaccacctcatacattcattcattccctggacagtgaaatacgatgtttacatcttttgtgacttcacattttaaatgcattgaagcctttacaatgttacaatgagcatgttacaatgtttgcatcttaaaaaagtaattagcataggagaccatttgatattacataaagaatttgacaggacctcactcaatgccttttaagaaataatatcgaaagaggaagtgagagcctgttttagttataaatctgttcacataattaccagttgaagaagatatcataaacattttagaagagcgaggttagaccctcacttcattaaaaacagaattccaaatgatgtcagatacctccagttctctagcatccgtttcttatgttcatgtacacacttgcatgcatgcctttttagtcagaaagatcatgtatttgtagtacgagtaaataattttgaagaaaaataacattggttagaaatatactactaaacacatgaagagagacaaccagatctgcatgtgaggttaagttcaacttgagatgccacagtgatatggacaaagtattccaaaggtggctttgcagtataggaatataaatattccaaatgtgactacacagtgtagcagccgactggacttttccataggagaggtctctgcctaggtttctctactacagcatgaagaacaggatgggaagcagaagcttttgccagggagctgtggcctcaaaggtattgaccgggcaggatgtgaatagtgggtaaagttggcaccacagccttacttcatccaggacagaaggtagaaagtaaacagtccattggaaaatgtttggggacacaagacatgggatctgaggaattctaggaatggtagtaaaagactttgggtttggctgggtgcagtggctcacaccagtaatcccagcattttgggaggctgaggcgagtggatcatctgaggtcaggagttcaagatcagcctagccaacatgatgaaaccccatctccactaaaaatacaaaaattagctgagtgtggtggcaggtgcctataatcccagctactcgggaggctgaggcaggagaatcacttgagcctgggaggcagaggttgaagtgagccaagatcgcaccattgcactccagcctgggtgtcaagagtaaaactccctctcaaaaaaacaaaaacaaacaaacaaacaaacaagactttgggatcaagtcttagtggaaagcacttccctgtgataagccaaagccatctgttcctataatcagttattacagcatgaatactacccaaagcctagaggaagcttctgtgtgtggatcgttttgttgttgttgttgttgttttgttttgagatggagtttcactcttgtcacccaggctggagtgcaatggcacgatctttgctcactgcaacctccgtctcccaggttcaagcaattctcctgcctcagtctcctggatagctgggactataggcacccaccactatgcctggctaatttttgtatttttagtagagatggggtttcaccatgttggccaggctggtctcgaactcttgacctcaagtgatccacccacctcaacctccccaaatgctgggattacaggtgtgagccactgtgcccgcccctgtgtgtggattctttctggcctcccagatgcaactctctgagaagctgccatgaatgtgtatgttgagcttcagtttcatttactgaccaggaccatggacatcgatcagagatctgctagagagagtctgcgctaaccaacttggcataccatctgcatgctagtagtggtctaggaagactctgctggggaaagcgttagccttttggctcagccttttgcccccgttatgaccagcctagaatcctagacacaaagaacatctaagaaaatatgtagtgcgttcttgggagaaagagatactacagcacaataactgtattagttttatataatgtttgagtatgtaaagcacacttgaaataattaaaatacatgaagaaaatctttttctttttgtgcttgggtgtgtataatgggaagtcataagttgtagtgaaaggggcaaccaagactcttcctgtgctatttaaaagagctgtattttacttattcaggaaaacagagtattgcagaaccataaagattaccaaattttgaagtagacttggctctgctacttacttgttttgtgaatttgggcaagatgatgaaatgttctttcttcacactctccagctaatacttctcaggactggtaatgttttataaaaagcaagtagcgtagcaaacaatagctattgatggttatactctactcccagttctacttagtattgcgtaccagtccttcacctgactgcagagaacacattctgaaaattgcaaaacagataatatatgatgagattttttgtgacattgcattaaaatacagttagcattttgaacactctgtgtgcctagactgtgattataactttttcaggcattatccaatgatgaggatgaagagctatgcttgcatttctttatgctacaggtatgattgttattcctattgcctactgacatgtattctctgagccactgtattctgagaggatacaaagctacacaaagcaaggtccccaggaagtgagtaaggaagataaatgcacaaaaacaacggtgtaatatatcagatgtcaaatgctctaaggggtatttaggtcacaaatttggggaaattacacatggaaaagtgtgggaaagattaatgcttttatcattttatggtctttaaactgagccttgaattagagccttggacttttgtaaaaatgggtgagacatttgaggtacacaatcgtaggaaagtctggagaacagccttagatgaaatgtaaagagtttgatgagaagaagtgtctgtggcaagtgttttgcacaatcccaggcttaggagtttgtattctactttataggcaattttgttattcatttaatattttttatttgtttttatttattttgaaaacatgtattgaggacctagcatgtggcaagccataggctgggcactgggcctacaaagatgtataagttgtgattccatccttcaaaattagacattccagcctgcttggaaggaaatattctgcctcaagaaaatcacctccatacccccaaaacttggctccactagaagacacactagaaggctatattatgaaattggtacttgttatctactttgagttaattcctacgtaatcgcaatggccaaagcccctgcagctgtgggaatgaacagagtaacactgaccttacagcacaaatgtcccaagtcatggctccctcctgtgtaatcacaacacagcctttctctgcctcctcagctactcaagggagtccctgaagtgtgttgcacaatttgatgaattactgtcttttgccccattgtgttctcctctctcatttctttctcttttatacccttactacccacaagctgcctgaagaaggcaccttaccttggctgtgcagccagcactttctgagagttacctgcttccctgcctaggtactggccagggctcctgagcctgcaaaaccttccatgtgccagaatgtgctccatccctctggatcccactgaatttctagtccactttgtcttcaaaggaaacagaaaggctgttctcctccccaccctgcctgcatggtgcacctgattttttagggcctgaagcaacaactcttactcattgaatctcacaaggtgagagagtagcttctttccactgtgtctgaggctctttcctcaacagaaattacacctagtccctgggacttagccagagtacatgtgccatttgccatatctcaggagttcacaattctcctgactgtgttttaccaactaatatcagctcttgcaagtaagcatccatggtggcgaacatcattctgccaatacagtaggcagatccaactgagatactccattccttctctaagtcccctccctccataagaggtcccagtagctggaaacataactgtcaagcatgcaacaaacctggcaaatgagcaatatacaaagcagcatctcacaacatgatacctattcattcagtttggtgggcaactttgggacaggataaggtgttttggaaatgttgttgcattgtcactttctgcagtagaaactgaaaaatgagaaacacactgtgtttgactggaagcccaaaggagacaaaatgttttcagaaatgtgtgcatcatggcctactaatttgggctcataactactctccaattacattcctggaaatgtttttcaatttctttgcgtggaataactagcagaccacagtgctcagaacagcccatggggaatggcattcctgagtagaggttacatcacacctccatggaactagccagcccttctgcagaaccacatgattccctggctcttaatatggtttattaaaaaatcctttacctacctcaaagcacttttcatcaaagccacttttaagctgaagctgaggactaaagaatgcctttaacagaatcctgaaatagcttttaacctgaggctgagagagaaagtgcttttaacctaaagtgctttcctcttaggtgcttcagtgcatacctagcactcagcattagtggctttgagaacacccttaagacccaaatgaaagagactccattattgatattcaaacctgttatgttaatatattaaagtaatatttgaaatcattaagcagttttactccaactaaatttgagtcttttcttattgaactatgcattcatgcaaataaattgaagtcgtaccacctgggattctaacaaatctatgctgatattaggaaaagtacagtcttctttcctaggttttactttaatctagagtgagtcaaaatttctacactttccccacccaaaaagaatctttcaactcttctcaatcactgaatgacacttccagctttagtccatataagttgtgccttaaagataaatcatttagtatttttaattacctgaataaattctgtgtatcaaattttctcctcagacttgtcactcaaacaaatgcaattaataatttcacagtagttttaatccccctataaagttcctacttagtcaagtaagtgacaacctaattgataagttttaacttcagattaatagtaagttatataattgagcatgtgaatttcatggacagttttctattcaaagtatgtaaagaacatacaaatatgggagaaggtagcagaacttaacatttgaattgtattacccttcccttcctttgctggccctctctgtaattctaatgagatgatgacaggcaaatgaaaagcagaaaatatcatcaatccacaatgtacgtcaacagtcagctgaacaaaatttggtcatgttaattatttgaaatacatgaaagcaaacaatgaaaatatgtttccctcatactcaagtgctcatattacaatctttagatagaaatcggtttcttggactacaacccagtgagaaaatattagactaattagtctgtcctactgtggtctgttagaaaaaaatattgaaatattagggtattttccttaaaaaataaaaacattctttataagctgttttaatatcaaaggaaataattttcttttgtaaatttttctcatatttatcttttaatctattcatacattcatttatgcactcattaggcaaccagaaggcatgtaatataataaatgcaataaatataaatacaagtagaagaaactgcattcatcttttcctaccgtgtaaagttttgttgaccttgaatatcattttgtagcttcctctacttagtaaaattgtaatcatttttactcttccaactcagttaccagtgccacaaagctatccctttcttcttcattctcaattagtcctaccttctctttatccaaaagctgtaatttcattattttaatatctttcaactggattatgagctgtatctagtagaccagatactattttactgaactccgtacttccaggagttagaaagaaataaggaaatgaagctggacatgaaatcttgcagtggttttagagttattatttacagcttcttattacttcctattgaaactctcatgtcagtgagtgcccctttggtggatcctgctcttctccccatcttcagaatgttgggttacccctatgttaaggccttggacttcttttctcatttcattcttattctcagactattggacattaaacattcagagttgaaatataccattcatgcagcttcgaattccatctagaggttgatgctttccaaacttaaaacatcagtctcaaacttcagacttgcatattcaaatattgatttcatgtcttttggggtgcttggtacatatctcagatttatctagagtaatccttgattcttcagatcccatgtgtcctctatctcaggaaatatcactgccatgtgccacctgggatcacccccgctttctactctgtctcttccttcatcagtagatcccacctttaaaatatattctaaattcaaccacttttgattacttccattggattcattcttacccaagcaccatcatctcttcctatatttcactacccccctgatgagccttcctacttctcctcttaacccccttaaatctaggcttcacacggcaattagaaggatcatttataaatgtaaatcatatcatgtcacccccccctcctccataatctccatttacttagaagaaactcattcttaatatctaatgtgtgtccttcctgtgacctatagggtcctacctgctttgaccctgaggctacattttatgttttttcctcagccatacttcctcttgttcacaccactccagccactcaggccttcctgctcctcctctaaggaacctggcttacaccagcagctttatacacttgctgctccccttgtatgtacatggctcagtcggtcacttcatttggtgtctgctcagatgccattgcctgagatgccttccctggcaacaccaatagctctctgtctctctgccttgcttcattttttccatagcgcttatcaccatctgacattatatgttaatgtgttttcatgtttattttccccatttacatatagactctgtgaagacagagagtgttcttttcactactccatccccagtgggcattgaaaaatactcatagatggttagattcaatggataaatccaaaaatgcataaaggatttacttggtgaaacccttctctatgccgttgtgattctgtgtgctgacgtacatgtgtgtatgtgtgtgatgttgctttagataagcagagggtgggagagataggtacaaagtattgacaaagttcttgccttgagtagacaaatatagaagaatttcatgcgcacagtgtcccatttggttaataactctttaagatgcaaatttcttcctggctggtgtaatcaccaaaatgcctactgcactagtcagaccaaaattagattgacatctatttccaggtgagtttaggagctgaaaacgaggggccaaagggtacttcacagaagtactgtttagggttgagagtgaaactatgaaaactgaagacggccagaagcctgagaaacaaagagaaaaagtagaaagggctgggaagaacttttctcttctgtcagtcccatccctgaaactcatctttgggctgccttgatcaaagggtgctacccccgcagctaaatgtccagcttcatttgaaagctgcagcaactccgctatccttgttcggggagatcctcttcccccaggctagtctctccgtagcagatattgtcattatcaccagagactttagaatctgttaggtttgatgagatgcaaaaatataaataaacatgtgggggaaaactattcacagaagcgcatatatttggtaactcctatttatttagattccaaactacttagaagttaaagtaattaagctttttcttgtacttgcctcttatgaaaaaaaaaaaaaataagtaaacaaggcaatgagagaggtttacttccagtgcatgtcgtagattcagcagagaatcggcccaatttttgatatctatgtaacataaagcagcaaccgatatttctaatcaaagccccaaagcatcataagttaacgcagtacctcctgaagcacttacagtatattctgtcgtgttttagcattaggcgtattttttctgtgtcttaattcaaaaacataggccattccataacctatagcactaacagaagtcacccagttctccaaacattctcagtaaagttttgggaaagttacatgacatggggctcatgtcgtgagcattttaaaggaaaagaaaagatggtgggaacagaactggagaaaatataaaagatgagagtagaggctgggcatggtggtccacacctataattccagcaccttgggaggccgaggcaggcggatcacgagctcgggagctcgagaccatcctggccaaagtggtgaaaccccatctcaactaaaaatacaaaaattagctgggtgtgctggcgcatgcctgtaatcccagctactcaggaggccgaggcaggagaatcgcttgaaccagggagtcagaggtgtagtgagccgagattgtaccactgcactccagcctggcgacagagtaagactccctcttaaaaaaaaaaaaaaaaaaaaaaaaaaaaatagaaacaccatgctttgataagcaatctaaaagttttgggctgaaaaccaattctcaaaaggaaaaactaatgtaatttatagtttaaaatcaaaagatggaattattaaattgctgaaatcacccatgtttggaatacgattttgtcttccaatatccgctgcctctctattatagcaacttagtaggaaataatctgcccatatgtgtggcattgctgtgggagaaaaattctaagtgaatgctacctactatggaaactacgagggctgtattttctctccccacccattatttttataacataatcctgatcaatgaagcatcatctagagaaacttccagtctagagcgattgatgactggaagttattatgacaatgctgatgctggtggtggccatgaaatgagcaccctgacccagctaccagagttagaagacagtcgctttttctccttcttccaatttcatggctccgctaagcatcttcatttctgaatatctccaagactggtcccctagcctctcataaattcattgaattccttcctacttccacccctcaacatcattcaaataaactttccgttgcttaatacagccacagtgttgtgtttttccgttgcttgcagccagaaaccttaatcaatatacgtcattaccacgatagttggataattgtctgatttgtttttgtgactaagccatttgggctgccattattgttttctgcttcgctctgtgttccgcatgtgtgtgtccttctaggtgctttgttcttcctttttgaagtttactagaatcgctgcaatggccctctctcctgaaagcagagtcacatcattttgaaaagcctgtggagactgtctcctgcataaatgatgataaaaccgtcacattatttgaacatttaactgcctctattgagcagttgtcctcatagttttgattcatttggaatctgactgacagagatcccattactgggtgttctttccataatttgtcaaaaaacttatagcagtgatgagggagaatgaaactaatttgtaatctggaagacttaacctggttatgctgatgaactaacaaaatcggtcaaaaagtttgagagcttaaagattaaaaaccaccattctctagttaaacactaattcattatgtaaacaacatgatttataagggcagtcatgtggagggtctatttatttttctcaccaaaagatgctttcaaagaaaaattgcagaaaatgaattttttttcccaatcaatgtatatcctgccacccctgatcattaagtgctgaaacggtgggatgaagatagaatgatcacactggccaaggtcacaggagtttgcagaagattccaaaaatattggcacccctagcaagaggtgctttctaaataatatgcatatttttatggttgttaagtgaggaagaaaggattaccagtaagcacacagatgggaatataggtgggaagtcaggagctcagggttttggaagtgttcttttttgtttgtttgtttgtttgtttgtttttgaagaggagagtagaaataatccttaatgttgttccaggacaagagacatgagcatttaggggacaaagttcattaatgcttgcctggaaagcagaatgccttttctctccctccctttttttatactattttaagatagaagtttccatggctcaaatggatttctatcattgaattgtcctccttggtgtatgaaactctaggtgtattagatttacaaatggagagcaatcctaccacagcacttaaattcaacaatgacagtgtagttaaatctctgatttcctttctttggacagcactatttactttgcaaagccatgtgatgtgcattatcatctcttctcaattatttaattcattgtctgtcaagggctaatgttgtagtctacattctttccactgtaaatgacagaaacttgtccaaactgtaaaagtcagaatggaatttactagctacttaattgaagagtccaagggacagggatagcttcaggcatgactggatctaggagttcaaaatgctatcaaatatatttgtcttccatcactcagctctgttttccactcttccagaggtggcagcatagcgtctagaagatcagactcatatcttcatagtttaatatctctcataaaaagagggttcctctctcccagtaacatcagaaaaagtctcaggatttacttgacaggatccacttgggccacatgttcatgcctgaaccaattactgtggccaagaagataaaatgcatattcgtcactggagatggagagggtggagtcaacactacccaaaacaaatggcagcaaaatgagaaaggaccatccccaagggaatctcagggtgttcttgccagagaataggaggatagacacaggaccagcaaaaccaattgatatctaccatactcttcctagccagtgtcatctgtaagcagtggatcccattgagctattttgccagacctggtcctgttgtgactgtaatccctttcttgaaacgtttgtccaatgctacatccatatttttgccaggtgtatttgcttgcaataaacagaaatttactcaagagttctattaaaatgggtgggaggggatctcatggtatttatggagctcatgacatgggtatggcaagtgccatggcaaggatacagagtgcctggagtaggcactggaaagtcaggagctgagttggatctgttccatttgcctctccctgcaaactagttcctgtgtccgctcatctgcggcacataagcatcttcccaaattggctgtcccagcccccagggtttaagtgtaggcagcctagagttctcatccctagaaacaaccacctcagtctctcagtatccaaattctaaattttgtagaagaagcgttgctttgttcaagcttggggcacatggtgacctttgatgtaaccaagttcacctgagatactaggttcttgtactccagagccccaccttcttgggtgagtacagcaagtttcaagagaggctataagtgagaagaacagttttggctttgctggtaactggggaaagcaaacatctgccctctagctagtgaaattccagatgtctaggctctttactcaccaagacaccaatggcagtttttcccttgtgagggactggatgcacttgcctggaccaccagtaagtggcagtaatgtacctcccccacttccaacattataaccgctaaaaataatcagcagtgtacttcacccagctccgtggcaataaaaaataccctgtagctgaaattctctcctatccatcccaattcaaaatcctcttccaggtcttatctccacttataactaagtagtccccatatgctagccttttcacctctaaagttcttaaaataggagtctatttgctgtctctacttcttcaccttctcttcaagtcttaattacaactatctgcttttcagtttcactcctctactgaaaccatttttcttaaggtcactcatatcctgaaattgccaaaatccagcgaacatttttcatcttgatctctcataaccattctgctgcatttgaaatacttttccttaatgtctaaattccatttccattctcaagaccctcaagtaactgcatctctgtcttctccagtcaagcaaggaacttggcagtcacttttacctggtggatcagctcacctcctacacccacttgccaaacccgactgaatcactccttcttgccatgacaggtttattgtcttagttcgggtccccatcctccctcccccaagagcctaatgctctgtgacctttcacaaataactcaatatctctgggccttagttccctcttctgtaaaatgaagatgatgatagtatacacgctcaaaggattgcaggtgcatgtgagaattaaatgttagaatatataaagtactttgagccctgcttggcttagtgtagtgtacaataaaccctcactatttttttacacgtatctgcaatagcattagtcatattatgttgtagctgcttgtgacagttattctgtccacctaaactgtaggagatggtgcatcattacattttcaggctggcacacagtgtctggcttataacctgcatgaaatagttactgaatgaataaagcaatctttgcattatttacaatatggagcacatggtaggtgttcactaaatagtcactgaatggaattggatggaattgggttaatctggagagaatgcagaagaggtgccataaaatttggtaaggcataaataatttaaattttaaggtgaaagtaattttctttgagactcctcctgaggattgaaattaaactgaaggcataactccacattcttagcaaatttagaacttttttttctgttttgttcactctccagttttagtttccatgtcctgccaaccctctttgttttcattctcacagcatagcttagatcatatttcaccaaaaacctggactcatcaccacctatgtgagtaagctattgctacatgacaaacaaacataaaatctcagtggcatataacaccgagcatctatttctcatgtgtctgtggtgcaggcttgactgggccactctgctttaagctgcaggtctgactggacttgtctcttcactgagggttgccctcagttctgtgccatatgtatgtattctggagcccaggctgaaggggcagcagctccccagggaagctcttctttggcaatagcagagaaacaagaggatgagtagaaatctgcaatgcgtcttaaggcctcagtctggaactgacacatttccactcacatcattccaaagaagacatttggccgagcccaatatcaaagaaatgggggaaaataaacactgcacactctattgggtggtacgagatggttccatggcaaaggaggtgaatgtatacatctaattcagagaagacaagaaggattgtgcacagtgattacacctatcacacccttatcctgattctggtcttcgtaacatctttcctaggtaatcacatcagtcgtttaactaatctccttgtgcttcatcttccccactatattaacccccccaccctcccttttctttacaaagtgctaccaagtaaaccttctcaagtagagtatgattataatgatcactttactaaaaaaccacaatcacttcctaatgtcatgtcatatgcttttggctgcagataatagaatacctagttaaaaatgacttctttcatatgaaaataagtctagataaggtgttttagtgttggtttaaaagctcagaagtgtcatcagggtctcaagttttgttgcttatttttaatacattagctgctgttcttagcactcattgtctcatggtgacaagattgctgcaatagctccaagcatcacatcattgcaaaatgatattcaaagatggattaaaagaaaaagaaaaaagacttcttatatatccctttcctttcttcaggggaaacaaatcttttgctatatagtcctgagtcactttcctagacatttcattgaccagagctatctaatcacccaaagttgcagagcaggtaaaaatcaatagagatgattttcactttctgtcatatgagtggcttctaaaaacaagaaagaaggtgggagaggaattacttatatgtagaaaatcaatggtatctgcacactctcaaataatttaacttacctggcaagatttaagatgctttataacataacctccatctcttttataacttaatacatcaagatttctctaagagtgaatgtattcctcggcataccccagtcttcctatcattcttcccatcattcatgcatttgtttccttcctttcattcccgaaaatgctctttgttccctcttttacttgtctttccttatctttgaggattcagttattcagagaagggaagcactcaaggctgatctgttgccccaccacatgctcccacattgcctctgcgtttccccagttatagcagttttctcatgataaaatgttcttacctgtttacttatatactgcctctactgggcaaagatttagaaaatagggaatgagtcttggttgttatattaccagagcctttcctagctctaaatacagtatagccactcaagatgttcttttgcaaataactaaatgaataaaagagtaaattccctggaatgctgttgtctgtatcttctcatatccacctgtctaaaacaaaacaatttctccaaacacaaactctctctctcccaccctctgttgtacaaacatacacacactgcacaccacgtctacactaaatgacacaaaaagacctcatactaaaggacatttttcttagcattcagtaccttttatgacacctgctatattcttttttttgtatattctttgaatacttttattagccccctataatattacaaacttctcgatattgtttttacaactcaatatgcctacctcattgctgtgaagatagaagataatatttgtgaaattgatttgagtaataaaatccattaatgggttttttactttatagcaattcttcttcctgactgtaatctccagacaatgtaaatcatttgatctgatctactgggttattttttcctagataatattttatgtcattctttcttggagtggttacacagtgttttgaacaagtcattgttacttgaccaaagtattcaaagcaaatgcccattactatttcccacttctctatactatgtccatgtgttttgagcttctttctgttacttggataaaaatgcacatttccatattggagttttgtttttgtttgttgttgttgttggtgttgttttgagatggagtctcactctgttgccaggcctggagggcagtggcgcgatctcagctcactgcaacctctccctccgggttgaagcaattctcctgcctcagcctcctgagtagctgggactacaggcacgcgccaccatgcccagctaatttttgtatttttaatagaaacggggtttcaccatgttggccaagatggtctaaatctcttgacctcatgatccgcccacctcagcctcccaaagtgctgggattacaggtgtgagtcaccatgcccggcctggagtatattattaatagtgttttagctttaattgttccctccatgttgggttgtcaccaattcaaaccattatgttttcctaagaaataaatgaaaattatgattcattgaattctctctacactcgattttgagtatccccttataacaatatatatcactgaacattattttatgctgcattattattctatctaattttacatatactttaaaaaatgtattgactacctccactgatggttaagatgatgtcttgcagtccctcattctacaaatgtttattgaacttctagtatgtgccaacactgtctaggtactcaggatccaataataaatggttgagatatgacgcctactctcctgggttttgccttctaagcaagggaaacagctaagcagaaaacatttcagtctcatatgtcaagtggagatatgtgctctaagaaatgtaaggctgggaaagtggcatagagaatggcatggagtggagccatttttttaaaggctggtaggaaaggctgcaataagaagataccatttgatcagagacctaaggcaatggagttccatgaagaagaaaatgcaaagtccctgcagcagaagagtgcttggcagccatgagaaacagcaatgtggggctattacaaatttaaagacggggaggaaagacccaaatgaaatccattaattagtggaggtcagattatgtaataccttataagttacagtagggactttgatttcattctgagtgaaatgggaagcccttggacccactaaatatttgtttcattatcagtaataaacagatactatctcaatagcaaaacccagaaattgatggtggtgagggttgcacaacattgtgaatgtacttaatgccaccgagtggtacatttaaaaatggtggaaatgatcaattctatgttatatgtgttttaccacaattataaaaaacaaacatctgtctttaaatactgcaggccagagtctgtgcaagcactggtgaagacatagatgattcagacactcagaatctgctttgagagaatctattccatatattataaatgtaaatacacaatgcaaggtagcgtcaatcatgttccaaatgagagggctaggctaggatttcacagtgggtattctcggaaacattagtctggagacatgctctctgaaatcaaaggatgttgctcaaataagtttgggggaaaatgcatccttcacccctcatggggattcacagcacacattggcatatcatgggctttaaaaataaatgcatgttaaacctgtctaactttgcagaacctaatgatgtgaaaccattttgttcgcaggccctttttcctgaatcatctattaacagcctgagggtctggtattccaaagaacctgtgtcacaggagacacaaagctgagataggaaggagttagtgaagaaagtgtgatctgaactgagccctaaaggaaaggtgatagttagattagagaagaggaagggcattcaaggcaggagaaatgctaagtaattcacttcgaagcaagtctcctagaacttgcctcctcatatactattgagttgcagaatgaatgtcctaaatatactgataacattgtaattttcgtaaccattaactggtaaacttcttctaaaacactcagtataccaaagacactaagataaattattttgcaaaaattttctcaattctttgtctttcctttatagaccacaaaattaaggcccagagagactataacttacatagtcatccctgcctaatcgatgcctgagcgtcagttttctcactctggggcgagggtcctgttccatcaaggagggagttgtggtcttcatatgtctgccatagacactatggaaataaagcaaaaaaaaaatcttatgcaagatgaagatttcagcatgcaatggatatggaaacggaatcaaattaaagaacaacgcaagcttggattttaatgaagctcatctttgtttcttttgcagatcaaatttttggctctcatctgcacaaagtgtgtgaacgtgaaaattccacagttccgtggtttgtaaagcaatgcattgaagctgttgagaaaagaggtgggtgactgaatgtgcagcagttccccccattactgcaccctctacacaaccaatactcaagttagcagtgccacctgatttgtctgagaagccatgcaattaaaacttgacttgtgttaatcggttaagaggatcatctttcttattaacttcagtttgtttttacaatagggacattagtaattctcactaatgttcttttttgtttttaatattttgtctgtctgacttactgttgattcaagtgcaaacttcttgttttcaagccagtgataaaacattcataaaatatcagcactcacagtgttagaaccttcctaacattcatgctggtagacgttgtgccagaacaatttttggtaagcccccaacattacccaagttaagcaaatagcattctgaatcacagacagtgatatcccaccttccacatgtctctgttcagtacagaatacgctaacgggttttttcaggaacaattaaaagacacacctcaaaagatgacctttgattcctctatttcagcattctgtttttcttctgaaattatttcatcttactgaagggaacaaaacaaaacccaactgaatcatcatttctactccactctatctgtggggtgtttttccttcaaactatgacttcattcattcaaggtcatttttcctggaagatacatatagtagatgcagaatcttaaaaaatgtattgtataaaaatgcaaggcttcatcaccatctgttacaagtttacaacatattcccaggatctagggggatatatatcatgtaaaagatagaggtgttttcagaaaaaaggattggtgaacctattcccatttccagctcctagtctcttaagacaatagaaccaaggggaaaaaatctttacccaataatctactaggaaaaagccattttaattctctcagtgttacctggctttattataaaagcataataaaaatggtctgcaatttctaactcctggaaattcatactttaattatactgtaaggacagccttgggatcctattattcccctatcagtagggaatgagagaataacaagaaggggaagagtgggtagggaatgtggataaagagaatgactttggggaaagcatatcaacacatcagagagaagagcagagagtacagtgagagtagaaagcagcaactgcaggatgaacatgaggagaggtatctgtgagaaatgaagtcaattggagtttagagaaaaatgtttttattgcaagttgcaatttcatttaattttataagtacatttttaggaataaatattctttggtaagtacttaaagacaaaatggatcactgagaatattataaagttattatttccaataactaaattgtcatcattttcaggaaatcttcatccacttataaatactcagccctgacagtgtgagcactattagaccaaaaacccaaatagggcgttggggaagcacataataagatgtgtgcatgtgtaaagaagcgctccattcctcccgatttatgtctccaccctaggcaaaacgaaaaactgctagatgcagctttgcggtgtgcagatattataatattgcagagtagaaaacgtctataaatagaaaccatgtcttttgttcatggcattttgttggtgatttttaataaaataagacaatgtttttgctgactggagcaatcacatctagcattatatttcattgtccctgtgtttactcttaaaatgaatttgtagatccagcactaaacaggcgctaatcacacatatgattattaaaataattcctaagcattttaatgaaactcaaagactttccaattccacaaagcaactgataattcaaagcactttggcagcatcagcttaaaggaaccctatggaaatattcagtaaaaactaagaagcacaagataaacctctcacatcattgcaagatttacaagtgtgtacttttgattataattttctatgatcattttgttggattaatattcttatatttatacaccaattctatttactcaaagtgttgtttttacgaaattctggcataaagcatttcaggacagaaataatttatgtgaatctaagtccaatgtttatgcaggcttctgatgacattttatgctggggttggtattaggaagtagcatataaaggcgccaagtctctcagcatggctgggactcagcatatctggatccctccttctaatggccagatactctcccagccaagaaactcaactgcagagtcatgggaaatgctgatggaccagttatgggaaaggaacatttaatgaaaactatgtgtttactctcacagtcttagggaaatggtcttgatactcactacatcggcacattggctgttataaaaaagatttgtttccttctctttttttttcttgtgattattttttactcctttaaaaaaacctacaaattgtggctatatctctaaaatgcttattagatggatgatttaaaatgaaacattatcaggaaggcagatctcactattcattcattaattcattcatttatccatccagtcagtcagtcagttatttgtcttacctgtttgtaatgaacagagccaaattgctcacacttctgtagtctctccaaggaaattctacccagtacttggcaaaagatgcattctttattcatccctggtaaagtgatattagttacattttaaattttgcaacttttggacatgcctagaagaaaatctaccaataaactgaatgtgaaccaatttagctaataacttgtttagtatgtttccttatcttgatttggttctctttattactctaaactaccagagcattctccttctcaccaactattataactagattaacttcatttctgtggtttctgacattgtctgctgagccttgaaaatacaagcaaaatttggaagacaaactgttaaggagcatgttagtctttaaagctcttccaagtggttccttcccgcttgccttgcctttatagtcgtagagcatgtatatgagaaatcataattagccaatgaaaaactcaacttatgtttcttttttgaagcaatttctgtgaaaatattaaaacacggttctgctaattcttaattcatatcctgggtacaatgaccaaaagcatgagatcatctgacactattttggaggtttgaggaaacaagcatgtagagcaggggtatctaatcttttggcttccttgggtcacattggaagaagaagaattgtcttgggctacacatagcgttacatacactaacgctaacaatagctaatgagctttaaaaaatgcagaaaatctcataatgctttcagaaagcttacaaatttgtgttgtgctgcattaaaacccctgggccatgggttgggaaagcttgatgtagaggaaggcattgtgacatatagtagatacaagcagtgagaagttcatttttcactatgttatagaacactttgtgtagtttatgatgacgtcatatgtgtagaaattgcttacttaaaaatgcgatcacctgtgtctcttagatagaagggcctaggagacctgaagtaaacaaagtatatattttaaactggtataacaagtaagaccttaattcatagttctttttatgcaaagcatgtaattgactatcctttgttgaggtccattatttggaaagaagctttatacagcacgtgacaccttgtaagtactcaataaatattggttaaatgaagcaatcgaagccaaatagctattgagtacctactttgtgtcatcttccatgttaccagctgataatacagaggagatagacattaagcaaacagacacacacggttatgtatgttagcataaactgtgataagtactatgagagaaaagaacagaccctacaagacagaagaaccataacaataataaaaagcagggaaatacgtgtgtttaaaaatgatgtaataaaccttgaacgataaacacatatttatctggttttatcttcattataagaccaggagacatttaattttgccttattttgcaagttattttcttaacattgtgactatgtgatatagggagtcctttggtgtgagatctaaaaggacatgccttaagtggcgaaccagtcatgtttctacccaataataccaaacatgcattttgccaaatagatattttatataagagtagtgttaactagataaatgagcatatttctaccctaaagatatttttatggatccaaaatttttttggttttaagggaataacattaatttttttaagtttgtaatataatttagattagcattcatttggaatatgtcttaactcatacttccttcatgattcccggttctggttaatatgtacccaaactattttaaaacattaaaatgatacctagagatttattgtacaacagtgtgaatatacttagaattactgaactatacacttaaaaaggattaggaagagaaattgtatgtcatatgcttttgaccacaatttttttaaaatgaaatcatgtttttcaaatgtgataattccaggtataagcaactttgcagaatgcctcagcagatgctaatcaacaagaagtttgccctttctgtcttttttctggaacacgaaatactatgacaggaatggtacacaaagttacatatttgacttggtgcctaaaagccaccctgggatccataaccttgcttaaagatttaagaaagacctttagtctacttctgagaaggtccttagcctcaaaaactttatctctcaacttgacttcttagcagctgttatattttttttgctgtcgtttgtttgacaggatccagttataggttccgatgtctgtttaaagaaacaaggaggctgttggctttaaaattccctcattgcttgtgtgatcagcattttcccaggcttttctacatagtttgccaagcaaagggactgaccttttgtagcaaacactttttcatttcaaaatgctcactttgatttttgtcccattttatgctcattccaaactgtttacaacccactaaaaatgactgtgaattatatgtttgtgtaatggattccttttgtggtctgagtggaatgtttactttgaacaattagttatctttgggtagattatagcaacttggaaaaaggatggctaaaattattattataccttaactgtttcttttttggtaattcctctactgttaggagaagtttgagagaatatgaaattaacaagcctgtgacattataaatgaaacctgtttaattatgtgactatttggatatgtgtgttaatatcacgagaaagcgtggctggacacctactcaactcagtaatatacttatctaacaaaaatgtaaaacttggcatgtaaataaatacatgaatatttgccatatacatgttgcatttgcatatgcacatgaatgtgttatataaataacagacatgttaatacagctattgtacagtacccattgtacagtatagtagcaagcattgtagttgttaatataattttcctgatatttgatccagtgcaccagtctgcctcttgagatcctaccgagtgcttacttgcaaaaatcagactttacatagttgtttcccgttgcctttgaatccaggccccgaaactgcagatcatattgccttccctagacaagctctgctcccagttctgctaattttatactgttcattctttcccactttgggataatctattatagttggatccaggcacgcactaaaggctgatacttccatgaagaatgtgcaatttgtactgttaagtttgtgatgagattcttgaaaacttttatgattctatcttgttccagagagacttctgcttgctagttttataagcagtgagtaaaaaaaagtaacaaaaacaaaacaaactgataaaaattacatgctccaaaaaaaaaaaaaatcaagagtacaagataagcactttttctttttccctggagaatatttgtggactgaacaaaaatgtttctgaggtcagtgacctatgtttttgtttttttttttaagtgtttgcttttcatgccttatgttaggcatctgcatgcatttacaatggaggtgatcttaaagaagctccatgaaagtttgcagtgaatctccttggcttttctgagttaaaattaagaccagtttagtgctttggtgttttgtgttttgttctgttttgttttaatgcagccacaaagactgccaccttcctgacagcacagtgttgtgctgggtccaagctggaattggctctttggggtagtcacgctggggcctctgtgtctgtaagaaagccacatttagggctcgaggggaagacaaaatcaaaaaagaataaacaggaaacagccagcaagagtataaaagagaaactaggaaaagacaaccaaaagaaatcagagatgacaaggtggagaggcgggggaaaagctgcattttgcaattaagaaaacaaatgtggataagaggacatgcttgtgaggtctgtaagaaagagaagacaaactagtgaaaacattgccatctctgccataggtacctgatacctgctttgctgttccagagaaacttacttatgctcaagaaaatgcttgaaacttaaaccttgcaatttatggcatgcattgaatgttcacaaactctgtatacggagctggttattaattaattcacatatttattagtgacatttaacagagtttatctatgtctagcaatgcatgacagtcttattatcaaaaagaaagcttaaacataacagaagttaatgtaggaataaacgtgcagttcaacaaccagagaggctatctaagaaatacagcaatgtggctctggtcaaatcagtcagcggatattcccacactttaaaatccacaatgcatcagaataaataatgtcgcttcccagatacagcctgagtctaatttccaacctccacccccaatgtaaagtttaggttcttaacatacttttcccttggagtcagttggaaggaacagagccaaaattaagaccctaggaaattagcttcttattgtgtatggggaatttaaataatgcaacacctcaacttaccaagatgcaatactctcaaatagcctatactggtgtcatttacacagtgggagttctaggactgggagttttcccattacaaggccctatatgcagaacttaagagttccaccataaaaataatcttggctgaaagttagcaggatgttttagcctggaagcaaatgtttacaaaatttgagaaaaaattgcatgcatttggaaagctttcaggttttcaaaaagcagaagcaaataataataaggcagtcagagattttcagatttttttgccctagcattcaaaaactgacttgtagcttttcagtagaaatgttttgattcttgtcccataatatgaactgattgattaaaaataatcaactttcacaacagtgtcactctgttttatgaaataatttgttgtttactggtagaaaaagaatctatacattgtatttgtgtaggtatttccctagggtttaaaaattaatgataattaagaaaccaaattaattcaggaagctataaatgaaacccaaatattatactcctttgtggatttcctaaagcatgatgttcttttttaaagtttataccaaaaaaaatgacattttccaagggatttttatactttcaaattgtatactcaatttaagcattaatcaattagtctacacatatatggtaaaagagacatacagattccaggtgaaataattacagtggtctatatgaatgaacatgacatatttttttgtacaggatatttagaactttttacccatttccttaaaagactcatgtcttagagattcctctaaattctttgggaggttatcttatagacgagtaggctatacagttaaagatgtttttcttgggttcaaaataatcatttattttcttgttttatctctctttgcctgattttatacgtttcaagtcgcttcctatttttggttcagaaaaaaaaaatggaaaaaatcaagggctggacactttgagaaaaaaacctaactctgcaaaaccaaaatagctctgaaatgataatgctggaagaattcttgaggttatagtagaccagagacccaatatgtaaatacacactcttttttaagaagataataatgtcctatatctagggtgtaagtatatcttatagaagaaaaatatttaaaatattaagtacatgatgtgctccctcgtgtataagccaacttctcatatggtacctaacacataatgaattctcagtaaatggtgtataatcagataaattatattcaacattgctgaaatcctcattggagagttgcacaccattgctaccgatgcatatagttgatagtataaaaagatcaatcaccaacagttgttggttgaaggcagctcagagaataacatggtctgtaaatccactttttaaacatttaaacaagttcatttctgataagagtatatcatattgttcaataaggtaccattcttgctatcaatacacagctatgctaaacaattgaagttaggtttccttaatgattttattttcatcgatttttggatactccatttaagttaaccatcagcaactactaaaatatccattctctactcattttcatcagaggaagtcatatcccattaggcattgtttcaattccaatagcctgctgtttttaatcaagtaactgaatggtaactatgacttgtaattgacatgcctgagaatggtcaggcttaggctcagttcccataaccacacagcaagttaagccccacatcttttcctttaattcagacttggaatgccatgttagtgctgttttgtattagtttacttccctgtgaatatatcaccctcttgattcattgtttgttttccatgtacctctcaggaaatttttatttggatgataatttttttgagttgatagagactgtccaataattaaaataagaaatatatggtcaatacacaggatctatcaatttgaagttaatgaagacagaatacatgattttgctattggatattgatttcatttcctccaaatttacttcctagcagaaaaaaaaagttaaactctgctgttgctatcaaaagctctgtaaagacgttgaatataccaatgttattaaaattggactgttgtctttcttcttttaaaatgatgttgttcttgttatattttgcattttctgacagtttgggatgactaactctttagtctccctatagaacagttgcacacctaacagatggtattgtcacgacaacagtgagatttttttcttccttttgtcttgaaggtaggcatttgacgatgtatttgatattacatagtctaatattggagtccatgtgtttggcctagagtttgacagcataagaaacattcatttcctctggatttaattattgactctgacatttcatgctactggttttctcagggtgatctcaattatacctaaagcttcagtgagcccttcaatgacttcagagctcctatatgcaaataattactcaagctgtttttttcccactcagatccatggtctagaaacaacccttcttgaatttccctctgtctcctcaaactgaacttttttgaactaaactcatcacttttcccaacaaagatgttcctcctattttatttcttaactcagcccgcagcattacaatctatattccccattgccctagaaagaaatatgttagacatcttagattcttctctctcattacagacagaatcattcaccaagcctcatgagctctactttcttactatctcttgaatctggttcttcctttcactttctgtgaccttgattgggcctccatacttccttttgagataaatctcctaaggaggtctttgcctttgttcttatttctgcccaggccactcttttcaatgctgccaaaatgatccctcttaaatacaaataagattgtgttatcccctcttagaatcctccaatgattcattgatctcataaggataaacaaaattccacactaattacccccataaaaaaggataagcatatgacctctgtctactgttcagcttcatatccttataagctgctttctatgctccaggaataccaagtacatgaatttttctaatggcctattcctttcccatgcttttctttctccctttttatccatctgccaaattcacattcatcttcttgtgaatatcacaagaatcaccttctccaaggaatattctctaacttaaatccataaccatcccgccatgatctcttgaacatcattagccccttcctccacaatattccagtgacagctttgcttttcctaatagagcccttattgcctggaactacaatggcttgtttcattatctgtttccctatctagagtgtgagtccttgagtctaggaattatggttggatcaccccgtccccacagtgcttagcacactatacctggcatatgatagggcctcaattcataatggatgattaaatggatgaagagacaaatattatccaagctttctgtttatccactcatccatgcctctatccttagagaaacaaagcttacagattgacgattcagtgacctgctagaagagacaatgattaaatgtctctttaaacataacgtaaagtcatattatccagaatgtaaagaaattaccttaaaagtgaaagtaagggttttgttttttgtttgttttgttgttgttgttgttgtttttccagggggcatgatatatatgtagaccagtatgacataccatatttgtaataatcttgaataggataggacggaaatagggcaatgacctttgtgtccaatacaggtttcagacaaaacatactttctcatttttaatagggagaaaccagtctctcaacaaataatgttaaattgtttcataaaactgagggattcgactaactaaagccaaatttgatgcttttgagaccgaccagtgtcataagaatagcactatccactttctggttcaaaatattatgctcttttttatataaaccttcaggcattgtgcctacttccttgtaagtttgtgtataatttttcccattatcaccccctaggtaatctttcaccatcaccactttccaggcatctaccatccactgaatagccatgtttctgattatcttctcccaaatgtatcagcttgcattatttaaagctgaatctcattttattatttcctgctcgtatttctaaactccttaagtccatttgtatgattcttttgtcctcacagatgtccacagttcctcccaatttagtatcatcagcaaatttaattaatgctctgtttacctctccttctaatgaaaccagtcccttgtttcatttcatgatacaaagtaaaaaatgtattggcaataaaacagtccaaagaaatgtttcctcactgtaggaggggaagttaaggatacagcaaagaacaatgtggtgaggagtggacagtgcagcagggtggtgagttagtttgctattgccctgaagcaaaacctttttcacagagactacactttggcatattgcctgggttgatgctgtgtgtgtatgtgtgtgcgcgcatgtgtgtgttctgttctggaaggtagctttaatatcctaactgaggacattttaccaaagatgtatttatgaatatatgaaaagcatattgaaaactataaatataaatgtaattatagctttatatacattagtatttatagttttaaatacaataaaaggtaagctagtaatgtctgattcatggtgtagttacaaatctagatatggatgcatacatctggatatatacagacattcaatcattttcagtgggctttttctagcattcactgtgatgtaaatttatctctgtccttaacttgattagtgttttaaatccaaattaacccttggatttgaatcaaattctttgtaaatagcaggtttatagggtaagaaaaaagaactttttttcagttgtatccaacatgcaaacttcaatcaaagaatattttaacctctacaattaataggctagaaaattgagcttgatcagagtaaaaggcctaacctgctaacttgaaggtaagccagcatatgttctaaaagttacactataactctttgaaggtgtggatatacagatattgtgtcatttacatgaggaaaacaaagatgacatttattaagcactcataatgttagtgctttccagcatacataccaatactgtggaataaaattgtacattaattactacctgatacttcatagtctgtattcttaactccagcaaaatctcataaacgtttgtcaagtttcatattaagagtcagtcttcagaatgtggatggattagtataaatccagtgactttactgggaaaaaaagtactttcaagtttatgctttgaatggacagacagatgttaagatcaagatctctattgttgtatacaggagacaatgcatgttcacaatgctgaaatgaaggctgatatgtactttccatacaggacaaggtcaccaaagatggcatcaccaagggatggtgttaacaaaacagtgactgggaatattgttaggtggttacagcctcacattgcttttctagtgagaaaaatatctgatgcataatgcatccttatgagagaattttctcagatgccaagattttacaggcataacttccataagctttaatgggaatttcctgccagcacctgttacagtatagagttcttacttttcacacataatccaagactgacttggaacactgacttggaaaaactaatatagtgaaagcttcttgtaatgtttcctcacatataatgttcatcttttaatctttggtctgatgatatatgtatgtccatgttttccattcaaattcttttcccaccagtaaggtttcttttcacaagtttttttatggatgagagcagaaaaagcaattcttcttactaggtaaactagtggaaatgatacataaaggggaaagttattaggatagcaagtgacttaatgctagaaatcaactattcttgacttaaagtagttttatagatatactgtagactcctgagcagccaacaattagagtaccgcatgcaaaaacaactgtcagggactccacagcaaaatcacaggtcaaaataatatagtttgaccatattttctcatatatttatagactagaatatggtaacttttaatatttaaaaagatattgtgtagatataccaaaggatctattttaatatttcaaaagatattgcatagatataccaaatgggcaatgcattgggtagaggagaaagttaaaagttttaaatttcatacatttctaattaattccccaaacttccgttaccaaaaaactcaaacaaaaacaggtcacagtgctcctgcttaactagaattattggagattgtacagaacgactattttatgaacaacaacttcacttttaactttttcactttcttgaagtttcttcttgtctagagtttctaacacacaatgacacattagaatgaaaacagacatttatactcaaattcctgaatcatttctgatcactaccctgagtgacaggatgatgagcagggggaatgcttttcacttgttgaatgttgaaagacagtaaatttttagttcatttttatgacaagatttttttaacaaatgttggcaggtaacatgattaacgttggaagaactctgaaaccccgaaaacaagagaagacgtgtgaacctgttcatttaatttctcacggggcaaaatacgggaactgaaggagaacagtgcattcgcatccttccttctctttctttggtgtgtgattacattactccatgatgtcaccttgagcccctgtctgacctctgatactctccttctggcacacctgcctcagaaatatcatttatactccagcttgatgttcagacacccttattcacacttttgagtattaccttgagcttaactgttttaaaaggtatcaataatttgtctcctattagagtatgttcaagcaccaggaaagaggattttgttttgtttcatttgataaggcaaagaaagggaaaagggagtctcactgacacttctaaaagcatgctgtgtttccaagcttggtaccctcctcctctcaaggggttttgactgtagcacactttgctcttagtggaaataaggttattactttcttttgatactctggccagtgaattaatagaaatgcatttgtttctgatgtaattgcctttattaaggtttattttaaaacttaagagcagattggaaatctaagacctcgttaagtctgccatagttcaaagccatgcattaccagctgaggccaataagccttaggttgttactggggaagacttaagacttgtggcattgtttgtgtatacatcactggctccatctgacacctctcatctctccagtgagcctgatggagttaggctttgtatccccacccacatctcttcttgaattgtaatctccataatccccacatgtcaatcgagagacgaggtggaagtaattgaatcctggggctggttcctccatgctgttctcataatagtgagtgagttctcacgagatctgatggctttataaggggctcttcctccctcactggcacttctttcttccaccttgagaagaaggtgccttgcttccccttcgccttccacccttactgtaagtcttccgaggcctctccagccatgctgaactgtgagtcaattaaacctctttcctttataaattaccgagtcataggcagttcgttatagcagtatgagcatgggctaatacagacccagtgatgtatacacagacaacgccacatacagtaaaactgcaggagagtgatacggtgagagaagtacctgtattctctgcagtccttacccagagaagagacaggcctggctcagagatctgatgatttcatgggagaatgccatgaaatattcacgacatttcaatctatagaaaaaaagacctatatggggccaggaaaagtggctcatgcctacaatcccagcactttgggaggctgaggtgggcagatctcttgagctgaggagttcgagatcaacctgggcaacatggcaaaacactgtctgtacaaaaaataccaaaaaaaatagccaggcgtggtggtgtgtgcctgcagtcgccagctacttgagagcctgaggtgggaggacctgagcctggagaggttgaggctgctgtgagctgtgatcataccactgcactctagcctgagtgatagactgagaacctgtctcaaaaaaaaaataaaaaacaaaacaaaaaaacctatatgaatttaggaacctcagtttagagcattgtactcacctgaaagaaaaattattttataagttttccctgaagatgttattttttacaatttccatatttctaatttccttatgatagaaaattactataagaataaattatgttaaaataaattgtgattaatcaagcttaaaaatgtgccccttctcccccaaatttctaagtacagtaatatacttctttttttctgtgtcttggtgtgtccaaaatagcaggtaacccaggaagggagaaactttggataatagcaaccactcttttgaattcatttgaagccaacatgttgtacccattttccctttctgttcctctcccattatgtacttgcccccttattctccatctttttctctcccacatcctacacaagtaaactcattgtacttgttttcttttcagttaaagtctgctcccagtaaaggatttaataaattaatccacatactaaagcgtatatgaccagtgaggtttgatgtgaaatcctccaataggatttcaagaaaaaaggacgaattctaattgcagaattttaggcataagcaaggctgtgtgaaagaaatattttaagaaagaattatcttcccagattttctgaaaataaactgcaaaagtagcctctataattaatattaacttacgttgggaaccaatggcataaaatccaagtcttcaaattgataatctttcatttctatctctcatggcacttcaagatttagctatactgcctgattatggatttcctaacattcaaactcaatggagtttctaacatcaaaactcaaactctgccatcccctggaggaaacagggaaattaagacatcctttatttacatttcatacaagagaaaacatgagatacatttataattgatatcttgccactttagaaagtcacatatatggagttagatatttcataaatgttgtatcaatgaacatcagcatatataaaacgtcttagttttttttaaatttgtggataatgtatgtttttttcacatacaacatgaagttttaaagtatatagatattgtgtaatagttaaatctatgtaattaacaaattacctcacatagttatcatagatgagagcacttaacattcactctcattacatttttcaggaatatatgtcatcattaactgtagtcgtcttgctatccaatagatcccttgaaatttattccttctagctaattataattatgtatcctttgaccaacattttctcattcctaccgtccgcctaatcataccagcctctagtagccaccattccattctcttcttctatgaggtcaacctttttgaattccacatgtgagtgagatcatgcaatacgtatttttctgttcctggtttatttcacttagcataacgtcctccatgttcattcatgttgtcacaaaagcaggatttttttttttattatttaagttttagggtacatgtgcacaacgtgcaggtttgttacatatgtgtacatgtgccatgttggggtgctgcacccattaactcatcatttagcattaggtatatctcctaatgctatccctcccccctccccccaccccacaaccgtccccggtgtgtgatgttccccttcctgtgtccatgtgttctcactgttcaattcccacctatgaacgagaacatgcggtgtttggttttttgtccttgcaatagtttgctgagaatgatggtttccaccttcatccatgtccctacaaagaacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgagatggctgggtcaaatggtatttctagttccagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggctggccagtgatgatgagcattttttcatgtgttttttggctgcataaatgtcttcttttgagaagtgtctgttcatatcctttgcccactttttgacgaggttgtttgtttttttcttgtaaatttctttgagttcattgtagattctggatattagccctttgtcagatgagtaagttgcaaaaattttctcccattctgtaggttgcctgttcactctgatggtggtttcttttgctgtgcggaagctctttagtttaattagatcccatttgtcaattttggcttttgttgccattgcttttggtgttttagacatgaagtccttgcccatgcttatgtcttgaatggtattgcctaggttttcttctagagtttttatggttttagatctaacatgtaagtctttaatacatcttgaattaatttttgtataaagtgtaaggaggggatccagtttcagcttcctacatatggctagccagttttcccagcaccatttattaaatagggaatcctttccccattgcttgtttttgtcaggtttgtcaaagatcagatggctgtagatatgcagcattatttctgagggctctgttctgttccattgatctatatctctgttttggtgccagtaccatgctgttttggttactgtagccttgtagtgtagtttgaagtcaggtagcatgatgtctccagctttgttcttttggcttaggattgacttggcaatgcgggctcttttttggttccatatgaactttaaagcagttttttccaattctgtgaagaaagtcattggtagcttgatggggatggcattgaatctataaattaccttgggcagtatggccattttcacgatattgattcttcctacccatgagcatagaatattcttccatttgtttgtatcctcttttatttccttgagcagtagtttgtagttctccttgaagaggtccttcacatcccttgtaagttggattcctaggtattttattctctttgaagcaattgtgaatgggagttcactcatgatttggctctctgtttgtctgttattgctgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcttaattaaatgccctttatttccttctcctgcctgattaccctggccagaacttccaacactatgttgaataggagtggtgagagagggcatccctgtcttgtgccagttttcaaagggaatgcttccagtttttgtccactcagtatgatattggctgtgggtctgtgatagatagctcttattattttgagatatgtcccatcaatacctaatttattgagagtttttagcatgaagggttgttgaattttgtcaaaggccttttctgcatctattgagataatcatgtggtttttgtctttgattctctgtttatgctggattacgtttattgattttcatatgttgaaccagccttgcatcccagggatgaagcccacttgatcatggtgaataagctttttgatgtgctgctggattcggtttgccagtattttattgaggatttttgcaccaatgttcatcaaggatattggtctaaaattctctttttttgttgtgtctctgccaggctttggtatcaggacgatgctggtctcataaaatgagttagggaggattccctctttttctcttgattggtatagtttcagaaggaatggtaccagttcctccttgtacctctggtagaattcggctgtgaatccatctggtcctggatttttttggttggtaagctattaattattgcctcaatttcagagcctgttattggtctattcagagattcaacttcttcctggtttagtcttgggagggtgtatgtgttgaggaacttatccacttcttctagattttctagtttatttgtgtagaggtatttatagcattctctgatggtagtttgtgtttctgttggattggtagtgatatcccctttgtcattttttattgcgtctatttgattcttctctcttttcttctttattagtcttgctagcggtctatcagttttgttgatcttttcaaaaaaccagctcctggattcattgattttttgaagggttttttgtgtctctatttccttcagttctgctctgatcttagttatttcttgccttctgctagcttttggatgtgtttgctcttgcttctctagttcttttaattgtgatgttagggtgtcaattttagatctttcctgctttctcttgtgggcatttagtgctgtaaatttccccctacgcactgctttgaatgtgtcccagagattctggtatgttgtgtctttgttctcgttggtttcaaagaacatctttatttctgccttcatttcattaggtacccagtagtcattcaggagcaggttgttcagtttccatgtagttgagcagttttgagtgagtttcttaatcctgagttctagtttgattgcactgtggtctgagagacagtttgttataatttctgttctttcacatttgctgaggagtgctttacttccaactatgtggtcaattttggaataggagtggtgtggtgctgaaaagaatgtatattctgttgacttgtggtggagggttctgtagatgtctattaggtctgcttggtgcagagctgagttcaattcctggatatccttgtttactttctgtctcgttgatctgtctaatgttgacagtggggtgttaaaatctcccattattattgtgtgggagtctgagtctctttgtaggtcactaaggacttgctttatgaatctggatgctcctgtattgggtgcatatatatttaggatagttagttcttcttgttgaattgatccctttaccattatgtaatggccttctttgtctcttttgatctttgttggtttaaagtctgttttgtcagagactaggattgcaacccctgcctttttttgttttccatttgcttggtagatcttcctccgtccctttattttgagcctatatgtgtgtctgcacgtgatgggtttcctgaatacagcactatgatgggtcttgactctttatccaatttgccagtctgtgccttttaactggagcgtttagcccatttacatttaaggttagtattgttatgtgtgaatttgatcctgtcattatgttagctggttattttgcttgttagttgatgcagtttcttcctagccttgatggtctttacaatttggcctgttttttgcagtgggtggtaccggttgtttctttccatgtttagtgcttccttcaggagctcctttaaggcaggcctggtggtgacaaaatctctcagcatttgcttgtctgtaaagtattttatttctccttcccttatgaagcttagtttggctggatatgaaattctgggttgaaaattcttttctttaagaatgttgagtattggcccccactctcttctggcttgtagagtttctgctgggagatcagctgttagtctgatgggcttccctttgtggttaacctgacctttctctctggctgcccttaacattttttccttcatttcaactttggtgaatctgacaattatgtgtcttggcgttgctcttcccaaggagaatctttgtggcattctctgtatttcttgaatttgaatgttggcctgccttgctagattggggaagttctcctggataatatcctgcagagtgttttccaacttggttccattttcccgctcactttcaggtacacctatcaaatgtaggtttggtcttttcacatagacccatatttcttggaggctttgttcgtttctttttattcttttttctctaaacttgtcttcatgcttcatttcatttatttcatcttccatcgctgataccctttctgccagttgatcgcatcggttactgaggcttgtgtattcatcatgtagttcttgtgccatggttttcagctccatcaggtcctttaaggacttctctgcattggttattctagttatccattcgtctaattttttttcaaagtttttaacctctttgccattggttcgaacttcctcctttagctcagagtaatttgatcttctgaagccttcttctctcaactcgtcaaagtcattctccatccagctttgttctgttgctggtgaggagctgcgttcctttggaggaggagaggagctctgatttttagagtttccggtttttcagctctgttttttccccatctttgtggttttatctacctttggtctttgatggtggtgacatacagatgggtttttggtgtggatgtcctttctctttgttagttttccttctaacagtcaggaccctcagttgcaggtctgttggagtttactggaggtccactccagaccctgtttgcctgggtatcagcagtggtggctgcagaacagcggatattggtgaaccgcaaatgctgctgcctgatcgttcctctggaagttttgtctcagaggagtacccggccgtgtgaggtgttagtctgcccctactgggggatgcctcccagctaggctactcagcagtcagggacccacttgaggaggcagtctgcccgttctcagatctcaagctgtttgctgggcgaaccactactctcttcacagctgtcagacagggacctttaagtctgcagaggttattgctgtcttttgtttgtctgtgccctgcccccagaggtggagcctacagaggcaggcaggcctccttgagctgtggtgggctccacccagttcgaggttcctggctgctttgcttacctactcaagcctgagcaattgcgggcacccctcccccagcctcgctgccgccttgcagtttgatctcagaatgccatgctagcaatgagcgaggcttcgtgggcgtaggaccctccgagctaggtgtgggatataatctgctggtgtgtcgtttgttaagcccattggaagagcacagtatcggggtgggagtgacccgatttcccaggtgccatctgtcacccctttctttgactaggaaagggaattccctgaccccttgcacttcccgggtgaggcgatgcctcgccctgcttcggctcatgcacggtgcactgcacccactctcctgcaaccactgtccggcactccccagtgagatgaacctggtaactcagttggaaatgcagaaatcacccatcttctgcgtcactcacactggtagctgtagactggagctgttcctattcggccatcttggctctaccccaaaagcaggattttttaatggctgaatagtattccatttgtgtgtgtgtgtgcacatatatatcatatatgtgtatatgtgtgtgtgcatatatatcatatatatatgatttaaaatatatatatgatatatattatatatatgatatatatgatatgatatatagtatcacatatataatatatatgatatatataatatcacatatataatatatatatgatatatataatatcacatatataatatatatatgatatatataatatcacatatatagtatatatatgatatatataatatcacatatatagtatatatgatatatataatatcacatatatagtatatatatgatataatgtatatcatatataataacatatgatatatataatatcacattttatcattcaaccattgatggacacttaggttaattccatatcttggttattgtaaatattgctgtaataaaataagaatgcagatatctttttgatatactgattttatttcctttggatatatacccagtggtgggattgctggatcatatggtatttctatttttaattgtttgaggaatctctatattttttcccataattgttgtactaatttgcattcccaccaataatataaaagggtttccttttcttcacatccttgccaacacttgttatcttttgtctttttaataatagccattctatcagaggtaaggtgatatctcattattgttttaatttgcatgtatctgatgattagtgatgttgagcattttcccatttacctattggccatttgtatgtctttttttgagaagtatctttttagttttttgctcatttttaacttgggctcaggttgttttttggttgtttggtattgagttgtttgagtaccttatacattctgatgttaacatcctgtcaaatgtatattttgaaaataatttctcccattctataggttgccactccactctgttgattgtttcctttgctgtgcagaagcttcctagtttgatgtaatctcatttgtctattttttggcacatgttagtttaatatattttctttccatgacaatagatcagaaagaaatgagagatattaaatatatatatataaatatgtatgtgtatatatatgcaaatacccagatatttccacaagtctttcaatgtagatctatgtgacaaaatcccccagaagctgaaaatctggtttgtattacactagtgctagatgagtttaaataagggaacaactgttattggaatgcctttttttaagtcaacaaagtgttttgagtaaccagagggtgcatacttctttgttagatggttaacagcccttatgtagtacagaatgaagctgagaagttaggtctctcctagaccactagaggaaggctaatctttctactttatattgtgatcataggaagtcagaaagccaactttattgctacctcttgtcttttgcttatacatttctttttgtacgagtcccaaaatcacaaaagccaatggtataaattgtccagggaaaggtagagcttctaagtagggaagatgtttttgtcttttcagctctattccagataccttatatttctgtctccaaatctggatgtgatttccccaataagaaatagtttatgaaatacttaattttgagatttctactgtgtgtcccatgaagattttgaacctcattttaagagtcttaaaccatctttcagctaaattagagatacaaaatacagcattcaaggatacagaatagatttatgatagtctccaaacatttttcaagtggatctgtggggacataaactcataagtatatattatcaaataatttcaatctgtgtcataatgttttcataataaatgtcattaatatttgttcacaagagtaatatatatgtatatactacacacatgtgtatatatgtatatgtatataaacacataaaatagttgggaaatatgtaaaacgatttaaaaacagaatcatttttataatccacctcacagagaatatatgttctcacattttagtgcgtgttatggctctataacatctggaaatgtgtgtaccacatttgttactgtatccccaatgcctagcacacttttgctacatagtaagtacctacacaatatctgtcaaattgcctggagagttggaattcaccaattcaagggccacagaatatcttagaattgatctgttcttccatttaatcacagtttaacacaggtccatctgccaagcaggaaggaacatgacctagtcccacctctctgtggagcagaagtattagtaatatccactacgcagtttctcctgtactctcaaaaagaaaacagtcatcctatttgtgtttcctgagaataggaagctcaaatgtctcagcttcatccactgtcatggttaggagcaccttcttctttgcctgggaaagaggctagtgacactataatttctcagaagtttcgaaaggcagcaataagctgaaaagaaccattttgtctgtgatctaaataggactttgctgatggttagtatactcaaatgggtttgtagaatattttgtcttggtgcctggaatttgcttttacgaactcacttgagaggcagcggccagggaagagctctctctcacctgaatgcttagcagaggcaagccatcaaaaccttccaggaagtggcaagccaaagggtctgaattggaggcacctccccaaagatcaaaagttatgctccaccaacacagagacactgagaaatggttgaatgtgttctaaattaaactgccctggtggtgagcagagatctgccaaaatctttcaattaatcacttttaccttcagggcagagttaggcctgagagtatttcaatagatttttattggaacagagttatttcagatattaaactatgttgcacaaagtaaaaataatgttattttttaagttgctactcttgttaaataaaagttggcaagcgttctcggggtctgtattgtgtctgtgtatttgtgaatgtgtgtggctttttcttgtgccataatccccattgatttttaaaaagtgaacagcaatgaactaggtgataaatatatttatataatattttcattaataatgtgttataaataatagaagaaaggttttaagtatataattcgctacatcacaattgggatttttttttcctacgtcttcagcagtaagttaattagaatcacctgcatttccttgggtggacaccaaatggattgcaaacaaaaacagattaaaatagctgctggagctcatggcatacagatgacaagattcacaaaaaggacaatgaggcactgaaaatgttcgcttttcaaacaattctagaggaaatttagctctcgcgacttctctgtaaaagctgcctgtaagtgttttgctgaaaggctagaacagctttgtttctgatcccttgatgagtgagagaaatgtttaagaaagatcactttacagagagattcaggctgaaatgtgatgactgtgattcaagccaagccaaaaattacagttcagaatgaaaggggagggacgtggtttgggaatccattttcccacattcctgaatctcaatcatcccagccaatgtttagaaaaaaatccaatggaaaacaatgaggtcactttgtttagatgttaaaaaaaatacgggtggagggattgaaaagaatgatggcaaatatatgaattttaaatcagtatctatttcaagtatgatgggatcaaaggctacactttatataactcttatgacttcatcccaaaaggatccatttttcagttttcttctttgtgttggtgagccttttattgtgtttctttaatttatgaaatagtctcttgctaaaattaaaaaaaaaagtgtatgtaggcacagagtacagattactcctcctgagactccaagctttccttaggaatagcatctccaggaatctggttttctttctttaaacctgctgtggccaccccactgctgtgtagatctcaggttatgctggtgtattggcttgcaaactaccagatgataatggcagaccaaattagattcattgttcttgttacctctatttgttttaatgaaacacactaagcaagtcatactaccaaatgaatgatttatttacatcagcatgatcacagcgtaacagtagaactacaacataaaagaaactcagagaataatatgagataaaccaaatataacctccaacttcaatatcttccagatacactaagtttttcttcaaggcaacagctctcacttaatgataaccagaatcattgaccaaaatttgtcttcaagactaagatttttttaaaaaaaagaagatgtaagatttgtcaatgactgtttataggtaccttgtttcccaatctccagaaatcatttcaattcatcatctttggtctgatcagaccactgatgctaggttcttttctagagaaatttctcaagcaaactcagaatcttgctgagatctttcttatcttcagagatttccaaatgatcctaaggctggcatatatctgtaagtcacatttatgtctactatcctacaggcttcatgcagttaggcctcaaattcttagctgagcttagagagatatgtaagaatgaatgtgcagaaaataagacacaaataggacactattgttccactattgtttcatgttaaccaggtattaaggtacataaatggcttatcaatctatatcacattagccacactggaactttttccccttgtcttttccctggttgattaccatttggtaatccttaagttaaaaggaatcattttaaaggtgggaattaaattagatgtatagaggctatatacacaaacaagcctgatccataaagaatcacagcaaatggaaaccaggaaataatatttttgaaagtatactactgcctatacttccggattccaaaggtatagataagcatctccaattataaaaaaaaaaaattggttagatattgtggcaagaactaagtataaatataagggaaaattctaataatgaggcaagacagtggttttactcctgtatccaaattgaggagggatgactttttttttttttttgtaacatttgaagaagtcagtgagattttcttctacttattgaaatgtctgatatcctacttaacatgaatgaaggagatgaagaaactaggaaagtaatgcaataaattgttttccaagactgaatccaatcctgtgtctctatacaagaatacctgataatagtaaaaagcaagatagccaatcactctcctcccacacgtctccctaccatccccccacccacaatccccaaactctattgtcactgaacttttcaaggcataaatgatacaatgtagaaccactaagaaaaccaaaccagtaacacacttaacattcagggtatttagttcttttcctcacccaattttgatgctgaagcaatgtaacaacacctgtcttccctggtgtccaaataagacgaggtttgttaagagctcaggactgggcagaagagcaaataggaccaatattaatgataaatatttttgcaagaaaacaatcttatttcctcatattaacaaattgaagtaacaggggcaaaagaaggaagtgggagtgaagcatttgaaaatgatcccaattgcccaagtgttcaaagaaaagtccttgaaaagcattctcctttctgattcaagagtctatttgatatcaccttcttcttagtatatatgtatatacatatacatatatattcctttattatgtgctctttcgaggtatttaatttaaatctggaatttgcccctagctcagacactggctatataaacaattttaaataattgctcattttttagtatcataggttctaagccattttcttagaaacgaaaaaaaaaaatccttctcttagtgacctctttttagtctaacattaaagaaaaattacaacaaatatttatctcttccatgtcttaagagaataaaaattcttattttccatatgaatcccctacaaatacctgggaaattaaatacatttttttcagaaatgaataatcaaaaatgagccaataaaatctagataatgatgataaccaaaagcaaacaaaataataaaggaaaaattgaaggtattttgttatgacattaaaaagaaaaacttgttgcaataattgtgtctatgaagcaagcatttcatagcagaaatatgaggaaggtagaacaaaaaaccaaaatgagataaaaattgaaaagaaaaggctcacgaaagaaatggaagagaaaactaaaacaacttcaggtaataaaaggagaattgaaaaatgcataaatgatagtaggaatttctataaacacagaaaaggacaagagtaagaaacatgaaatgagagatgtactgaaaccctgtatcaacctatacttccaacattagaattggaatcacgtaacaactgttttaaatattcatagtttaatccctcaccatttatttcccatgtaccaataatgaaaataatataatagtatcttcccaaactaatgaaacttctgttttcagtttttaaagttcttttttatgaaaaacaatgtaggcctcacattcaagttggcagtctcaaaaaagcatgtctgattctctttcctcaaaaaaatcccaatgaaataatagaaaatatgtgttttaaaaacaaaaaaatggataatggtgctgaaaacagaaaaggtgccatcagcagatgagaaatagaaattccaggaagagaggaagcagatgggatcaaacaaatagagaaatgaaagcaggagaaacaccattcccagacaccacaattaggcacagttctttccaggggtgtcccagagaataaccaaacttggagtcaacaaacaaaaagaacagaaattgtcaagagggcagtaaagaaagtaattcattaaataacaggatctaacagctgtgagaactgggctcctctttctttatcctgcaccaaggaagcacctacagcaggtgcttgagcctgagagcaatttctgtaaggacggaaaagttgctggcatctgagaaagaagacagtggagaagaaagtgtctcaggtcttctccaacagaattagatatacctttgcccaggtgaaaaattggtaaatttctctatatcccaagttaagtcttccttactttgataactggggagaacccctggcctattgtctactcaccacccatttatcctgcgagacactccaacacaccattctcatttaagattggacaagttgtggggagggagagagttggacacatacagaggtacccatgaccactgtttaatcagtctcaatcataagggtaatccaatatttgataatccatcttaaataaattctagagaagagagataatagagggaaaacaatattgagcaaataatataagaaaatgttttccaaatgaaaaggcccagatggggagcacatatgagtgacattttactgctataagtttaaagagaaatttttttttaatccaagagcaaaagcaatttacctgcaaagtgtcaagaatcaatctgacatcagacttaacagcagggatgctagaagataatggaacatatatttttcaaagttagaaaagtaaaagattatgaaactgaaataaatactcaagtcaacaatcaattaggaagcaaaagaaaacagtcagatgggtaaagtaagaaaaattaccgatcacatacttttatgaatcaagaaacttcttaaacttcaatccaagaaagaataacaacggaatacaagagaaggagggtagttgatgctgacctagagccgcattgtctaaaatggtcatcaccagccacgtgtggttaagctactcaaagctgaataaaataaaattaagtccctcagttgtattaaccacgtttcaagtggttaataatctctgtagccagtcatatgtggccagtgaatgctggtttggacagcaaagacatagaacatttctatcattgcagaaacttctgttgggcagcacttaatctgaggaaatgaagaaacctagaaaggaggaagaggacaagttaagtcttaacttttgggagctctcctttgtgaaactaaattttaatgttaaaccccaacatgttccctttttaaaaaatagtggctattattaacccatagataagtctcaaaatagttataaaaaacaaaatgtcccaaattttaagaatataaacaaacgcataaagaataaaactgggaagggaagtggtagagagaagtaagagtaaatatactgctttgttttccatagctcagagataatttgatatgctaagatatagaaataggcaaattaactcaatgaagagaaagagggtgtacagataagtggtaggaactacgaatgcactaagctctttatcttttctgagaaatcaataaataccattcaaagttaataaattaataaacagaaatatgacatattaacattaacaaaaagaatgaaaatagaacttttcttttcgagacagggcctcactctgtccacccaggctggagtgcaatgctgtgatcaaggctcactacagcctcaacttcctgggctcaagtgattctcctacctcagcctcctgagtagctgggaccacaggcatgcgccaccatgccaggctaatttttaaattttggcggggggaagataggtttcactatgttgcccaggctgttcttggattcctgggctcaagtgattctcctgccttggcctcccaaagtgctgggattgttggtgtgagccactgaacctggcctaaaatagaactgttaacaataactgtctttggaaagcatgttggggcagctactgtacttagttctgattgtatattgttctgtatggttcaattttgtattttttattgtttttttaaccatggaaatatagcaaaaaaaactatatatttttagaatggtttttatgaagtcatatagttatcctatagaataaaatgattcttgtttgaaaatcaaaattgtgccagctatttcctaagggaatcattcttaggaaatagcaaggctattgaaggatgggtgtctcataagaaattaacaataattaaattaaaatggcagataggtacaaaatcaacaccactgagttggaagagagattagaattttaaattatatcctgtactctcagtcatcgaatttaaagtgtgtgaacaaataagctagcaagaaaatgttggaaacactcatttcaacttagaggaggaggcataggtctgaatggcaccagagcttctcatgtttagctcagaacccaagtagaaatttggaaggaccgagacagaaacgtgcagcgttgaggacaacctgagtgttcccgtgctcaaagattttcgccggagggagaagccagaagttcaaagtattgcgagaatggcacttcttgtggtagctctggcctcctaggaattaggaagtgccataaatctcaggagagggactgtttgtgcaaaattcccagcccacatttgcagactgtagaggttcagatgcattttgttatgggttagaaaaacaagcaggctttcaggacacaccactcaaccaggctcaaactccacatctgcatggtttgtccatcattcgggctaccaaaaatgctacctaaaccagttttcaactatttttaacagactcatctgcattgtcaaaaactgtccatattttggcagataagccagtcaaatctggtcttagatttctttttgcaaagtgtctaagatttatggtgggaattactcataacagctgcattctttccactgggcttagaccaccatttggtctaataactcctaattgtgtgtctatcccagtctaagcttcttcaggagaaaaaaaagtcggggtggggaggcaggggaagacttttaaaaatcccctacagcaatacccagtgatttctgccaacagtaaacactattttgaaatataagaaggtcagctgatgatgaacgaataaacaatatttcagtgaatgtggatttcttcagataatttttcatactaccattaatgccactcttatttaaaaataaaaaataaaatgacttagttttatcgtgttcccaaagtatttttagcataacaggcaaaaatcctgtcagcatttacggtcatgttactttcttgaaagaggtacctctcaaagcgatttttcaccaaccttctccaaagcacaaaagaggtaccttgaagacgttggtcatttaaaaatcatacgacgtctaattatatttccaaaataagtagtttgcaatccagcaaggataatgtggtcatgaaaaggatgtccaaatccaccaatttacattggtttggtttggcataactttcaaagttcttggagtaaaaggaggatggcacgtgaataattgtaatttgggtaatagtcctagaactttgggtttgctgttctgtgagccattcaggggaaagcaaatcaactccaagactgtacctatataatttataactgttaaaattcactgatatgttccagattattttgcaaaatgtaataccctcctttttaatatgtactttgtcattttcactctatttatgtaatttaaaaagtatgatagccggagagcatgagccattcaaagcaggagccgctaatgtcagagatcattatcactcacaagatatatagtgttggtatctttgaatctaaagggcttggaagttgtgtcaagatagattcatattgcatctaatatgttttgctttactcccttttactttctggtttctgtctccagccacagagcagtttctctgctgtgactcaggtctacaaccacagcggtagcacaggtctgatttaccctccctgtctccaccagctgtgctccctccttttatgccaaaagaaagttgtgttattactttaggatgaggctgctttctttaaacagtatactgctttccaattgtttatatgtgatatgtccaatccatactactttttcaaatggttttgattactggacttaaaaaattgtttacagaaatttatgaaagaccaaggaaagcacttcttatattgtaacactctaagagaaaaaagaagttttggatacagggaatttcatcagttaaaaaccagtttacaattctatgcatttcaatagcatatagaataatatttgaaaaggaagagtgctaacttcaaaatcaagacatgcacttgattttacaccttgtataaatgaatatgcatattaaaatgatgattaagtaaggcccttatttgcaattaaattttgaaatccaaataatttcatttataatagacctctgataagggtctagctaattagcaaaacaaaatttttaaaaacacacaatgttctcatttttattgtaatagatattcacattttatctttaatcactgtaaataggactaatttgattgattttttaaaaaattagaatttctcttttagagaacatagacccacatattccattgatgtttctattttctaaaataattattattctctaaattccttaaaatcaattgataatccatgggaaaataatcagggccacattcatttgatcaaactttgtttgtttgtggtggcaagcatcaaggtgactttattcaccactcatggttctgatgccatttgtctgcttccaaatccaaaactctctccaaaacccccaagcatgccattatgaacatttttctgtaaacatttcagggcctctgagggtgattttagagaagaattttaaaataatttcctcagtagctatatgctcaaaaaaattaagagggaaaactttgagaaggacacacttgaatgtacaatttttaatatttttaaatctatcacgttatttaaaatttcataggttaaaactaagtaccaaacagcatctaatgacaaaggaaaaaaagaaaatgataagttttttgtaaattaattttttaacattctgggtgtaagtgcatgaacttaagaccaaaatagaccaatactaaaagtaggaattaaatattagaaaaattttaattaggactattatcacatttaagctgtcaagcagaaattgtactttaaaacaaacaaaccagagtagacttagattaatggaggtaatttgtgcatcacgaagaaaaaatatattgatttttacaaatatatgtgtcttagaaactttcaccactggctaactggtgtccagcttcacccaattcctcacaatttatagttctcaggaagagacagagtctcagtaatttcttagattattctagaactataaagtcacatcaattaatacatttgttaatagctattccattttattgcaattatctcaagtaaccctaaagtttattacatggaagagtaaaaactatagtgaatgattgtcttaaattatgccattattaccaatgttataagtgatgttattctaccctaaccttccaatgcaatattttgcacaatggcagaagtgttcctaatacaaagtgtgtaaaatggtaaagcaataaatgagctcattttatgccagtaaagtgctttgggaagtctttattctgttacactatggcaataatttctaccaatctatttaatactgttgtgaattacaatgattatccatgatgctataccacctccctagagaaactgctaagacctctgcatctgctggcaatctcagctagtcctgagtgcccagacacatcaaagaatatacattcttgacattaaaattatgttttcagcatttttagatactattatagtgtttgactaagtgtttcccttttcgttttcctgtttcttcattgtcctcgtaacgtggccaagaaattaactagattctataaatagatgtgtggaaaacaagtgaatgattattgaaattcactgccaggataagttattttgaattacagatgaccagttctaaaataatctgaaactcattttaccatttcgctaaagattttttaaatttttctctccataatggagcacctcattacctataatacactagaaattatcaaactagcattatatctagaatagaatttttactctttagtttcaaataatcagatcaaaatatgttattctgtaacaatcacaggaaaacaagaatagaatagaatagaatagaatagaatagaatagaatagaatagaatagaatagaatagaatagaacagagtagaaatggagagaagaaaaagagctgagaagaggagaggaaggaaagaagagagacagaaaggcaggaagacagtaagtcaggccagtagcaaatgtcttacaaatgtctcgagttattttaccttgcagaaaaaaggcaataatacacaaacgtctggaggtttcccccctacccagttggattcctatattttccttgtaaatgaaccttaaatatatgatgtaatcctattctacccactgctctttttgcctcaattagacccaaatttattgatgataattttaattaagactgaacaccatgattactttgagattaaaattttgaagattgcataatttagaacacacaaattggttttatctgagaagaatagatatttgatttactccttcttttcatagattttttttaaaccatctcaattcctatatgtgctaatataaaatatgcccttttgtcttcaggtctagatgttgatggaatatatcgagttagtggcaatctggcaacaatacagaagttaagatttattgtcaaccaaggtaagtgatttccacttcagagattttttcaaacagtttcatatggaacaatatttcatacactgtgctgtatgtactgtgaataataataaaactttaacaggagaatgtgaaagtggaagaaatttaaaaattatcagaaaagtaaaagataaccaactagtttatctagaaaagaatagcatatacagataaacaaattaatagtctatgtgaaataaataatgaatggaacatgtcaaaataaaaatgggggaaagaatagaaaaagagtaaaagaaaaatgacccagattcaaaaaatgttattggcttataatggacacttactatatgttgatgaatgaaagaatgaatgatggaaaatgtaaaagtcaaaataacagataatagaaaaatatatagtaggtaagaaaaaaattaggaaacgcatatgccatcaaagagttgtaaattaaaacaatgagataccactacacacctgttagaatggctaaaatactgacaacaccaaatgctggccaagatgtggagcaacaggaactctcattcattgctggcggaagtgcgaaatgattgagtcactttggaagaaaatttggcagtttcttatgaaaataaatgtatttttattgtatgatccagtacttcttggtactaacccaaatgagttaaaaactcatgtacacacaaaaacctatacacaaatatttacggcagcttttttcataattggcaaagctagaatgcaactaagatgtccttcaataggtgcaaggacaaatacaccagaatacatccatataatggaatattattcagggatgaaaagaaatgagctttcaagccatgaaaagacttagagtaatctaaatgcatatgctgagtaaaacaagccagtgtgaaaaggtatgattccaacaatatactgggaaaaggaaaactagagagagtaaaagatgagtggaagcagtaggacgagcttgggggaaagagggagagatgaataggtgagcacaggggattttgagggcaaacaattctgtatgatgctgtaattacccatacatgtcattacacatttgtcaaaacccataaaatgcaacacaaagagtgaatcctcatgtaaattataatatttagttaataataatgtattgatattggcttatcaattataacaatctaccccattaatgcaagatgctattaatagggaaaattttgggaagagtgaggagatacatgttaactctctgtactttctgctcaattattctgtaaacttaacactgctctaaaagaagtctattaattcgaaaagtaaaaataagaaattagaaaatgaaaaacaagaagaccaacacatcttaagttggtgttatagacagctcataggttttaaaatcatacagatggggtagaacttagactctctccttgtatccttggcatcttaacctccctgtgcctctgtttcctatcaggaaaaacagtagggggatgccttggaaacatttgggaaaattaaactgggtagcatctatgacacttaggaatgtgacagactcatgttagttttccttttacttaaaaacagtcaaaagtgtcttcagaagaactccaaatccttgtactctagcttcccacttagcttctataatagctggcttcaggtcctctgaatgtttttcataatacatttaacatataaactgtactcccacatttacatactgttgtgttttttaatgtctttgcacatgctcttccctttactttcaatatcctcctatcttttccttcccatcccacatacacaagcttccagcctggtagatttcttctttttcttcaaggcccagattatagcaatttcattcaataagcctccagtcagatttcttctctgttccccttactctgagtagctgaatttacagtagtacattcacatctaacttttaaaattccatctattataagacccatagatttaatgccaacttttggaaaggatataatcaaatgtactcggtgattgtatttcagaaacattaaaatttgtaagtcttggaatcaaaaaataggatactggctgaaatgtctgtctctttcacaaatctctaaaaaggtaggacttgaatcatccttgtatcttttcccattaaccagttctagccttggtgtttccatacaaggagttcctcatacagggagtttttaattaatatttgttgaacaatgtgtgtgggtgttgcaggtaagagaagtattaaaactggaaagcattcaactctccagcaattcaacttgggttgaaccagttttttaaatgttgattgcaatacttttggccacttgccacatgactcttgtttctaagaatctctataactgagaatctctacagctctgcttgttcactaatgcaattctttgtctttcacaattactctctttcctgggcaaaacacagaactaaactttacctcattcatttatattatttccatttaactgaatcagcgtaccccctctgtgggtaaaatatggataaaatagccctagcctcatattcattctagcttataaccagctaaaatcattcttacaatatagtttatgctgaaacgatatcctgattgggattctagacagctgggcaacacatttcttctacaaagaagaaatctcaaaacagaagccatgctagaaacaaacactagttgcatttcctgcctttaaaaaaactatgctcagcagtttgaaaaggcaaagaaaaaaatctgcaatgaaaatatgaaatctgtccatctcgtcttttgcaatccaaacttcagcgtcctctgaggctatgtaactgctcatgtttccatgagaattgacaatgtaaggctggacagaggcctgagttggtatctggtagcacagaattgtcagtaaactgtctccctggtttatagcactgtcagaatgcaacatactcaacacaaattatgctacattaggacctttgatactggtaactttgtccaagttgtgttatggagttttctgaattagatgataagtgaaatgcatataccaacccctttcaaaatttgctaatcagattatcctttgaatgcgttttctggactggccccacaaccttgttgctaatgccataccttcccctccatctggaccaggactctaatagtagagctgacttgaaaataatcagtgctgggtgcaaagagattgtaagtgtacatgtggccctctgtggccctctctctgtgtgtctaatacaataaactggcaatgcagggaaaattccatgaaaagcataaagtgctatgtaaaggcagtgcatcatttttgcagtctaagctgaaacataaatgatttttgcatacctgccttgtattaacatattttattccttctttattcaccttgcacatgtttattttctagaaggctctaaatatacatttttaaacaagtaagccctgcccactgttagactagacaaataaaaactgatttttgagattttcaagacagatgaattgcaatttatgtatttcactaactttcttgaatgctataatcatcagcaattctaaatacaccagttgaatgactcaatttgttttggttttctatttgacttactaaatcagtgggaattagatacccttattatacttccagttcagatgacatgcaagttatattcaaagtgttcacttttgaaaagcatttcctaattataactagtaatgatgataatagtaattattatcataaaagtaagcagcattttcataatttattatgtgccaggcactgtactaagcactttatttacataatttaatctaatcctttcttacatcccatagagtaggcactattattattcccattttacagatgtaaaaactgaggttcagatagtaaataatgtcctaatgtcatacagcatataagtgaaggagctaagactagatcccagatctgtctgactcagagcctatgctgcaaaccactgccattattctgcatttccaattcatcagctgttgattatctctttataaaagcagagattagtcttttcatgctacacacgctcattcatgactttcctttacaccccgcctcttggtgttggtaactgatgagtactaccgttggagttttgctaaaattgttcaagagctatttggagaaacgccaaacatcacagttaggaagaagcctggcattgccattctctgtatggctttatgtatctatgtttggcccaagaaactactttaacacgctattctgttgcagcctttgggaaagggatcgaggattctcgatttactaggctgttggtgcgtttgtgagcagcgctctgccctgtttgttgaatttggtgacagctttcagtgacattttgctgatacagctcttctgctttgtgaaggcatccccaaagaaaactggtccatgaccttagatgtcaacctgtcatcagcctgcgacattgcgttgattcttcagaatgatctgtgacctccttacacttttcttgcatggggggtactttgcaaatgacagacttcagcatggaggatgctgcatgtcttgagaacttttgacagaaagtcttggaaattcccctaggctaaactccccctccttcccacattgatacttgggtttgagctgcccatctatgccttaggcttattgcccaaactacaaattcagttcagactcacttggtattatttagacatcctctttcaccctttgaaaaagggacaagagagattggcattctttttggaaaaatctagctatgaaccttcccaagcccatgagccaatgggagagctatgaagcattgccggaagaactgactgggaattttccagatgggtgtctgttagtacacagttacaaatattctctctgttttcctgaactgaagaaaattacttcttaccaggattttagacatgtttttcttttttctttttcttttttttttttttgagacggagtctcggtcggtctgtcacccagcctggagtgcagtggtgtgatctcggctcactgcaacctccacctcccgggttcaagcgattttcctgcctcagccacctgagtagctgggattacaggtgcccgccaccaagctcggctaatatttgtatttttagtagagacaaggtttcaccatgtctcaaactcctgacctcaagtgatctgcccacttcggccttccaaagtgctgggattacagagtaagccactgcgcccggccgacatgtttttcatttatagaaacaaaatttgaagaaaaactgttaaggacaaccttctctacttgtgcaaacaaggaggaacaaaatatacaaatgctataaatctacatgatcaagaatcttgtttgtgtgtttgtgagcacacacacgcatgtgcatttgttttaaatgagaggatttttttcattaatttatggtctcgtagatatctttatctacccagattttattggcataataatccaaattagatattggcttaaagagatggatgtgcttagtttaaacatgctaagaataagctccattaaaaacaaactattagaaaaacaattttgtttttatcaactgtacctaaactactttaatatagatttgtaccttaaagcaaagccaagcattaactttagtagctatccctgtgcttttcatattatttgcagcatcaaaaattgaataaaagaaagagaaagtgagaaagaatgtgaacaattggcagtttcatcatgaaataagcaattggatgaaacagaaaaagatctgaaaaaggatttcaaatttctgttcttataaaatagcccttgtatcaagtccattcatttttctattaaataagtttatattgccctcttattatttttaaaacgaggtatttccttaagcctgctctactctcaccgccaatcacagcaacaacgaaacaaactctgttattcgctttattccattccacagggtggttttttggtaagttgaatcattgatattgcacctttttggctttcatgtgacaagattatcttttaacaatgatttatttttcccattaaagttgaaaagatcacttgatcataaaagagccagactctaacatcattcagggctttggaaactttcttagacctcatttttcagctacattgagtcagggagctcaaagactattgatgaagcatgtattgttttctagctgcttaagaaaatgtattggcattagtaaataatgctgaacacagaggtcaaaagagtaagttattcatgttcatgcacatttagtttctgatttttacattatagtccaaaaataagtttatgaatcctgacagtctccaagacacacaaatcctggctacttattttaaagcaaaactataccacacatttaccgtggattgtattttctaattcattatgtaccaaccaataatgaactgacctaatgctgttgtgaaataaaggcagaaggcatctaatggggaaaagcaccagataaatgttgaaggatcgacctctttatcttgattctgaactatttggaagcctaatagaaattattttaacccctttaaatcaccaactcttcatttccaaaatgggaaaaataatggaaatgtgaggactttaaaaagtgaatcagccaggggatagttattattaactttaattaagatgacaagtagatagatgaaatcaaatcactattgcattttcttggtaatagcatgataccaaatatttataatcaaatatggtttttgccttctacatgattgaattttccttgatgataattggaagaaaaaacaaataaaactttggaaactctttactatccagtgtttgaaatcattactagccaaattcataggccttctgaattcttggacacaaaaaagaaaatttcatgttgtcagtatggtttgggaatattctaaattgcaaagaatagcttcatgttcattggagaaggggagcgaagtctactgaaatttaaagtattaattcggttgtagcttttccatatagacttgactactgagtctggaaattaaattagtcagagttatgtaactactaatccccaagaaaaacccctaagatatttacaaaattccatcatgatcatcaccatcatcatcatcacaaatcattgccataaccatcaaaattaataagtagttattaaaagcttcataggaaaacacaccatgcttgcttctgctctaacaacactgtagcactggttcccggccttgactgcatatcagaattgtactgcatatctcctgctgcctaaccatattactgccaacttagctacctaaagcaatacaaatttattatctcacagtttctgtgggtcagaagtctgggcacagcttagctgaatcctctgcaaggctgcaaaatcaaggtgtcagccataggcgggttctcatctagaggctcaactgaggataggtctgcttccaggttcacatagtcattggcaggattgagttccttgtgggttgttggactgaaggcctcaatccatcattggttgttggccaaaagccttgtggaccatcttacagcatggcagctgccctcatcaaagcagcaagggagagacagattattagtacagcagaagttttaatcccatgtaacataatcatgaaggttacatccaatcacctttgctacctactgttggttagaagcaagtcacagttcccaccttacatcctaggggaggggactacacaaggtataaacacaagaaaggggggataattaggggtcatcttagaacctgactgccataagaatctagtggtagagcttttcaaaaataaatatttttgaagctcattcattaaaaaatccaatgtaagaagtctgcagtttgagctataagtaagtgttttaaaagaaaaactccccagataagtaaagtgcatagccaggtttggaaactccctgcacaatggaagctagttttattctggctctctggtggagacatgacttaccaagacataacatatacaagatttgcatttgaaaaaaggggaaatagaccatgaatgcctgtttcgataactagttttctagtgaggggaagtcttctctttggctattgattaatgtaataatgttcaaaaacttttatgaactgcttcattatataactaaaaactaccatggatatattatgtatgttagtatgattaaaattacgcattttaccataacaatccttttccaatgttgtgagttctgaaataaatgaaaataaaaggtgctttacctaatcatttgctaacgaaactaaggggtaaataatatgaaaaatgtaatacatttatatcattgctgataataggagcatttaattgagaatctactacatgacaggtacacaaagttagaggaatctctgaccctcataaaagttttcgaggtagataaactttattatccacattcttcacataggaaatcatacttaagaaaaattaaataactcttaggccacaaaattaatacagtattgaaggcaggaggtgaatctattttaaacttactcccaaaaatatattgcctggtagctggattcaatttaccatggggaagggggcagagagatgttatcttctttttaacattaaggaatcccaaatcacttattctcattatagtactatattttccaggtgttcagcctatgggaccctctataagaaaaaaacatcaattttaaattacccttttaataaataacccccaaatgctttggggattataagagtaggaaacttgattcatttttgaatctccagcatggcaaagtgcctgccactttgaatgtatgaaattaaggtttgattctacaaaataagagaatgatgaacatcttatacaaaccaactctatataaaataacttcattggtacattatgttaggttccattttctcagcaaagaaaactcaagctatattttacattatattttctcccagatgcctataagttagcacttaattttagactggataaaagaaatgaatagtgaaggatcccatatccccattttctgtctcaacaaaacaaagcttgaggcgagataacttactgtccctcaacatggtatcttgttagtaattgaacatgtcagtcatgatattggaaatagtggtataacttggcatgccatcttagtcctccaaaatgttggaaatacttagggttggataaatagcaatgaagtcatactgctcttgctaacccccaggccctgaattttgaaagcatgtcttttgtttttgttttcacacaaggatccctgttgctggtaattacagctttagtgactcacatatatttatatagcacctcttttccaaggtgccccatgtactttggaaacatttcctaacaaaagtgtgctgtagaaaaaaagtattctcatctccttaaagctgttcctgaaaaggaaagtaacagttgcagagatgggaagaaattttttttcaggtccccaagcacaacgtgaaaataaatattcaaagttaacaaatgcagggctaaagcaagattcaaactaaggtctgaatgacttagaaccacacagattctattatgcccttatgtgtatggacccactggagaggtggtggaagatagccttatctgcttcttgcttcactgagggtcccagcacagcaggattaatatggaagggagagatgagctccataaaataagattttggcttttacagcattcatttgacagatgcttaaagagctcccactagatgccaggcagtatgtgggacaccggaagtacagcagtgactaggacaagtgacctttccattcacatggagcctccatgtgcatggacattgcaatctatcagctaagaaccctggtgatgggttcaatgtgaattagtgggaaaatactaggatctgcaggcatcccaggtctgctccctcctctctctctgacctcactgtgtagctctcttccgtcctcattattttccaaccaccacggcttcctttctttctcagattcatcaagctcatcctcttcctggggcttttgcatttgctcctgtctactggaaatgagtttccagcagatccccacaagatgcccccctttccacagtcaggtcaccttctcaggaagccctttcctgaataattcgtctgagacatgccttcactgtacccacccagccactacctttcccagtatcgtgttttcctttcttcagagcacatgctatctaaaactgccttgctgctgcttttttttttttgagacagagtctcgctctgtcgcccagtgccacgatctcggttcactgcaagctctgcctcccgggttcatgccattctcctgcctcagcctcccaagtagctgggactacaggtgcccgccaccacgcctggctaattttttgtatttttagtagagaaggggttttgccgtgttagccaggatggtctcgatctcctgacctcgtgatctgcccccctcggcctcccaaagtgctggcattacaggggtgagccacagcgtgcttctttatctatcacctcagtgcttgccttcctcctccacactgtggcatctatgtaagcaagaccttccctgtcttggtctcctcagtatccctagctcttactgtgccttcaaataaaagctttttggatttgaatgaatctaacaaacaagtgcattaatgagtcatgttgggtcaccagcaaaggataggctctgattgaaaagcaggcgttagccctcaggaccacaacccagacccaggaaaacatacagccccgaaaagaatatcttaagaatttgagagttgctttctagtcagtccagtgaaagatgttcctcttcccaaccctcaccttccacctccacctgaagtaactgtcttccaacccaacatggaatacattggaaagatttgggaagaagaggaggaagctgccaggcttggaagatcagagccagccctgccagccttgtcctttaggccaaaaaagactgcctaagaaacagaggacccccaaactcaggtgatactaaagccacatttagggtcttatgtgaattatatgaatttccatagtgtaatccctttcagtgaggtgatttgttgccaagtccctgtcggccccatatctcgctgtacctcaccttccgtttgccagagaacacctctggctcaaattacaagtggatgtcctggtcttgctatggcttcagtgaagtaacataaactgcaaaatagaataatcaggaaaggagggaaattagctaagggtataaaataaggcctaaatgctgggaaaactggctagtcatatgtagaaagctgaaactggatcccttccttacaccttatacaaaaattaattcaagatagattaaagacttacatgttagacttaaaaccataaaaaccctagaagaaaaactaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaacttaaacaaatttacaagaaaaaaaccccatcaaaaagtgggcaaaggatatgaacagacacttctcaaaagaagacattcatgtagccaacagacatatgaaaaaatgctcatcatcactggtcatcagagaaatgcaaataaaaaccacaatgagataccatctcacaccagttagaatggcgatcattaaaaagtcaggaaacaacagatgtggagaggatgtggagaaataggaacgtttttacactgttggtggtagtgtaaactagttcagccattgtggaagacagtgtggcgattcctcaaggatctagaactagaaataccatttgacccagtgatcccattactggatatatacccaaagaattataaatcatgttactataaagacacatgcacacatatgtttattgcagcactattcacaatagcaaagacttggaaccaagccagatgtccatcattagtagactggattaagaaaatgtggcacatatacaccatggaatactatgcagccataaaaaaggatgaattcatgtcctttgcagggacatggatgaaactggaaactatcattctgagcaaactatcacaaggacagaaaatgaaacaccacatgttctcactcataggtgggaattgaacaatgagaacacttggtcacagggtagggaacatcacacaccagggcctgtcataggatggggggcagggggagggatagcactgggagaaatacctaatgtaaatgacaggttgatgggtgcagtgagccagcatggcacatgtatacttatgtaacaagcctgcacgttgtgcacatgtaccctagaacttaaagtataataatttaaacaaaaaaaaagcctaaaatattggcctaaatgaagacttcaaatggggatttattcattcaaaaatatttcttgaaaaccttttatgaaccaggatctcttctggaaaatcaggctctggtggatcatccattttggtgtcaagagatacataataaatacacaagataatttcagatgatatcagaaattataatcaagatcgtgatgtaatagagaagaacagatggagacgggtgaggtggcccttgattagatgacctgagaaggtctctttgaggaggagacatttgaatagacacttgacctgataggaagcagggaggcatggagagatgtggggggagtgcaaagcagggaaactggttctggggaatgagggcttctgtgagatcaggacacacagaaggccagagggatgggcaaagccaggccaggtaggccttgccaatcaagattagaagcttggcttttattctaagctcagtggaatgtcagtggggtgtagggcagcagtaagcagaaaattagctgaacctatttatttatttgtttttaaattattccactggctaagagaagaatgaattgtagggggaaagagtacatacaggggacaaattagaaggttgttacagtagcacagtcaagctataatagtggtggctgatttgtatgagggaatacttcatattctatttgtcttattttccatatgccttttaaaccatttcctttaagcaataaagtgtagagagaagagtggcccaggagttagaaagcctaggtcaattttcatgtcacctcttaataattgtgttgtcttgcccaagtcatttaacctccccaggtcaattttattatctttaaagcaagaatatattttcttttaagatgagtcaatcccatgagataatgaacctgttacaatggaaattgctacaccatatggaagttatatctaaatgtgtcccttacaaccatcctaatgaagtaatctattgtaatataatgaagtataacattttttaaaggaaagaatattttataaagaaagggcttatctcaagttcttcttggattatttaaatgtcactcaaattttccctggaacctccccccaaaccacaagaatcactcctcattttaaatcctatgtttacaacttcaactactcaatttacaataacctcatattgtgtataatgttatatatcactagtgaaaatcacatgcttatatcttatctactcaacacactaaacatttcttaagggcagagttcatatcttttaaacctgtctctcctactttacccagaagaatattttgcagctgatagaagcactacacattttaatttattgattgattccatccagagttggaccatttttttattaaagaaggtgaggaatttggcacatgctggagatcagtctcaaagtgaacaatttttcactgtgtactattgaactcagttccaaaaacaatagcaagaaatacataaaatgttagcattaggtattggtgatttttattgtcttcgtttttcaaaataccttcccaatttcctgcaatttacacattatttcttttgaaaacaaatattgaagaaaagagaagatatgtcttgtttcaaacaggtcaatccttttttttaacagaatagaatttacagaacataccaacagaaccaagagaatgtcagtacttgagttctctaaagcaggggtttccagccccccagccaggggccagtaccagtccatggcttgttaggaacctggcagcacagtaggaggtgagtggcaggtgagagagcattaccccctgagctccacctcttgtcagattagcagtggcattaatttctcataggagtacaaaccctattgcaaactgcacatgggagggatctaggttgcatgctccttatgagaatctaatgcctaatgatctgtcactgtctcccataacccccaaatgggactgtttatttgcaggaaaaaaagcttgaggttcccattgattctacattatggtgagcatgtaacaataatagaaataaggtgtacaataaatgtaatgtgcttgaatcatcctgaaaccatactcttccccttacaatctgtgaaaaaattgtcttccacgaaactggtccctggtgccaaaatggctggggaccactgctctaaagcacttgaaatgctattacactaaatctttgtaagaaagctacccactttatagatgaactaaagtctctatgaatttgaatgagttgctaagagttgcatttcttcattcagctgagatttggagaaggcattatgtgtttcctggtaatttagagagaaggtgacatgaaatcccagccacagtctcctaacatccatgggattctaaaaagcccatggaataattccctttaaatagcagcaggtattggtggcatctgcatttcttgctgtttcaccatctcctcatcctttctacttctccagattgtttgtctttttgtggtctcctcactctctggctacatttttcctgagcaagtaccccactccctcttcttgttagtctattactttcatgtctggcagccataaggggttcactcaccattatctgcttaggatgttggaattcaatatcccatcagtcctgggggctggagtatgtatgcgtattattatttgataggtcccagcagaacagtctttcagagcaagatgcacatcatcagtggttttgctgatggatgagctcacctccttgacacagatctcatgattcttggcataaatctcaacaggaattagctgcttcttccactgtgttcccatagcatgttgtccctgtgtttcagtactggttttagtctatttcatatgccacttctctccctttcatgactgttagatgctggagactgagctatttttcagtttcctctggattcctccctatgcccatcatgtgccatctgcattgtaggctttcagcaaagctgtgcctgccagatcctcttatttctgggtgccaaaatactcagcattacacttctacctcacaaagatctacctggcttaaaatcatcacccacctgtgtgtgcctttggagccttcatttcacccctgtcctcacccctgacacctgtaagacactgagtcttactgagcccactttctccatagtcatactctatgcacacagccatcttccccattcctctctccctctccctttcccttgccctgttctcagcgttatcatccccatctctcaagagtccactcagactttctaaggtgatcatttgttcatctgagcacagtaggtcatgcttcctgctactcctgggaatataaggtaagagacgtcatataatcaggtaaatagtgaggatttccagtctctacataaggtattttcaacagtagtgttgactcacctcaaatcacaccacttagacagctataaagccaggcttacctggaattttctttttctgactcatgaaactcttgtctctgtcatatgtgtatttttacttctgaattaatatagccatcctgaatcctaaatccacgcgtgatttctgagaccactactctcactgctaatctagttatgtaggaatccctcctaaataaaaattttaaaagataaaacatacaaccaaaacacaaagagccatattgagaaccatgcaaagcactttaaaagtggtaaaagatactagctagataaattcaaatctctagattacaaaaatggaaattcataaattaaaaaaatacctctagatacctttatatttgtttctttattccatcttgtgtgtttatagaagaaacaatattcaggtacttttcattttactgggatgagaaatggaaatgctaactacagtgcagcttcatgactcaaaagtctgtaactggtattaatgaacttttaaaatgctaattttaatgcttactccaacagaaagatgccttaaagcaaaacttcacatttcttatctgctaaaagcaatgtgttttgcatcccttacaaaataaaatggttgaaataaggtttttaaagggcttaaagtttcaaggacttctcttgttcttctagagaaaagaaatttataaaatcacatccattaatggtccctctgctagaaaacgaaaatactcccaaatatgttccactctaggaaaatcaaaaataacatgtaaactacaaatatgttagccaattcagaatatttattaactaaataatttaataataaagaaaatgccgacttgattaattgttacagagtaaaaattacaataaaactgtcttgatcagtgctttgcagaagcgccattactgtctgtgcagttgtttaacaaggatttaattggaaagataagtgaatgcacatttaaaagtattgttaatttgctttataatcaccccatccttcacagtattgacagcacaaggcacaaacccctttctgttttacaagtattattttccatatgtgcacaataaattctgaagcagtaattggaaattttatgggatccagtatacctagtatagtgggtttggaggtgcactcttcctttacaagaggtaacccagttctagttgttggaaacgagtgacaaatctttgatgtatatatttcccctatccatgtttgttcaggttcatatttggtccatttctagaaaaggttgcctctcttatattttatgtctaataaaatcaagattgagaggagaaaaaaatatgaattatttttagtctgtgactatttgtattactttcttgaaaatgtgcattatcagtggaggttctaaccaaggatggtttctagactgtagccaaacgaaatcacctgtatctgaaaatagtggtacctgaacctattaaaggagacaagagaaggggcaaagaacatctatgattgatctctacctctgcagccacactgacactcactcacacacatcccttagagtttggaatcatctcgtcaaaaatctaatcagtgtggtttgcaaaacaacatgagtgtaatgcctcagatttctaagaggtggcaaccttgactacccaagtttccaatatacaaagcccaaagaccttccttattgtagaaagagcctaaagctactttggaagcaggtcatttgctcatttcaaatgggtagagaatgttagagtgccttgtttattggctgattctcaaggagccacagtctttaggatttatttcaaaagataaaagagcctaaaacttaaagtataataataataaaattaaaaaataataataaaaaagatgaaaatatgagcgtcttcttgaaaatggggaactgttcattaaacctattttgaaggcaacagttgttcgaatcctctctattgataaaggctgcccacttggttatgacgagcagggagtgtccccaaagtgtctcatgccagtggcagtaaaagcatgaaaaaatatagggaacatgctaaatagcctcttggccatgcccccattagctagaattggtagaaatatctttaggtttggttaactatagatttatttttttcctgtagacagcaaacacttcaactataaaagcttagaaatgtcttctgaggaaaattttcgttagaatcctttgcagtgtaaacctctttgccctctggataaaatgtgttaccttacgtattgtcatgggaacaattatttttatctttagtttggctatgcctctaaatctctaaacttctcacatttacattagttttttatgcttacagagtaaaatagatacacatattgagtttcacatgtctagagattttccaatacatgctaatatccgatcactaataccaactcgcaaatcacataaatctatttcttcattctgacatgtatatatatttctctagtgaaaattcttaccttgctgagtttcactctccctatatgtgtaagtacttgtgtgttgtaaaaactgtgcgcagacacacatatgtgtacactttaaagattacttttactactttttcaaatttctccattggaggcatggattttaaaactgtttatctctggtgaaaatgtctttgggaccaagacctttatatgccccatttcaactagacagagctgagactggtgcaataatgaaacgtccagctgtcctttaattaactaaaatgaggaaaatgtaatgttttgatgagagaaccaggattctgtgagggataaggggaagactatatgtttctgcgccttcctgcatatgacacagccatggggtgcaggaaagagaggaggcatttttatgccccagtagggggagctttcttttccctactgtaaggacagcatggtgcatgtgtttaaatacaccatcctaaaatgcagacttttcattttcattttgcaagtgggaaatttcactatgtgatgggcacattactcttcttagcgacacattttgtgcaaactcatttgggaaagaataggaaatttaaaatactgccttcatatttcttctggaaatgttagcctgaatccattatttccaaacctgatgaggattacagttcatttgtatttcacagcaacccatattgtattctgttttgtgaagtaaataagagatgataccgttctaatagtgcctgtattttgctttccatgttaatagtcttattctgggggcaaaagggaaggaaaaaggcagagagtggaatactcaatttagccttctctagatggaaggaatgtgttattctgacaaagaagtgccctgaattattttataaataatctaaaccggaggaggtggaacacaaactcacttaggtcactgagtatatccatattcaaatgatattataaaaagcactgttcattaacacccaaatctctatctcttatttaactacgtttaaaatactcatggactaacctgatttgacagcagtgtaggtggatgcttatgtgccactgaagggaattctttacaaaataatttcccaccagcatttcactgtgcctgagatgccacaatttgaaaatcaattcattggctgaggcaggaaagacaaataatttcacctcttatactaaatacagttgtttcttggtgactgaccagatggttgtgttaagaaggatactgaaacattgtcctaaataagtgggaaagagttctgtgatccatccataatggatcacattaataatgtatggcacagatattatttaaaaagaaaaaaccaagtgcctgaatatgcacaccatgcactttatgtttccggtttaagatattggattaagaaaaaattgactgttatacaaataacatctgagtcttacactctatcgacgtaatcatgaacacaaatcttttaatctggtaggacatcatataacctagcatacctttaatggaatacagcaaagaacaggaaatatcagaagaatcagaagaagggaggattatatgataaagaaaaaagaactctgggagttgagttagattaaaaagtcacattttacttaacaattttaccacctctttttcacccactgactaaatttctttctgatataaagtatgactaaactattttggttgactctagttcatagattgaggttatttctattggaatgaaaggaagtccaaagtaatcctccattgaagaaatgtcccagcccaattaatgattttagctgatgaccatatagactatctttctgtctacaaagctgtcatcaaactatagctaaaactaatcctcctaattgcaaatcacttgaaaataaaagcaaatcacttgaaagagagaacatctacaatggaatgtataagtaaagtcttcccactttaccttcacttactttgggctcaggttggtgagatttattttcattaagacaaattcttaggccctgaaaaaatagatgaaacctaccatctgcaccacatttcaatatttgacttaagtcatctgttgactttgaacacactcgtgtaccattcctcatacgagctaaaatgtaatccccttcactggggactgtaaagaaatgttgactttcgatttctttacatatttgatctttcaagatatgagaatgctgcagctggaaaactcagcaccattagggaaacaaagcagaaaataaaacatacaagtgaatcagttaggactcttctgattttaagggacaaaaaccaaaggatttttttcctttatgtaactggaaaaatcaggaaatgatgcagcttcaagcataactaaattctgaagcttaaacagaatcgtaaggcctaacctctctcggtctctcagctctgctctcctccccattagcttcatactcaggctttgcatggttgtaaaatgaccaccagcagttctggatcaacatgatccctgcttctagtccctcaggaagctcctttcccaaagcacctgactattattaaccaaaattgtgtcattaactcatccctgaatcactcactgtggctaaggaaatagaatgggctgattggcttagaacaaggtaacaagccccctacatggaggtagagggagattcccatccagaattcaggaactgcagtataaggagggggatactccccagaggaaacctggtgcactatgttcagaaataagatgctctctacaacgagtaagtgaatttttacagttaagacaaaaaatgccagactgtacagatagaagagatgtcaaatgtcactcaggcaattctcttacttgcaagcagtctttgaacgtgcttaaaactctttagataaattaattttgcagagttttgggaactttttaaaaatattcagtaattgctttgggagctgatgtacataaacctcacagcaattgattggttcaggaaaggggtaatcatgtccaagttacgttggtttgctagctcaggtataagtgtggaccctcatatgtcctgagtatttcatttatacataatctttgaaatgttttaggagcaaaaaccacatgctttcaaggtcttttaggcaaccaacattgaaaagaaaaaaaactatcattaaagctaagcacatgttgtcattcaagtaccaagatatttaatagaaaattacaacatggagtatgaaagatgagagatttaactttcaacaggcaaaggtaaatattgagagggccagaataatgatgtggaattatgtagatgaaaatcttgccaagacctgatagcaaatacaatccagcaaagggccagggagagtaatgttgaaatctttgatgactctaggccatctagaaagcgccaatggcgctctatacatttttaaaaaaggtgggggggtagttttttggttgataattttggtcatttttagtggtatccctgtgcagaagaagatgcttttattcaataagagaaaactgtttactgtttttgttgtatcagggacacatgacaaagcattcaaatatgcaaataattgcaaactgatgtatccagcagtttaaaaattgaataaataatttagtttttacgcatgggcaactcttgctaaaaaaactacaaatcagaactcttctgtttgaatctattttattttgttaatagatgagctaatatgataggcatttaattgtataatatattattagccattttctttggcataccattaactttaaatagtattaatatttaacatttcataatatacactacaaagttcttattttttccagctgaacagaaaatgtacattgatagtaaatctctttaaagtgggttttaagatgctaagtatgcaaaacctgttccatttatactgtttgatcagaaatactcaaaatgccacagcataataaggcaaatgctgtaagatgacaatgatgccaaaactgtattatgattgtgtattcaaatacaatgtatcgcataattaagcataattatataatttgaatatttaagagagcatttaaaatgtgataggaagcatctaagtacatcgacttctcaggatggttaaatcagagagtgtaaagttgcgattagtatttgttactgaatggaaaactaattcaaacacaagtttgcaaggagaacacttgtagctggctcaaaatcataggccctaactttgtctcattacatttgaatctgtttaaatttgagtaccatgtttttctgtccttgcaaaacgtcatttagttagttgaggtggggctcagagtttctaggatagttgtaggatgcctaggataaatgatgctctttgttccatggatatcaattgtgcccttcattcagaccagcattctcagataggtgtgcccacgaccgtgaggggagctcgtccaaaaagaataaagggagcaactcaaatgcatccctgtttccaggaagactgcccagaggctatgccccacttagtataaatcagccagatctttttgtcgagggaagaatagtgctgatcatgcaacttcctaagtagaagatgaagcttgatttcttattaataaatatttggggggtataattttaagtgggcaagaattaagattctgaacttttccagcactccctgcacagagctttttttctccattaccagcactgaaacatttgttttatttttttatttttatttttatttatttatttaagttttagggtacatgtgcacattgtgcaggttaaaagaacttttcttcagctctcagtgttctttcttaataaaacaaatgtttcttcaaaacatttgttttattaagaaagaacactgagagctgaagaaaagttctttttatttctaattctccctaaattttcaatgatgtgaacataagcccaacagaccaggcttatggcatactctaaaattgcagtagaaactcgaacaattttttctacttcattttatgtaatggtgacttaattaggggctaaagacaggtgaaagaagttgtcccaacaacgagtatttaatatgtcaattttttcagagatttgtgccattgcaagtaaataggaaatgaaaagacaaaatttaactaaagatttcctgtatctgttagtaccaaagccagataaatttctccagaggtcaacatattctccagaagctgaccacatccaattatttccagcccacgcccaacacgaatcttatgctcctgcagacaaatataattattacaggcagagaatggtatgtttatttccacctcgatgacttgccggtgacaacagattctgtattctggatctcttcttttcccgaaattctcttgcttagcccatttttcaaaactccactgaggttccaagttcctgtgatgaattcagctcattttcttactcatccttcttttagatgtatttttaaattttaatatgcgttttatcacaattattttaataccttaaaatatttaatattttaatactttaaaatatcctagttttttgttttctgtatcattacaaatatattggtacataattctaattaatatatgtaattttccctttatactaattcatgcacttgtgccttgtcttcccaaccaaaaccatctagatcctcatggataggatcatatttgacttttatatttttaccctcaagctgtgcaagaaagtgcctataaataatggatgtttaataatgatggtcttaatgataactaatatatactgagcacttcctatgggctaggtactgtatgtgctaagttttgaacagtagtatcttgtgatcatcacaataatcccacttagcaggttctattttcattctcattttaagctaaaggaactgaggtagaatgtgatcagtaacttgactgcaggcacagaattggtaaccagcttcacacaggtatgcttgaacaccgtccatgttttcaggcatactcgatggactaattagctccacaaaaagccagaagatgcaagtgccaagtgacatttgtctcaatatgccataaaggttagagaagctgcattttttttatagtttcactttacagagaactgggctcattgtggcaaacaagcaacttgctgtgccagctggtacatggctatgtgtcattgcccacactgcagtcacatcttggagtgcccttccaccccacagccccatagccccacagccccacacccacctacaaatctcttattcatccttcaaaatcaagctaatatgttatcacctctctgaaactgtccttaaatttcccagggagaggcaacctctccttctctcctctggttttccttcattttatccatgcatttgccatagcatttagtactgtataatcatttaccttctcacttcgagagcttgaattccctaatagcaagtagggagggcttgttacctttacctctactgcctggcaaagggattagtacaacaatgtaaataaataggtcttaaatgagttacaggaaaaaaatgtaggttatacttggaattagctgtctcaactccggaaatggcacattctgtcgctattctccggcatctcccccaacttcacattcccagaatctttggaagagcaaaaactctcatcttcaaagacaattgcttaaaattttccaaggattggagcttctctttcacaatcatttcattggtggggagggtaaagggaggaaggaagaggtcagtttcttttcctgaatgacattatctctaaagactctggaaagtgataagtgccatttagcactcttttatttcaagtgtctatgatgtgaagagtgtttgcttctgcaggctgagcagccccattggagtctaatattagacgtgatataagatgtgcacatctttcacattatgaggctttatgtttcaaacccccataccttgcctctgtgtatttgacagctgctgtcctgcaaggcaatggccagtaagaggcatgattgcactaaattggaagcatgaggcaaaagggtgtgtttttattaggggggcagggaagaaatttgagggtagtaggttagaagaaatcatccacagatgctgatctctgtcggttagtggatgtgatttctgaattgtggtaattcctgtttctgtgacagttcatcaaaaatcgagggcactacttttgaaaattacccatggtttcatttccaaactagatgcagactctgtgcttttgattattagaattattcaactcactctgtggggcaatgaggaggggcattgataaatcctaccccaactgatactctgtaagagattcgttacagaagcatgaggtggcagagcaaactccatcactttttaacaagtgttatctaaacacacagtggcaaccgatgagtgagccaaagtgacaatttggaaattcatttctctccttcagaaagtctgtgtgggttgggaacagtagaactaaaagatgtggagacaaacttttttctacttttattaagcatttctagatgaattgtgaaaggcaactcagcagatgtctactggcatctctctttccccaaagacttcttttaaagtcatataaaacacttctcataccagcttgccaatgggtgaggaggagacaatacttcaaaaacttttcatggttaacaccagattgatagttcctttagcaaagctaaatcttgaaagctgtttttctttcattctaccaagaactggctcaggttgagtcccagcttttcttcagggatatgggaacactcagatgggaactgtgtagatggaagaagtgtggaaagggagagatgagtgtacattggctacgtctagtgcagggaaatcatttctccactggtctcacgtacagctggccaccctcctgatcttgctaaaggggcatataagtgccattgttaagagatggggcttaaaatgtaagaggagtttcaagagaagtgagctgcagatccacataggaacatgtcaggaattatttaagtggccggtaatatgagtatcatgctaccaacactgaacagtttatcacataaatataattgtcttctttgagaagaataataaaagctgactccatatgttacatattatttaaaattgttcctgcaagatgtattagtcccagagaagaagcaattcttctaccagaggacaacagcagttttattgtataacattgtcatttgtttaatttgtttgttcccagtagtagttttacagatttttacgaactgttacttttatagaaagttgagttactcatgatggatattgctggcattcgtaaagacaaaaatggggggggtggaagaggtcagaaaggtagatggtgtggatttccctaatgaaatttgcttaagccaatgcttctgaattcttagagaaaccaaaaattactgtagggagttaggttctgtttgggacatttctaagatttttgtgtgagtttatttaaacatgatcaagttaaactcagtctggaagacctcttgtgaactgacaaacaactacttttattcagaaataattgtgagtaaatgggagttctccgaggttttatgtttttgtatttgaaccaattaccaaagaatactaattttatagttcaatgtctactaccaatttttaggcattttattggttaagaaaaccagtttcctctgtcatttctcacaatttcaactaaactttactttttagctaaattaagtgaaacttttctaggtaaatttggaaattttggaattttaaaatggaaacattttagtttgcattctcctttgactgatagatttaatatataccgaatgagaaaatgccacccaagagtaaccattcatgttttttgaactgttaaaatgcattctattgcagtttcacaacactgaaagcaagtgtctaaaattaccgaaataaagctgtcccaacagggtagatgaaaaactggccagataatcagcagtaaagaccaatcttctttgatatcaaggtatctagacattcacaatttgttcatttgtagcattctggcagacttaaaactctagacgagaatagccatgctattgcaatataatctggataattagagcatttagaaatccgacaataggccatgtgcggtggctcatgcctgtaatatcagcactttgggaggccaaggtgggtggatcacttgaggttaggagttcgagaccagcctggccaacatggtgaaaccctatctctactaaaaatacaaaaattagctgggcgtggtggcaggcacctgtaatcccagctactagggaggctgagacaagaattgcttgaacccccaggaggcggaggttgcagtgatccaagatcatgccactgcactcaagtctgggcaacagaacaagactctgtcaaaaaacaacaacaacaacaacaacaatatagaaatataatacatatctacaaaagccaattgaagtcaaactggaattctgcaaagcaatctttatgaatgtgagtaagttaggtcatattaggttggtgcaaaaataattgcagtttggccattatgtttgcaccaacataatacatcttttattctcagtgcaagatttttgatctacatttctgaatagcttggaaaataaagtatggtcacatcagaaccagtggcaggtaaaatttctaattataaattggctcaaatgatttatatttgactttggaatgtcttgctaatatcttcgtacatgtattttactttttgctgttaaaacattttctaaacatactgataaagactagagagatggatcagaaacatactgggtgttaaaaaatcatcccgaggtttaaaatgttctttctaaatttagataaacgcaagataaatcccacaggaagttcacaattccatagatgtctaaaactaaaagaatgcagagattttctcagctccatgccgtttcttgtaattgtatgttgactgagtagagagttataaaaacaccccagcctgattttatgcaactatattgctgtttgtcaaaagaatacttaaaaacttgtcaaaagaatatttacaaactatatttaagaatatttaaataactgctataaaatttaaataatacaaaaatatacaaagaaaaattacatcatctagtcatttcataaataaacacatacataaatatacacataaataaatatcttaatatttagtgaacaacaccattctagatggccctatgtgttggtgtagagagattgatagagatgaatagtcagataaaaatatgattctgccacagtggttattccttagcaaaaatgttttatgtttagttctacttgaattttaagaagaaaaagaaattaaatgaacttgaaaaatgactgaacttcaaataaatgtttatttgacccaagaaatattagcttctgaaagaagtgtttttaataaaaagtgtttttattttagaccaaatctttctcattgatgaggaaattagtacaattattcttccttccagatagtcttccaagttatttaggattttattattgaaaatgttatattatttacatttataagtatatccccaatattgtttggtcttattctatgctgcacaggaaatatgttcacccctttgttattttaccaagttttctctgtaagggaaagtgccttgctgtaattttgtgtttattagatttaagcattcagttacttttccagaaagaatcatggttaggctactctctagtttctgaatgtttcacagtgtctgcaaatggtcttatactggaagagcatgtcacggtataaaataatatatctatatttaaatttctctaaattttgcacactttttcatgtagcactcagtgttgctgtgaagttctctgaggtcattcctcccaccaccacccccttggttagtatgatttacctgtgctgcctggaacaccatatggctatatttttaattcctaaattttaatagctacactaggatttgttagattaattgttctatgtcaaattttcctgggactaagtgtgtcactttagtaaggaaatttaagtccttctgtattttcaaaacttttcttctattacatctttaatttttttttctgtggcatttgctctattctcttcttcaagagaactagtcctatttttcttgtgtactgtaatcacttttatcaatatactaaaactattcatagacatattttatgtctttaatctttttcttttcattttatataatttcttctagtttgtataccattctgtgttttcagtcatgcatattttattttgcttctactttgacatttatagggatttgttaattccactaatttcctgagctctacccactgcttttcatctttttgaatacttatagttctttttaaatactctttccattgcataatatgtaaatattttttttttaactataggttaactatttgtctgaattccactggtttcttgaataattcatcttctgatgtatagcccttcttcctttttacttgggtctaattgatgatttcatgctgtttctgtaattagctactttttcttgaaaaaggccatttactcaattactctaattcttgattagggcaattttactcaatctcaatctctcaatctctcaatctctctctctctctttctctcctcctccatccctctccctttcctccctccaacacagctctgtgtgtcagaatctagaaatttctgtttcctcttcctccttcatgcaacttcctctttggcactgttcctatgtgatgatcctgaggaatggacaataaaatgattttgccttcagtaccacctcccttgactttctgcagcatgaaatttctaggtcatttccttactcataggatacagccattcccatgtcctgatactctaatcagattgtcagatattactcttgaaactgtaaccctttaaaggaaacctctttcatctgccatttttgaagtttgtgttgactctcagattcttccctcatcttggtgcagacttcgatttctatttttacagtatttcacagtacatatgactgtgtatggtttgatgctatggctatttttgttttactaaagattgaagggttgtattgttagtgtggtggctctctacttttcagggtttgttgttttgggaatgttttgaaagaaattagttctgatgcttttcactagaaataatctatgacctgagctcttgtggactcctaaagtttgtgccactgtgtttcggtcttacttcaaacattacttttaaaaaaaagcctctttctattgaattatttcaaacaaatcaaatatattatgtttcctgaataccccttgctttagttggcttttcccttcccataatgaaggatgaggaccttcctttcctttgtcttctgtctttcacagtcgtttctggaataccagcccttctatcagaactggatggagacctgtggacacccctagtaagctgcagatttttcacagtggtcatttgacctccagagcaagccaataatttgtcacttcattaaactggtatttatatttattaagttttttgagatacaatccctagtattgagtgatagaagagcagaaaagaagtctactgttgttagcacctcaactaactgaacccattaaatcaaaagcctttctcttaactggactcaccttccttagaagacgatttaacaatgttttctttctgctcaaggataatcatttagaattttagccctcttccttctttccaaacagcttatcaaagaaggctatgtaattgtccccctaacagaagttctaataatataaattcctcccactcattagatttcagttatgttttacaatcccttttggacaggagctctgggaagccaatggcacctgctgtctacccctccatctaactttcttccctttactacattctggagaagccatctcagttgctctaagtacttatgtatttgccttttcctaatattggagaaaatttaagctttctatttttttaatggcatactccactgcatcccaatttgcttttgtgagtagaagagacaggtgtaaatttttcttttaatttttactttaagttccaggagacatgtgcagaacgtgaggtttgctgcataggtatacatgtgccatggtggtttgctgcatttaatgacctgtcctctaagttccctccccttgctccccacccctaacaagccctggtgggtgtcgttcccttccctgtgtccatgtgttctcatttcaactcccacttacgagtaagaacatgcagtgtttggttttctcttcctgtgttagtttgctgaggatgatggcttccggcttcatccatgtccctgcaaagaacgtgatctcattcctttttgcggctgcatagtatcccatggaaatttttagctagttaaattgacttgtatacactctgggcatgcccaccaggaattctcccacaaataaacatcccctgtactgtgttaagcaataaatgattctggaacctgttcttttctgcccagtttaaaccctctgctttttggattgggcaagttttctatactctttaataaatttgttttcatatttgttgtcaaccagctgacagtttctctgccctttttataacctacttcctgattcaagacattgggtcaagacttttaaaaggccttgacttcccttttgctgattcctcttcattatttcacctattaaactaggcatgaaaaaaactcaccattgggccctcttgcctacccactactccctcagaaaacttgcagagttcaagcatcacttgcaatcaaattattctcatacctgcatttctaacccttagtttcctcctttcaacatatcattagaagtgtgattttcattgcctaaatatatacttccacttaagtagtcactggtcactggaatgatagagaaattttatctttgctccaagagatctacttcttctccatgtactctactgcttatagaaattgactgcatttcctttccaaaggtgacaagtttaagtcatttctaatacctgctttttgtctgtctcaaccacaactttaatagcatttcttgaacacaggcatcacactgtggactttatttatgttatctcatttagtaatcacagaatacaaagaagtagacattattatctcagttgttctggtaaggaaactgaggcttagtgaggttaacttactcaaaggccccatctagtttgtgacagagccaacattcaagtctagggttgatggactctaaagtcaatgtgctcttagccactttgcatatcattgccttaaacccatccctctttaggtctagggtaggcttcttgagtctgcagctactctcttttcaacaaacatcaatcaaatggctatgatatcccagacccaaggtaacaatataaagatgggtaggatgaggttcctgttcaaaagacttttggagctagggaaaaacagaagcactaaagcttggaagtaattttatccattaaacataaagtgaaactgttaaaaaattaaaattaaactcatataaataggtgaaatgtattttttcaggtatttattactttatgtgtgtaacttaacaactcagcaagaccgattttggcagaaaggtgtggcttatatgattctagaatatagaatacagtatgaaacaggatacttgacttgcacagaaaaatatcagtgaagatagtaaggattaaaactcattttgtatttgctccatgaagcagtcactgctttctagtgcccttgattcacctgaatgtccataccccagctgtttagctcatttccatgtgcatgccccatttctccttcttgagagaaaacaccatcttttaaatattttcttaatttttcacaatctgttttccagagtggatggcaatgctaacaggcaaaatttctgtttctctttaatttccaattaaaaagtagctcagaaacacttagcatacacttttgctctgttttcttcatagtattacagcacaaagctaccttgtttagttgtcctgtctgtctctctccatgagcagaaggatcttgcagtctcactcaccactatatcctcaaagactgacgccatgataggagtttaataactgctgtgtgagtatagggataaatgaaaagatttgggacaacagccactttagccctcactcctgtcctccaggtcactcctctcttgaccactgcataaaggacatcaggcctcagctgcctggccccttcttttcctcacccccaaccatccattcctcctgggtatctttatggaatctaagtgctgattagaaatccttccagaatcgccttctataatgtttctgttttattatctttatttttctagtagactacaagatacttgaaggcagggtgtgtcttttattttgtcactaacagcatctagtatattacttgggccttcactagatgttgttccagtggatatttgttattgaatgttttttattaattggcaaaaaattaagtttggatgtgtgccatgtatagctgcacattttttatcaagtggtgagtattcttgttgccgctgcttcaaagacttagtaattaatacatgtatctttgctctctctctctctcttgattcagtacctattgcagatgatagcctcatttgagaaacacagattttctttttatcatttatttcctacccaggagttatttcttcataaaaaattagtcatccaatccaggtcctagtgagaactacatgagtttgggatatcatgtgcatataggagctaaaaatatatatattgtaaatttccaaaagtatacatttggtgcttaactcactattcacagttactttattatttttcctactaatcctttccaactaacttctatccagaggatccacttccccaatcgatgtgattttgctttctatttttcagtaaaattttcaaaacatatgcattaaatataatattagattgtgacagtcagaccattcatttcatttctaggcacaaaacaacatttgcttaaaaatgtggatcctggaatcacagtggtttggggtaaattcatgccatgctgtgcaaaagtggcacagccttgaattggttaaaatacttcagggctctgcttcctcaactataaaataagactaataatacttcctaatttataaagttttaatatgaaacccaagtgaaatagatgactattattattgttattattatgcaagtgtttctgggataagttggttttttttgtttgttcttttttttttttctttttttttttagagaaagtcttgctcttgtcccccaggctggagtgcaatggcacgatctcggctcacgcaacctccgcctctcaggttcaagcgattctcctgcctcagcctcctgagtagctgggattacaggtgcctgccgccatgcctggctaatttttgtatttttagtagagacggggtttcaccatgttggccaggctggtctcgaactcctgacctcaggtgatccgcctgcctcagcctcccaaagtgctgggattagaggtgtgagccactgcacctggctgggataagatttttataactctattttgagaaggatttttgtctgaagaaactcacttttatcactttattttgcccaaataaagcactatagtccatatctctgtttcaaatattatttattaaattcaatgtttcctggataatatgccctttctgaatgacagtcaaatgccattcagtaattccctcatttttttctgccaatcctaatatatcctcatttgtttataaacaattcatttttaaaattatactctcatataataagtgaagtgtctttattttgttcagatatttattactttatatgtgtttaacttcataactcagcaagaaattatagcatcattttggaaaatctccagtcaaactctgatctttgcctataatgtatctggttttatttaactgaaatgggagaattgaatacttttaggtttttctgctattcttagttgactatttgactttagttgtgtcgttctgtaagaaaccttgacaagttaaatttatccatacagaaacctatagttaggagacctgtgagatgactataatttccttcccattagtttcaatgaattccatgcatgtgaaagagaattggagagtggagtctgcagccctgtgtttctcgttgtgcaggtatattgaggagggagatatagtccaggtctccttaagttgttcctctgctgcacattacccttaatcctcctttgagcaaatgcagactagagcagctatgccaagaagagaagacttaactctttaaacacaaggggcccttggacacttagcttatgcttcatacaaaacctgtgaaatggttaatatagaaatgtgagtgtcatttgtattgtagccaatatgaaccagaagaattgagctgtagccagcatttatttaagcatcatttttgccatctggattcttttgtggggaaagaaccattcgaagggaattgcctttggttacaaaggtgatttgacttttctctctatttatatgtgcaccatcccactggcaccgttgttcaaggttccataaagagacacttttgttctactgctgcttgagagtttaggtagcataggagagcctgaagaagatgtgggaaagcgtatcaaacatttttgtggacaaattggattcataaaggacattggcctgtatgtggaaaaaccaactaaataatttaatccaggtaaaaattatgcagccattcactcacacaggactcattggcgtcttccctaaaatacaagtcacttgatgtggcaaatcatttgtaggtcagtgttcaaacccaaatgcttgttggacacctacctgtcagctggtttaggtactgattcaatccattccttagcaatgaacctgtaaacaaaaaatggctatcacccaggaatcataatttctaattacctttgacctgtggcaaagtacaataatttaaagatgatagtgagcctctattacacaaatgttttgaagattaaaacttgagaagattggcattcacatctgggaattataaattttattttgatgttagaagaaaggcttttacatgagtatgatctgatatattttattgttaggtttataggattcagaatccgtggttattttatgattatgtgatcaggtaatttttatcttatctgagagctctttcataatactgcattaattaaatcgctcatctgaataaggagtttaaatggtacagtgggcaatgaagtaaaatctgtagaattcccagccatagcacatattattttaaactatattagagataaaactatttattgagtgctaacttctgcagagccttatcttaaatacccctagaatatataaaagaaacactcacaagtaaaggtcttttaaaccaacaataaagtaatagatcaacaaatgcaaaataatataatctgtgcaaaatatttatgtgccattcacatacacgttacaaaaatgattgaaatggaaatgaaaattattggtattctaagtattcatccccttatactattaattggaaactgatatattatttaactcttaagcagaaatgtgtgatgtttaaaaataaacagcaaattatgaagtcacaaggtaagtgttaaaatacatatatatgtgtgtgcatgtgtgtgcgtgtgtagatgtattaatctcatcattaaaaggaggaaaaaagagcctttaaagtttccattatccattatgtcaggtagcaaatatcttctcaatgtaactccagacattaaatctgtcgagaggaatgctgtaaaataaatgtctgggataccttcataaacaaaaatcttatttccataattcatacagctggctggcatttattggcacgtcaggtgcaatggggacatttcaggaacattaacatgtacagcatcatttgtcaacaaagcaacaatgtaagcaaatcgttcagaactcatacagatttacagctttctccgccagctgctaattacggtgtgctcggcctatttggtatggtctttttattggaaaatgacaaaggggttatagtatcccagtttggaatatagatgtggcttttagtaataatatgaatgtaatatgacgatgtagcttggagttgtgatccagttttcctggtcttataattgatcagctttgattgatgaaggacaagagaaattcacagcctattttgtttctgatgtaactaacctctaaaacaaaggaaaaataggggaaaaattatcaaagaccatgtcacagcagttcttaatgtttttccctatggaacatgacacataatatttacctctcaaagaaaatctgatatgttgattgctggtggagcaaatgttacaggagcctgtacatttcagaattctacgttgtactttgaacaatcagaaaggccttacacaaatatgcttaaataatgttaaggttatgacagaaggtgacaaatgtcagcagcatcaaagttaacatctataatcaccccctgcttacattgttcagttttaggaaaagacacaaccgtacaagcaaatgatggagtgtcaactctaccttcaaattccctggattgtgtcaaggcatattataatccataaaatgaagagtggtgctgtctttgtgcccatgatgtaaatctgtatttagagatggtccttctgtttaaccaaaatgcaaaaagctaaattggtaaatacttattcgaacattgtttagatttatcccatcccaaaccttattaaaatccattaaattccagagtgaaccgatttgacattcagcaaatcagttgctgtcagagcagctgacttgaccagatattaaaatattttcaactttgctggcatcagatcctcggcccttcctagagctgataatgtcaggacagcaatggttgactggatccaaaatgcattatactaaataagtatcattctcatgttccaaaaataaagattctaactccagaaatagtttgcagatagtgtccttctattttacgtaatgccccgtggaatcctgtaccatcttcgcttacacatttgtcattatgtattgtaattgttggtttcttcctcctccactagaataggattcctaaaatcagcaagtaaattatgtttaattttgtaccctcagagcctagtactacctggaatatagtagatgccaaattaagactagtcaaaagaatgaataaatgtgtacatattggggcagccctgcatgagattgtgatggaggaggaatttgctttaatatcttgcccactcatcctttcttgaggataccgtctcctaagtcctctgagatgcatatttcccatatacttttttctttgtcccttattctaaaacctacttgcagaagagtatctgaaactcataaacattaagatgtaaaatataaacaatcttccaaagtattgtcttttccaggggcatttatattcaaaccaagatccatcccttaaactgaaattgaaaattaatttgagggtattagacattattttttatgtaaagaaacatttttacagtgaaggtaccatcttggttttctttagtagaaaggcactcactcaacttttccccaaaccacccttgcttggtgctaaatggagatggtgttggttctattctccaggattatgtggcatgtagattctactaggaattgaaatgaagaccttagaatggaaatgtggcctagctaaggaagaatactatgattttaatttgcattaacatgaagtccttctagactgagtcaatatgaagagaaccatctagtgcatcagaacagagccttttcaacccatattattgtctttgtgaagcaaaacgtgctgctggaattaaaaacaagcaaaaggttgtattttttactgttcaaagaatgctaaaactttcaatgcataacaaccccagagaaacagggttgatggaatcagagaagttggaggacagacaccttaaatttaaaattgaatacttgtgaagagttgcaactcatagtctgcctttaaaatatagctgggcaaggaggtcttgtgtcaccctatatgatgatcacttcaaattggttttaaatttacaacaattatttgaataaaagccactatttccaaagccacccatttgcctaaaataatctctgaaagtaagttatttatatatatttatttataaactagcatttgtattaacccttacccaaatggttatccttacttgtatttaaaaccactaagtcagtgctttagaatagtctatgttaatctttacaaataattcatgttgcgctaattaatgattcatacatacttgagagagaatggattgatgtttacctgttcattatgcaaaaagtcttcacagaaaatatttccaaaattccaggaacattttaagtgtttttaattattttagaggtatctatgtatcttcacaaaagtaatattctaactataaatccctcataactaatcatttattcagaccctctaaggaccttcactaagaaccatttattatcctcaataatacataagaatcctattttaaatgatctcaaagttgactacaatttgtatttctcactaatttaaacaggcctctcctattcttgtcctcttcctacccctccctcaagcttcccatggtaatacatggctactaactggattgaaagcataaatgatatgaagcagagttttgagaatttgtaattcagaaaatatggcaaaatctaggaattctcatattttaatatcactattagttgatttgcttaaatgcaaaatattataataaagaaataaaaatataaaatttgtattttataagagcaatactaaaattacaatttaggatgcataatatgtatatatttaagcctatagatctcaatacaaatgcaactgaatgtagaaagtctacctttaatccagtttatgaggaaatgtcttaacgtcacctttctaggagaaagcaagagaccaatcatgagaaccatttagtccagcaatctctcaagatgccagtcgccagcttgatggagtgagcatttaattagcctagtaattccctcctattgttcccttctcaactctaattgaagagagaccttaatctcaaaggagaaatatttaacttttaaaaatgtcacagaaaggtggaaagtaactgttttgttaagtaaatagcatttactcacatgagaaaataacttttaaacaaatattttatgtttgtttcttaaggtctgtagtaaaacaaaaacaatttcaagcaaacaaacctgagagctcaatatcaacagattcttttgaaaaggaattatcaattgctgctgccataacaaaacacttaagactgggtaatttataaagagcagaagtttattccctcacagttctgggatctgggaagtccaagatcaagatactagcatctagtgagggtcctcttgccatgtactcacctgtcagaaggcagaagaacaagagagagtgggcctactcctgcaaaccctttttgtagtggcattaatccattcatgagggcaaagcctttatgacctaaactcctccccaaagtctccaccttccaacactgttgcattgagggttgtttccaacaatgaattttacaggacacatacagaccatagcagttattataaggacatatttcaagaataagctacattatcccagcaggagtgtctgaaatgcatgaagttaaggctaacaaagaacatctaaactaataggtaaatccaaagaaactccatgaaacaaggaagtctcatttgtgtggtgtaaaataaaagtctagatacggatcaaatcttggtcaaaaatagcatcaaatgtggctaaaggagtgatcaaagttaaaaacttcaaatgcctttagtatttctggaagtaaagacttcagttgtattaagtgaaatacacgtgttaaaattccgaggccatcatgctatgttacacagatggtcaccatccgctgtaaggtggctaaagggaaagaggtgagtagctggcttggggtagccacccaatagggctagccacccaataggtatatagccacattataccttacccctttactatgcctggcctgatctactgcagcaatgagctgttcactctttttgggctgggctcagtagttcacacctgtaatagcagcattttgggaagctgaggcgggagggtcacttgaagccaggagttcaagatcagcctggacagcaaagcaaaacccccatctccgtaaaaacatgaaaaataaagaattttaattatccaggcatggtgtacgccttcagtcccagctactcaggaggctgaagtgagaggatcacttaagttcaggagtttgaggctgccatgagctatgatcgcaccactgcactccatcctcggagacagcaagaccttatcttaaaaaataagttggttttttttttttaaaaaaaactaagttttattttattttttgaagttagaaagtatgcaacttgtctgtgggagacaaaaactctgagaaatatattaaacattggaaaggaagggagagtaggggtacattgttcagggttgcaaagtgaagttgagagtcttaaatagagggaggcctatgtactttcttaaaatcaaaccaacagcaaataggaacacaagcaatagattctggaagaattgtttgctatggagtaaatcatgtatttgtctattcaccaaatgctatatacctagatgcttctacaaggaagaacaaaaaaccatgttaatgaactcagacatttgaatagtgttgttgctgtccatagatgagagctttaatagtgttgttgctgtccatagatgagagcctaagcagttttcctaccagcaaagaataatgtaccttgagaaagatgtgtgaacatgtaagttcctattaatgcacatttatcacaaaaattaatctgagcataagcaatgggcaatgtgagtgttgaggatcgcttgaaatcaggagttcgagaccagcctgagtagcaaagcaagacccctacccccgccatctacacagaaaaaaaaattaatggtaactaaaacacaacgaaaatattgtcaatcagaaacaaataatacatgagaaagaaacgaagccataactaccaaaaccagaaatgtatgtctcagagaccagaaaacacttttgatccaaaattaaatatccaatattttcacacagttagaattcatcttatatttctagtctaatctatgcttgacgctttccattgctactgggtgacacggatcacttttctctaattttgttttcagttttgctatttcttatattgtgtatctgcctccatgagttttaaatggctaaattatttgcttagaattcaggtgtttttcttaacagattatttctagctgaagctgtttctgtcacatattgttgaattccaaatgcccccctaaaacataaccataaaagtaatttctttcctatcctcatcaacacttcagatagttaatagctgcgggcacatgttataaaagaagttgctgaagaagggaacttgaagtgaatttggcatagagtcatggatggtactaaacacatggatgaagttatttacttaaaatttttcttgtcggcctgatttggctatattttcaaaattgacacatactatgctgtagacttctattttcactagctgagaaacagaatgattacagacttttgcatgttatgcatttttaaatatcaccaagttaaacttagattttgattccgtgcccaggaccaagtggaaaaaaatctccatcttcaatagttcctattatcttttagtcacagggccacatactgtatttcttccatgagtaaaactcccacttggaattccaagcattgcataactagtggagtattcatatcatatataactcagtaggccttcatatcctaatcagctatttcatctgcacaatattcttcttagcagttaaaaatcttaaaatcatagttcagaatggagccaacatttaattcagccaacaaatatttattaaacacctacttctactactggtgttacaaccatgactactactttacatagttttgtattgctttaaattgtttttacaaacctcatctcatttactacagtgaaattacctactgctttgaaggagcttagagactcataaagtagattaaatcaattgtcagaaaaactgggctttaaagaacttgtctacgatggtaccggctactgtagtattttagatgattttggtgaactctcagttgattttaggtaaaagattcatctgcacaaatgtatatttatctttcattgtattttttattacaatctaatattttttaaaagctaagaaaatgcaatgaaaataacattttaaaaagtgtcagctatatgaatgatattctttaatgcatgtcacatttaaaatatgacctatttttaaagtacattgtatatgtcacaagccagatttggtcacaggccatggtttgctaatctctgtcctaaagcaatatggtagttctgaacgtttggctgaagaacatggatggcggtagaagtccctaaactggtcttcatagcttagaataacagaactgctgagtttgaaggaaaccgaacaacttatctcacttactctccaaacactgttcaatttctcttcatacttttttttacaatgtggtagtctctatatttatatttgattcaaaatataatgttttaaaacggcctgtactgatgtctcttcaaaatctttatcttgcttaatcttagaaactttcttgccaaggagtgtaggagtagacatgatagcaagggaaaggtaatagaataaattttgaaagctaaatgctttattttgatatagctaatattcatagaccttaacatttacattagtcagcaatcaaccaaaagtcatagtttcaaatacacgagggcagaatctgcctagctacacaggatttgaccacttaaaagttgagctctatgattattctgatgaagtggattggagaccatcacctttctcttagtaaatatttgtccttcacataccaatcgtaagtataattaagcattttttacttcatctggtgcttcaaattttgtatgatgcaggatttagttttctattctaattcctaaaagccatatttcaggctgcattctattaggggtgtctcacttaaaataagaatactattatgtagcttaacttgcatctatttcctttttattatggccactcaattgttcctgactttctttgggaatgatttgttaattttattccagtctcagctatgtgccttcacttaacaatgaacattgactactggatacttagcttaccttttttacaagatatatatttcaaggttttgttttcatataacataaaacagtaaggcattcattaatcactattaaattcattcttttcctctttattgaattctaaaggaaaatcagctagtcttttttttggcatgtgtcagcaaaagtatgttattatgaggtgttcttaaataatatatcttcataaaacaatataggtggaggtttaaggagaaataaggaaagaaattggaaccatctggatatccaaagtagagaaaagtttttactaatggttgtcatgtacacgttacaaaaataacattatacagctttctaactggacaggaaaaggcagaactatcaaaaagttgaaaaagaagatagccctggagtgaagcaattgacaaataaaatcatttataagacatgcatttagaagaaaagtggagattcatggttcttgggtcagtaaggattaaacatatctcagagatgacctgcttgttcctgggaatcgaaatacagttgcattccaaaaaggatggctccctgggaaatgcaaggaggggaggacaggagggaacagatttttgttgttgttgtttttgtttgtttgcttgttttcagggatgagtgggaaagcaccttctatgtacttgctcctaaatcagcctggtgaactgggaagagtagagattccatgaaagaaaagaatgtgaatacatgctttggagataagacagaaaatgggagaaaaagcaaagaaggaaagaaggaagggagggaggaagaaaagagagattctccagagacacactgcactccctcacatgtaaatgttatattaaagaagcaatatcactggaaattcacttcatcagatatttaagtattaatacataaattagaaatcaattttaggagtgttattcctccaatacaaacatttttttctggcttttcatctccttgtcatattcccagcaaataaccacacagacggggtgtgtgtctctccttaaatgagattagtgaaggtggcccgatcaattatttttaagcctgaccaaataggcgtactctaatcttgcctatttcagcataatgttgcccagcatgataaaatacttatttaaacaggtgtatcagtctcagagatctgtatgtatagtttaccttgaagtcaattgaaaacagaatattccttattgattttgcctgcctggctgctatatgtagtcaatgggactcacgtggatgtaaatagagtgaatcaactccttgctggccctggacctccttgagtcatgtgaagtaggtttctgattcctttatgttcaggcacagccagggagacaagagtactactgtcttctgctggtgcagagagttacctcaggctatgcaggaaaaatccttttttcttatttttagacctgaatcagtctatgccactaaatgtattcttgtgaatacagatgcactttgttgtcatgctcgtgggaaggcaatggagtaacctgtttggacgcagctgcaggccacctgtagagaaagtcaaattagggagagaccccactgttctttgcattaatgctttttgtattgttgtttgacttttccccctctgtcgatgtatctttttcaactagggagatcgggagcacattttaaggccttctgtccctttaaggcatctaatgattgaaaggactctaagatttgaaaggctgtaaaaactccccagttggcaatgaatgatggcaatacaaagaatcttaaagctgttgaagttgaagtagtcttcttacagatttagtttgtttggtgaacttccagcggcagctcttacaaggtactgttcaaatattcccacctatctgtgctgctgctccttctaaagatttatcatgttctcagtggaaaagtagttatccatattagcagttaactttactacagataagaaacaaaagaaattctaaaagaagaagaataaactcctcttcttcctttcctcatctaccaatgtgaagctctaaaaaagaagcccataaatgaaatatctactttagccataaatattaagggagggaaatgcacaaataaaacttgtttctggaaagcttgattttggctgaatatcaaaaaccatttcctgacaatgaaatccattagactacgaaataatctctcaaagtagtggttgcattgcttataagatttaacatttaaggttaggctgaagacagccacagatcctcaggctcaaatgcagaatgttatttcagaagttggagggacctactcttttgatcctagctgtttctcttgttttgggttcctttacttggaaattcaggttataatatagggttttatattaattttttggtgtcctccaccatggatccttgagagctgtttcagctgactgggatcgaatcacatgaaccagcctgactgtgtttgtgtgtgtgcactgttcttcacgcatctgaagcagaggagtcgtcacaattattctaaatgcagttagaggattctgtctgcctcagctttacaatgtttatcaagctcctgtattaactcagtaacacaacctgccattacaaaattcaaacttttgataaccagcatttcaccaatatgaatttatttatacaagatgccctttcagagaacatattatatctaggtagtgactgagaggttccctaatcaattcttcaagatgcagcttcagtaccttagtcctgaggaccatgactaaattcatttgatacatgtatgttatatattccactaaaatcaaagaagatatgatagaatttgttgcaactaaatagtggcactcagacaactttaattctcaaattcttggcacgcatcctgaaaactcgactctgcgctttctcctaaatgctctgctctcttttgctttattgtagtgaagaaaagagaaaagtaatgataataccgtgcatagcataatattttacagggtttttttgttttgttttgttttgtttttgtttttgttttttgagacagtctcactctgtcgctcaggctggagggcaatagagcaatctcagctcactgcaacctccacctcccaggttcaagtgattctcatgcctcagcctcctgagtagctaggattacagatatgcaccaccatgcctggctaagttttgtatttttagtagagacgggattttaccatgttggccaggtgggtcttgaactcctgctttggcctcccaaagtgctgggattacagatatgagccactgcacccagccatactttgcatttttacagcttgttttcacctatattttttgactaaatgctcacaacagcccagcaactgaggctgagattaagtgataagattcaggacttgaaggatggagctctgactctaagctctttgctctgtccacctcagcgccatagctgaattctcatatgaagaacatttttcatgtggtattctattctgctgggactgacacataattagcaccttaaactatatatccaggtaaagaattagtcctgtgtcagaaacaaggcatttccagaagcataaagtatagcacctcacaacaaggtagttggaacccagggtcaaaaacaagacagataccccaggggaaaaaaccatgtccctagctaatatccctagcaaatgatccctagctaatcatgatgccaaggtatgctgcctcaggaatcagattcgcggcatttaaagtaagaaatttttgacttccaatgtagggagacagaactgatgggccacagggagccaattgaaacctaccttaaaagcattcacctccaggcatggtggctcatgcctgtaatcccagcactttgggaggcagaggcaggcgaattgcctgagctcaggagttcgcgaacagcctggccaacacggtgaaaccctgtctctactaaaatacaaaaaaaaaaaaaaaaaaaaaaaaaaaattagccaggcatagcggcgtttgcctgtagttccagctacttgggaagctgaggcaggagaattgcttgaaactggcaggcaggggttgcagtgagcggagatggtgccactgcactccaacctgggcgccagagcaagactctgtctcaaaaaaaaaaaaaaaaaaaaaaaaaaaaaaaaaaagccatacatctgtctctttcgctacctgtgttttgaagttgaaatgattttatactacttttatccttggatgctttcttcatagcttaacacaggtattgtttaccaattaaaatgggaagctggtttaaatatcagcaatcatgctacaacagcacaattgaaggagtatttgactcaaagccttggctctcctattcacaaattttgagtggttatttcattgaacttccatttactatcttctaaaatgtggagaatatgaactaataacttttccccagattgttgtgattcttaagtgggatagcgaatgtgagtgctttgttatctgtaatgcactatatcaatattattgttatattttgcttcaatatatttattagcttgctaaaataacttcctaagttatctagctaatcgcctttttaacaccccagtctgatctctgcgtgcactcagctcatatcagagtagttaaaagtaaaatgggaaaacgtgagcaatgtataacaatccttatttcaaccactgtatatagacaactcctattttttgtcagctggtatatgagacatccacatgcaaccataaagcctgtgttgtaaagaagtttttaatgccagaaatcccatatggttttgatgtaactaaaaggtgtacactttcctcaaggtcaagtctaaaaattggaccactacaggctctgaccacatgtatgagaagccaaaggacctgtgatctcacctgcctcaatcatgtgccattatttactccacttgcctcttctgaatgggtatgatcccaaccaaacatagtgaaggggaaagttaaacaatatttggaaagccatgtatttggaaagccaatgtaaaaggtacattatattacatttgatataatgcaacagtaattataactatatatgcaattcgtatctacataagccatgatagtggaggatttcttgaaattactttcttttcccccagtgaaatgtcagttgtttttagttttaagttttgcaaaatttggaacctggttttcttacacactgtaaataattactgcagatacatttcagtcacgctgctctaacttgggagaagaatcagcaccaaaattctatgatgtttcaggtggggcagagtgtgagaagacaactcaaaaagaggctggagagtcttacttagcagaaacctcagctctcacttcttttatggctgtatttcataacacttatcttttgacttagaacatttgccaggaaaactttgattcttagggcaaataaccctgataatttagaacttagagatgtcttatgagtttgcaaacatcaatgcattatcaaaagccctgtgaattattagccatttaaataccagctacctatttttttctgattactgtttcattttaattgctcccatttcctgtcctgaccttaatgtttcagtgaaaagaaggccacccacgagagagagagagagagagagagagacagagagagagatctttcatttgtgaattgcaaagcttcagaggtccgaatttggccagtatgtttgctgcaaagccttggaatgctgttttgcagtttcaaaagtgatcatactcagcttcccagaattttttatgcctggaggatgccacaagaacaagggcagccttgttaacaagttccaatctctcaaaaacaagataggattcggatataaatcatcatttcagctcacaaagccatgttctccaccccactgaagggcttcatttacatctaaaatggttaatactgatctgcaccagaactcctaagtggaggaatgcagctgccatgtgcttagtgactctggggttagggaagaatgacatcaccaaatgtaagcatattatcatgctgacatagaggcaccttgttttctcctctgtggatagagcaaggattgtgttctgtctcttgtttttttccgctcgaagaatacctttccccctcccttcttagcagctgcaatatgaagggctgaaaatgtcacttcaactaatgatgaatgatgcttgacctctggatgggttactcagaattttatgcaattctaaattaatatgaaagatcccaactcaaaggacttcggccgttaagatttgcttcaaggatagatttgtgtaaagcagttagtagctttggggattttgttgctgttgttattgtacttggtgggggactgggagactcgtgctctgtaagcaaggtaaaaggcagaatgtgctaacatttttatgtgttatttttttcctgtgagattaatatctttttctactagaaatattgtcagtaagcagaaccagtttgtgaaaaaaacattctcaaaagggcacaggcccacacgtctttgttgtttttatttgaatataattaattatgtaaagcaatagttagtgtaagattaacaattagtagattctgtcaagtagtcacacggaaattactaactaattgaactactggtcgtctattgtgtcagaaagcagtactgagtgtcattctttttatctttttactttgttgttttcacagatcctcttgtttctaagatgtatgtttcacagccgactaataaataaataaccctggttgtaatttcataacatgcaaaaaggtttgaaataaaaacacctgttttaattagcattatggtttgttcactttaaaaaaagtgataatcctgatgcagttagctgacatttttaaagctttgaatttccatctgtatcttatattatgatgtttcaggattgtcatgagttaattatgttaacttgggaagcattgcttgcatttagaatgaaaaacttcagcttgaatagacagaaaagcagatgctatctttcttgtcaattgctttgttgtgggctgccttgcaagttttcatgtatttctggatctaaaaggaagtgtaaatctctatttattttaagtttaacataaactacacaatttcagtattcttctgttttggctgtatgtgtcttgtgtatctttacatgtgtagctttcctgcccccaaattcagaaatccacagtcaaattatctcttctttaattcttaatttgttttgttgtgcctaggcattatggagattagtacataataaaatttaagaataggacaactctactggctcaattctctctctagttatttttttctaccacctttttgcttttgtacatcaaccttttaaatggtacaaaatacatgcagcatctgggcacaacaaggcatgttaagaatggagtaggcactctaagtaggaatttccatgcttttgtgagtttaatgttcctttaacatagagagcagctgtgtttatgtcaataattacacattgggataaatgcgtgtacatgtttttctttatgggattaaggatgttaggtatggccttacacaaaagattcttgtccctcccatacccacccaaaaagtttctataaaattcaaaaccaagttacactgttctgagattctgaaatatttctctaggcatttgcacttctagatttcaactgacagaatatgggattgatgtgtttgtaatcttctctttgcccccccacctcatacccattctccactcttcactaccctgttcggtacccaggatctgtatgcactcgccttccaacaggcttccaactagattgggccaacgagaggcatctgcagcagaacagagggcaggagacaatgcaagaatgccaggactgtgaatgcttaatccctgaattggtgccatgagcaataaatgctcgtgctcaaaagaaagtgagatcaaggaaaagtggatcactctaggcagaacttctgggataaacaatcttcctttgggctttaaagaagtggtgggattgggccataggaggtgggtgggtatgatagcttaggtcaagaatgagcaagaaccacagtatggttcttgcttgggaatatcgagtatactagtataatgggcccagatgctcaggtctgaatgaggtcaaattttaagactgaatggcaggttgtggcctggaaaaagaggcctcgaatgatggaattagaaaacttagtgtttaaaatgtatggtgaaggtgtgttcagtatataaatccaatctgtaagtgatatggaaagtggaagtttattcaatgccttatcacatattcaaatgaacgtatggctgctctaccacttaaaaatagctctgttcattaaaggaaatgtaacctagattttcagaaaattaaaatacaatgttcttaagtcagtttaaactttaactgagattcatagtttggttctgccttcctaagcatttggactaaggcagagagtataaatctgatgggtcatcttcctgaccaatcgactttccattttgattgcaaacaatccacttgtttatttagatacaaccactgaaccaagtcatttagacacaaacattgaacaacaacccatgtgtttcattcctctcaactttaggtgtattttgcctcataaaatgtacggcattgtaattgttattaattagctacacatcaaagagcttgggttagcagtgggccatgatggcctgaatcacaaagtgtgacttgttcagtgtatttatttatttatttatttatttatttgagacagtctcactctgtcacccagggtacagtgcagtggtgtgatctcggctcactgcagcctctgcctcctggattcaagcaattctcctgtttcagcctcccgagtagctgggactacaggcacgcaccatcatgtccggctaatttttgtatttttagtagagacggggttttgccatgttgtccaggctggtctcgaactcctcacctcaagtgatccaaccaccttggcctcccaaagttctaggattacaggcgtgagccactgcacctggccttttacagtgtatgtaagactaacactactcctctagaaacaaggctgtataccgtaatggaatttaccttcccaaccaagctgatttgtttagatgctgatcattggaaataaattattaatccaggaactcatgttgtttgttagtttttttaatgtaatggtttgaagcaggctgcttatgagcctcgtgtaaaaatgattctgttattagttccagggcataaacttgaatgacactttttcccttcttgctctatatgttgctatacaactgttttcatcccttattgttttaggtggttttgcaaaataatttgtgagataaatcagggttggaatgttagccttgacactaacttcttgtatgaattcgagcaagttatttaatttctctggtccttagttcctcacttataaaatccgtgaatactaccttgctttgttactatgaaaatgacataagatcatgcagataaagtaccaagcacagcggctggcacatgacaggtgttaagttaatggtcttgtcgtctttgttgttacagttgttgttattattactcaactttcacttctatgctgataattttcaaatttgtctgtccagtctttatctctttaccaagctccatagtccaaagtccaaatatctacttagcatcaccaaacaaaagtgtcaatagcatcccccaaccaaactcattctcccaggcatctttttatcaaaaaacaaactgaacaaattaaaaatcctagctactctttctcaagtattacatgtaagataacttgcataactagctacaaacaatagttttctttggttcattccccctttaccacccctatgttcattaaatggatggcctcacatggccttttcgttgcatttctacaaatactatttagttctggccttcatggtatcttgctgggctgtttccagggtcttctaactaatttgcatattcctacttctcacctctcaaatgcattattctatttcctacagatttatcttcgtgaaatacagtctggatatttcctcatacaaacttttgacaattctttcacatctaacagagaccatttaatctattagcataacagttacacttttccctggcttccaagctaagttctcattacatttcatcattcacctttgcactggtcataatgaagcctcttgccaatatcaaattttgatccatttcatacctctttgctagaacagtggtcctcagagtttaacatgcatcaaaatcacctggaggacttgttaaatcatagactaattagtatttgtagaaatgcaatcacacagccagttgcatccaaaagcctctgtttcagttaaaactgaggtaggtcttgataattcaccttaaatgtcctgtgtgtgatgctgatatagctggttctgggacatccttcctcacccatctcagttcaacaaaatcctatgcacttctcactgccattgtgtgggagacgtttcatctgtcacctgtcagaatgaaccattccacacattgtgttcatgagataggaggcaggactcaaccacagaggcgaggctcagacaccaaaccaaaatgaggactagctaaagcagggacagggcagacctgggcaaagccaaaaggcatcccagtgaggcccgatttggagtttacctgtcctgtatcactagcagaatgattgaggttttaggtggagccagattgcctggactccgctactaaatacctgagtgaacctgaacaagttccttgatctctggagctgcttttccatcagtaaagttgaactaataacagtacatccagcatatgttgatgtgaggattaaatgaattcctgcatgtgaggcacttagaatagtgcctgagaagtgctcaactattattggttttctagtagtttatacctttactacaatgctcaatgacgcttaaagtttgtaggcctatctccttttgagatgtcagtttccttgaaagcagagaccacgttgttgtgaatccccagaaacatagccctgggcttagcactttatagaaatccagtaaataaaatttttaattaaatggagatcaaagaaagattgcaaaaggatcttaagtaagtaaaaatcttctaaacaataaacaaaccatccatttctttttccctcatcataaagatgaataaaaatgaggtcaattattaataatacattgaaagtaggtttgccttttcctttgaattttctaaactctataattaaaatgacttcaaattggaagattgttaagaagaaattaatcttattggtaagtaaaaaagcaaatcccatggttgatgatagatatgacctgttagcaatagtcacacttttatattttatttccttacaatcagcatgtggagaccaacataatccaattaactgtaattcccttttgtagcatccgtaaagtagtttatgatactaaaacaccattgaagtcttatctctggtcagataatccaaatggattctgatttgcaaactaccagcaggtctttataaacttcaggaaaatagaatattttgacttccctgaacctacaataaatgtgatacacaaaaattcgtctctgaactctaatcctttgtaaatgctagccatcagttttctagacttctttctctgcacctgtttcttattaactgacttcttttaaaagcatttttttccacagtgaatatccagtatttcaatacatcagagcctctcagctgagcttcttgctcattgtgtctttttggacacaccacccctcttctatacgcccactccaacccatcctacatgctactgccagagcatctttctagaatgttgctcccctgcttatggtcatccagactctttcagttgtaaggaccttcatgctgtaccttctgccttcttttctatcctcaacaccctgagatatggaatctatgcctctagggtctccgacaacttgtggcatcccaaatgcatcatgttcttcattccttggcgtgattgttacttctagttgaatttttcttcatctcttctcttcctctctcccagctcctgcaccaccctcactcacctgactgctcatcgtttaagatcattattatgtgacacctcatctggaaagccttctgactacacccagatgaagcttgatgctaatcttctatgttcccatagcagtctgcaagaagttatataataacatttaccgtacttgattacatttttttctatttgaccaaacttcctatatactatgaaatctttgagcatagaagctagatctttatttatcttatttttaccccagcagctataacatgcctagcacaaaatttgggttcaataaatatttgataagtgaatgaataacctacttatgtcttcagtatttgttaagtgttttgaaagagaatgataaacaaagagaatacaaaaataatgctgtgtgtgtatacatatatctattgtcatcatcgttggtattatattatgaaatagcctctgttatcaaaggaggttaaaatttgataggtggtacaaatatatgaatagctaataaaaatgagtgcatcagtcactggctaagcactggggatataaagaaaaataaaaacaaatttctttgagacagagatagaggagagaccctttgtttaaatcactatagttaaattaattaggcatgccccaggagtgatggggttctcaggctaggattagaaacatggtaagcaaagtttgaaatgaaacccaatgtagggaagagtcaagattaacagcatagatagctaggcatcacaaactatcggcagagaccgggaattggtgccacaggtttgtttaggccagaataattaagatgataatgttgttcagtagtttcaacaagaagttgttgcacagggacctagctattttaccttactttatgcaagtagttgtaaaatttatacatctcccaactcttattttgtgtacctttgtagagctttagtggtgattgtggtgaagaaaagtcctgtgatgcagaaaatttagtttactcccatgaatccaactaatcgagataacttaggttaaaaattatcattaataattactagaaatcatctcttcattttggttgtcttaattgacaactaacagatgtcttatctggggataacatagtttcaatgaatgagagtagcaatatcttaatctaccagttttgtttaccttttatttcaatttttctgaagaaatacttccagacagaaaattctaagttagcaaaaacccaaatccatatccttttcaatgttaccatttctaaccctacacatatcaccaacatagtaaggggaatgataaaagccagaaattatattacattctggaaatatttgccaaagtctgtctacattggatgcttttcatatattacatcacttaaatctcacacaaaattaagaactctcatttgacaagtgaagaaaccagaatgttaagtaacttctatatatgcatttttgcttacaatggacatattatctgtatatgggaatttataggacttagtttatttcctagatatcattaagagataggttttgacttggccctgtgcttcatatttgcaaacgtaatataacttggagggaacaatagcaatggtgttgaaatttaaagccactatgaagcaagctttcaaaaatgactttgtcgaaatttaatcctatgattctctcccctttggagtacgtaatgtatgaaatcatccatggaattccagcaaattcagaatctgtttggagaagatggttaaataaaaagaaccattgtgtacggtatctatagagtacaaaaagcctttgactgaatggaaataagaacagagttggaagctctgagtaagaaaggaattaaagaaatatatatgggtgccaggaaatacatcaatttttttttatgatcctcactgaaagaaaaaagtctgttcatttttgttgctgttgttgcatctaaacaggactaccttttctcagctacctaaacgaaatatctaaaagcctggagagcagcataatgtcactaacgtcattttataaggtagcattatgcatggagttatgatgatgggaagatgttttatgttatgccattataaattaaaaatgcacaaagcaatgacacatgtgttatactttccatctgtggcacctgcttcgcaagtttcagttgcacctattatgttattctttacattcaaatgaaatctgaggagaaataaaaataagacagtcttgctcctaactagcttcctgtactggatagagtagaagaccgttccacctccttccaagagagtaactaaagatatttcatatgagcctgtgacatgcgcatgctttggtcttctcaaataatttccaaagatatgcacaaaacctcaaagcacaccgaaagcaagctaacgtggcgtgccaaagtagcccattagatgttcagaaataaaagcttttaaagaaaagttttaaaatcttagaaagtttgtggttacttccttcctccctctgtcgtaattcaaggaggccacagaaaaccaggttttatagaccaggtggtaatagaaccatctattctacgcacaggtctgtctcctcttgccagaaaggaaccattttcaaacataggactcctaagagcttcctgggggttactgtgataaatcatatgaaacagatcttgttgattttgcatacaagttttcatatttaaaaccactttgctcctttctctttgataggtatcatgaccatagacagttgattggacttgagttgagtttttcctgaggaagtttccaatgttttctagtagtacttagagtctcaggtgatggcaaccatgcaatatttccactttagacatagtagttggacaaagaatgaatatgaaaacggcaatcatgattttattctttctctggagaccacactggagagtattctgcatgtttgtagagaaaatcatttgaaataggttaagcctgaataggcaggcaatttttcaactaattccagcttcaaatctgttctctgaatattggtaattatttttcttcaaatggaattacctaaagagctaactctgttgttcactgtgtttcacaagtgtagcatagcccttgtgttgagaagatgtataggtatgatccagaaatttgaccttgtctttctctgctcaaaaccttggggcattgtattagtttgcttgagctaccatactaaagtaccacagactgggtggtttaaacaccagaaatgtatttcctcacagttctaaaggctggaagtctgagattaaggtatcggtaagttgatttctcctaaggctccctccttggtgtataggcagtcaatttcctcctgtgtcttcacatggtctttcctctgtgtgcaccctaatctgttgttataaggacaccatacatattggatggggacccacatgacctcattttaccataattacctctttaaagatccaatctccaaacatagtcacactatgaaatattgggggttaagacttcaacgtttgattttgaggaatggaagaacacaattcagcacataacaggcacgatgcatatttttgggtgatatatttgttatttgagtttgtcctggcttgcccccaaggacaaaataatatgattctagggaagagtaacaggatgtaaaatgtccagaactttatattcactttctgagcacctgatgaagccctctcctttgaggaacataaagcagcctcaacagctgtagctttaaaaacacaaggcccagtatgtagtctccttccatctctgtttgtttgaaaacaattaagtgaacaaacaaattaactggccaactggtttagttttctcagataatatcctcaatgaagtctcatgttacagccaaggtgtggaaggaggagctttagccagtgcagcacagaaagatgctacttttggcacagggtgacatcaccgtgtttgagaatgcagaacctctctaatccaccagaaatcagaccaaaccatcactttcaggagccagcacagcaagaaaagttgagctagttgagtgattcaaccaacttacttttgatccattcctttaaatactaaactaaaaatcttctatatccttataaacagtgtcattttatccacattaatatctaatctttcaatttgattttagggccaaacatattatgttttggatcgatcatccctctggcatctcttccatttgggatgtgactttcatgtacccagcaggccttttagataagggatccaaatggtcatctgtgctggaagcagggacatcatcctttatgagagtttcatagtgtaacaagttcttttcactgtattaatgagatcagggctattctttctgtatcctgggaaagctagggtgtcttttcctctttttaaaattgcaacaataaaataaaagttggaaagaggttttaaaagtgctatgaaaactattacaaggtaaagaagcacttgtttttaacacatgaagaagattttctttcttgacttggttactcttctattctggatagtccaagtgcaagcatatttcaaaaaagactaggttaaaacaggttgagtctagttaaaattggacctgatatcacaactgctggttatatataccaatacctacaaagcaatatataatacaagaggaaaggggtaaactcctttttttttttcctttgagacggagtctcgctccgtcaccgaggcggatggggtgcagtggtgtgatcttggctgactgcaacctctacctcccaattctcctgcctcagcctcccgagtagctgggattacaggcatgccaccatgccgggctactttttgttatttttttttttaccatgttggccaggctggtctcaaactcctggcctcaggtgatctgcccacctcagcctcccaaagtgctggtattacaggcatgagtcactatacatggacagtaattaaactcttaatgatatttaaatgctccttgttccttggaaactaccattgacctactatggctatcaaaggttcatctttcagttctttttaagaaaaattattcctaatagctactgtcaaattttttctttcaaatataatttgtaaagcttgatataaataagtttttacttaaaagataccctaaaggctcttcaagaaagagcatttcagggtaaccttgtttgggtacaacatttaggttgtgtgtgtgtgtatgtgtgtgtgatctcataaaattcacatggtatttgcattgtggagcttaacctatctttaattctgtttataagctttaaggcaaaaccataaccaaaatggatttaagataacctaattagagggccaggagaaaccagcacagattgaaaggattgtgagacatcgtgattcaaccagacttcttcctaggattggactataacatgtgatatggtttggctgtgtccccacccagatgtcatgttgaattgtgttgaattgtaatccccaatgttgggggagggacctggtgggaggtgattggatcatgaagatggatatccctcttgctgtcctcgtgatagtaagttctcacaagatctggctgtttaaaagtgtatagcactttcctcttcactcctctctgctgctggccatgtgaagatgtgctggcttccccttcaccttctcccatgattggaagtttactgaggcctccccagttgttcttctatacagcctgcagaactgtgagccaattaaacctcttttctttgtaaattaaccaggcccaggtagttctttgtagcaatgtagtttttgttgatcccgttcaagaaactgcatcgtactgagataaatcctctaaaacaaccaggctggcttacaatgtttgttcagtgtttcagttgccttagtcccttttttattttatcattttggcctttactcacctgcctcattctggtgacatattggatatgtttgattccttatgctttaaaatgtttttcaggtacattttcccatttgataccaacaattatccttctatcttcattttacaaataaataaataaatagatatacaatgaattagtggtaaatccagtcctggagtgggtgtttcatatggtctttttcctactctatcatatttcctcttcactccattgctacctaacaatttgctccatctgtgcccgtttcctaatgcagttgcttcttattaccaatttgttttgtatctgtttatataagaatctgtgccttctacaagtctgtaattaccaaagatgagagtcagtttacaggtaaaagcatagcctcgagttagacatttaaggataaaatgtaaaaattacaatcttgacataatagtcaatcaactaccatttgcaattactgtttatttgccttttccctttctgcttctgccagccaagattaagtctgaacacagtgattttaaacatagtgggggcttactggctctttatcctggtttcatcacttggcagccatgggaaaattgtttaatctacctatgcctcactttccctatctgtaaaatggacatgatgataacaatagcatcttcctcattccttgctgaaagcattaaattagataatgaatgtagagtgcatagcacagtccctggtacagtgtaagctctaagtaattgttggttatcgctttcgttgcaaagtagcctgaatgagttcatatggattttgttctataaaaagttatgattttgtcaagaataattaccaactcaaggtcatattaaggaaatatcaatatgtgtgtatctaattttctagttccctgaccacctatggtagacttcgtaaatctttgttgagttacttctacagacacttatggacttcactatagtggctctcaaccaagaataattttgcaccatggggagatacgtggcaatctctagacacaatttttatcatccccactgggaaatgctactggcatctattagataaaggtcagggatactgctaaacatactagaatgtacaagacagcccccaccacaaagaattttccagccccaaatgtcaatagtgtggtgcttttgagaaactctactctattagaaaagggaaaagtataagacatcatcactgtgtagaatctagttagaaaatgcttatcaaataatgcaaatatatttgtaataatgcctgttaacaccagggtagggttatggttagttcatcttgaggactggttggcttcatgagaaggcatactatatggacataacttcatgtttagataaactacagtggccttgcaaaatttgccttaacatcacctggtttacaagggatcttaaccttggttgattatgaaaacttgatataaaaattagtattatatttcaaaatactctttccaactatttgccatattgcctatttaagctacttgccgaagggctacaaattattattatttctttaaatggaaactacatgggaatctatagtaggaatcttggtttaagggacacagttaatattatatggtattttaagtagatataatcaaatggtatctattcatgggtaaattttctttagatatcactatgttcgattttcatgttcacttgaattaactgatattaatgtggaaatgagtaatagtaatgctgttttcctttggttaagccattatttgttgctgctgctgttgtttccttgctcaagttaaaatcattctcttttttacctgctgaacactttcctttagcaatttcaaacttgtgcaccaaaacggcattttgtgttggacttttctgataaatttttggtagagatagttgtgtgtgtgtgtgtgtgtttgtgtgtgtgtgtgtttaggtttccacttaaagttcagtgccaaagctacagtacttatacattttctaaatgtgttttaagcaataagttgtacaacatttttagaacatgtgttaagctatttctctaagaatgaagctcttaacaaaacataagcactctgcatgagatcttagcagcaaagtgcttaaaagataaagtaagaattggtaccatgggaagaacaccagctgtagagcacacaggtccattatgagaagtatggtagtgggtagggagaaaatgatttaatcaggagtaaaaccaattttattataagggcacgcagggggtgtggcaccatagtgagagggacatttcaaaatatctgacagatttcaacaatgtgaaaaccccgttctttaaagtgacagtaaaccccatcaggtctccctttttgatgctattgttaacagttgactgtttaaagctggcctgctaagatgctgtcggcctatttcaatagtgtgtagccaaataaaagactaattgttgaaatacaatcaatcaaaaatgattgcagggcagaaagaaggtctcctctgctgattttgttgtgtatcacattattgtgttatgattgaggtaggaatgaagactgaaagggaagattagcccgtctgaaataaacagattcaccttcatgtcttctctttgcaaacacactgttgagcaggaacaccacttactataagccttagaaacgatcgttcatttatttaaaaaaaaaaaaaaaaaaaaaaaaaagaactgctgaagatttgggctaatgtttttaaaaggacgtgaacattattagcaaaacagcccatgcagagaatccctacagtgacaattctcagcttttcttacattttggtgcaaaatgctcctctggattcataaaactgacatccaagggacatgtgaatgcgagcccaagacatcagtaaagaaacaaattttcagttgaccaaatacctcggcgcttgccagtattctcagcttttcagttaacccccagattgtctaaaatgattagtttaaggtttcatgaagccccgaatccaaaaccttttccatgttgcacgtttagaaagacaaatcgtctggctcgacagcagtgcctttgtacctcgcttccttttaattttatgtcaagatgtccctttcagacgtgaatgcatccacttcttgggtgagactaattccagacattcatattgagggtgaaaaggacaaaaataattgcccagcgcactttatttctattaaaaccttcattttgggatttactttctttagtatttcaacatctccactcactcaagcttcccaagcaaatatttctgttgtttctaaaaagagttggtaagcacttgtggtttgtctttagtgtgttatcatttttgacagctttgcatagcctacgtaggccaacaggggtctgtctaatattgttgctgggcatattttcctcactgagatgagaactaaaaaaaaaagattttgaagcagtaagaaaagaattaatatcctttctcactcagtattctcttccttgctgactttatattcaggcaaaaaaagggaaaaagtgttacccattattcccttgtacatagcaaggctaacacatgtaaagcaataactcattttctattgccatgtttagcatatgtctcctgttggctcagcaaggcctttaggccggtcccttgagccggccatcattggcaactcttagcccctcggcctcaaaaccaaatagctttgaatcatgttgagctgtgatgctaattttcatactgatgcattatgggaataaacgtatctgacatactgtgtcaatggcactgtctctttgtgtctcttgtttttttgttagctgcattcctacagatggtattccattgaaaatgttcccttcctacggaaagagggaggaaaaaaaaatgcacagcaccaaacctctaggtgcagaaggctgttaacggttgctgatgatagtaggcaaacattaacataataattagtgtcttgtaattgtttcattaaaaccagttgttccatttctcctcgtgttttcccagaagagaagctgaatttggacgacagccagtgggaggacatccacgttgtcaccggagcactgaagatgtttttccgggagctgcctgagccgctcttcccttacagtttctttgagcagtttgtggaagcgatcagtaagtacctcacagaaaagggcaggtggtagaataacctgacatcctggaattattaagtaaataataagaatgattataataataatcatggggaacagatagtatccccgatgctccatatcttacgttttcgtttttgtgttttgatggcttgttttatttctggccctgcagtattatctgaggtttgtttgtttttaattaggaaaaaaaatatgacatcctatttagggtagccaatttaactaagtatcctcaaatgaaaatagtgtctcatcaaatctgctttaaagggttcactgtgtgcacccctcatctctgcctttatactttcagaattgcaatgagtttgaatacaaagcggtctcgaaaaggatcctaagtgaattaaatattacatttcatgaaatatgtgttaaattatcaactaagacatcatgttctcttggttcactcacccttcacccaccaacactagtaaacagtcagccataatttgcttatgagcagcgtgattatcaaatgaagtaatggcaagtttcttctgttaaactggtgactttataagagagtgagttatatctactactaaccagtagtcattgtacactccatgaagcttccttttctgttttttttttaattcataaaacacacacacacacttaagtaaaagtgaataaatgaatgaatgaatcaatgaaaatcttttccaaatggaagggtacttctgctattaatccttggagaagcaactactggtacgtctctaaatttaatatcttagggtatgcttactgtaactgtgacagcttggaaaaagtttcctggcaagccagctgatttaaggaagaaaaagaaagaagaaagaaaggtaaaattaaaaaccttgcaagcctggcaggagcttaattaaaatcctaacgagacaaatctccaagaaaaaaaaaactgctgtattcaggaggtctgatcttggatggctgggtatgaagtgttcccattagcacaagtggagatttgggggtcctgtgttggaaaacagcccctcaacatgccctctaattctgtcattcacaaagccttcacccttgtttaaagctctggcaaaacggtatcaagaaaaagaagaaatttctctcccaaggtctttctcttgttgcttgctcacaatttcagattttgttgttgctattgctgctgctgctgctgctgctgctgttgttgaatgcagtaacaatactctaaagatgggttttgagttgaggctggaactcttatcccttgtcgtgacttcatctcatgacccctctacttcttcagaacagcaatgtttcatagttcagcatgctttcctaacttcatttgaaaagaagaaataaaaaataaacaagcaggcatttccataacagctttttctgatattctgtcttggaacacccaagcaacttacaatgttggaacagcgttctggtaggaaattggagggactttgcatttggatgcctatttctgattgtgtacatttaaagaagtcatataaatttcacatcatcatctccacacattcaagtgaggatgatctcatttggaaatatacttcggtatgtgctatttgggggctataactaggatatccatcatttaagcttcctttagttcacctgattctaaagatgttaggaaagtcattttcttagcttgagagatatggaaagcaggccctccgaatccacatgagagtatgtcttttgaatttctctaaggagtaggatcatctcagggatattctagacttaagtccaaattttatagaatttcagaaatataggcatggtaagaacggaacatggcagagttgaggcagcagactattgggattgatggctcttgcaagggtttctgccaacacctataaaatgggttatggcgagaatgaataagaaagtgcctaagaaagtctttcaaaaatgtaagagggtgcacaaacagtgctaaaagtgtttctccatatgagctttgtttgataatgtaatttggaagagaagagagaggagacttcgtccttcattgttcaaggcaacaagaatcaaactcagggttattgtgtcaggacgtggttcctgccggtgggttcgtggtcttgctgacttcaagaatggagccgtagaccttctaggtgagtgttacagctctttaagatggcacagacccaaagagtgagtggtagcaaggtttattgtgaagagcgaaaggacaaagcttccacagcatggaaggggaccccagcgggttacccctgctggctggggtggccagcttttattcccttatttgtcccctcccatgttctgtttctgtcctatcagaatgcccttttttcaatcctccccgcgattggctacttttagaatcctgctgattggtgcattttacagagcactggttggtgcatttacaatccccctgctagctacagagcgctgattggtgcgtttttacaatcctcttgtaagacagaaaagttctccaagtccccgctcgacccaggaattccagctggcttcacctgtcattatgatctgaaagtttgtttcccatcaaaatgtatatgttgaagttctcacccccaaggtcatggtattaagagatgggggggctttagatggagattaggtcattagggcagagccctcatgagtgggattagtggccttgtaaaagaagcccaagagaaacctgtatcttcttccaccatgtaatggcacaactagaagttgccatctattagccagagagtgggccctcaccaatacattaaatgggctgtcaacttggtctcatacttccaagactccagaacagtgagaaggaaatttctgttgtttatgaattgctaaatttatggcattttttatagtaggccaaatggactaagacactcagcagccttgcttcaactcaaaacagaatagtagaatgtcattattttttaatatgtaaaacagagggatcaaccaacagggtaatggggctgagacatatgatattggacagagacgtacatttactaacccacgtatttttgatataaccttgaagctagtccttgtgttctaaacctaggaaaaactctaggttgtaattcatatttaaatattcttaagcaatgagagaatggccacctagatccttggcaatggtaaaaaccacaccagaggaaatactttctctccatgtgtaccaattgtactaaaaagtctttcaaaattttaagaacatttataccccgtcacagggctttatcatagcttacatagcctcttgtaaaaatctatgcagtgagaaactcaacagatccactcgcgagttttcggctttatatggaaagggaccaaccaggtaaagtaaattcacaggacaggatgaattgaggacaaagaggctgggtctgggcctctttgtcctcagatcctagttcttcccttttattctctgtaccataggagggttggtcctagccagctatattttgcagatgctgtttttgtggggttttttttcgacttttattttagattaagaaggtacatgtgtaggtttgttacctgggtatactgcgtgatgctgaggtttgaggtacaaataatgccatcacccaggtatagagcatactacccaacagtttttcaactcttgctcacctccctccctctcccatctagttgtccccagtgtctattgttgccatctttatgtccatgtgtacccagtgttcagctcccacttataagaaagaacatggggtatttggttttctgtctctgcattaatttgcttaggataatggcctccagctgtatccatgttgctccagaggacatgatttcattcttttttatggctgtgtagtattctgtgtgtatgtaccacattttctttatccagtccaccatcactgggcacctaggttgattccatatctttgctatcgtgaatagtgttgcgatgaacatgcaagtacttgtgtctttttggtagaaagatttgtttccttttggatgtatacccagtaatgggattgctgggcccaatggtagctcagttttaagttaagttatttgagaaatctccaaacttacatgtgctcttgagatgctgttgcacccggtcaaagccactggaaggagatggtagaaagagagagaagacaaaggccagcagtttatgagtttatccccaacccgttcacccttgccacccatctgcctcaggtagcttttcagcctgaggctccttctcctctacagcttcagctttgaccagacagggcccatctggtttcagctcccatctggtgacacagactctcctttctttgcttttccagcctggagaaggtagtggcttcctgatgtgtctactttcttggttactccactcttccttatctggttctcagcttcttctttatatgggtaaccaattgtctgcatcaaattaattccctttgttggtgtaaatacttaaaatggtttctgttttttgcttacacacaagtaaaacatcatgtcagttgatgtcatggtacatgttgtcataacattatttcccttttctcttttattacccccaagcccagtttgtggagagttaacatttttatttggccccagattgggagatctgttactctttcatggaagagttaaaaggtggttagaccaaacagaattttgcatccaactggaatactttgcatctgaggagaaaatgctatttctagtacaagcaattaatgaccactggagcggtctgaattactttaatttttattatatgtttgaaagttatcacatagtccaagaagagtgaacagaaggcatttactttttaaaataacttctttttggaccaaaaaaaaaaaaaccccattaatatcataagaccctgcaattgccatagtaatcccttgtctgataatactcattggggtaacaaaaacactagggattgttttatatctcagaatccaagtacagcaactattgatctgaaattctatacttgagatcaatccaactgggtcacctgcaggttatttcatggggatttaacccactgactgcaaagatttaattccctggaaatgacttgtactgaaggcattattagtactgtaaatgtgaactcagtagaaaagcacagccagggagttttatgataggtgatgcaatcttgtggctagaggcctgcaggggtccagacatttccagtagatctaaatcctaggaaatgtactaactttaccactgttcccatctttttcttctggtaactctacagatccaaagaaaaaagacaacaagcaatgttttttctgttttaatgtctgcatttttccaaagttcctgaaaaagagaaagggaggagaaaaactcattggcatttctaataattgtctcatgtaattctcaaaataagaaagcaggagatattggagaaatggaaagatcatctgcacaataatttctagctcataaagtagttactatgagaatgagaatagaacaggattttcttactccatgttaggcacttagtaagctatttaaaaagaaattagtttttagagaagttataaatgcacatagctcaaaaaactagacttggcattcaaatacaaatataaatactttgtatcattgtatattgccttgagcaatagctattgccaagtatctgtattttatatcatcctacagaagacccatatgtcctatgtcatcttatataagactacaagcattttttctacattttaaaagctgagtttagaattaaattaatggtcagaaatttcagtattggagttttaggttagaaataaagtagaactttccaagagtgagtgagatttcaatgtttagtactagatattaaaagcattcatgccttaaatgttgacttctctgggtacattttaaccctgcactctgatttctatgatcaattgctcaatatctccttttgaaatttatttatatgtacacaatgttacttttctatttcatatgagtattttaattgtattaagattcttatttataattatttacttgatcaaattacaatattcaacaaacaaaatcttacagaagaagttaggatgaaaagcaatggattgggccctatcacatcatatcccctgacctactcgtgagaggaaacctcatttagtgattttaatttttatctcttctggttactttcataactctagataatatctctacttttgatttatcaactatggataatatctgttacctaatattgtttcattctactccacttcttttagtatgtggtagccatatattataattgcaagctaaataatatgcctaaacctcgttttcttgtttcatcaacattcaacaatatctgctaactcttccattcataaggtgagcatatactccttcccaccctttccttaatctttctatagtttatttttaatttttaataattgaggatttttttctagttctactgaggtataattggcatacaatgaactgcatgttttaaaagcttaactttgataagttttgacaaatgtttgcaccacaaccaggaaaaagaacatctctgttattcccaaaagtttcctcttaatccttgacaattctctttccttcccctttccacctgctctgcactcccatcccaagccaccactgatctgcttcctgtcactatcgatacatttacattttctagaattttatataaatggaatcatacagtatgcactcttttgggggagaggctttttttcattcaacataattattttgagatttatccatgttatattagttcatttttcattaatgagtaatatttcattatttgaagataacacaatttgttcagttgtttatggatatttgggttgtttctagtctttgattgttacaaatgaagcatttacaaatctgtgaacatttatatacaaatttttgtgtggacaaatgcttttagtcttcctggtgatacttagaagtggagagctggttcatatggtaggtatatatgaactttttaagaaattgctaagctgttttccaaagtcattgagccatttttcaattcccgtcaacagtatatgagagttccagtttccccacatcctcagcaacacttggtgtggtcagtgtttttaattttagccattctatgtgtgaagtggtattttgtggtttaatttgcatttcactaaagattaatgatgttaagcatcttttcatgtgcttattggccattccattattttctgcagttaagaaacctactttttcaaaaaaattggctatttctttgctattgagtttcaagagttccctatatattcttaatgttagttctttatcaaatatataacttgccaatattttcacccattctatggctttgttttccttcttttaacagtgttttcagaagagcagacatttttaattttgataaagtccagtttatccattttgtcttttatggatcttgctgtgccttcacgtggactaatactattttcttcaacatctgttctgttgttagtctcagccagtgaattttttttaatcttaggcattgcagttattatttttagaagtttgcatttttaaatatattctgccttaaggtgtctaatttttctctagctgttttagcttttattattttaaatgatgcataattgtacatatttatggggtagaatatgatggtttgatacatgtatacagtgtgtaacaatcaaatcagggtatgtgagctggcagttgttgatttgttgaagtttccaaagttgccttttgtgtacaaaaataacttttcctcccactcctgggcaatgttccatacattttccattattagaatgcaatcaatgctaactccgtgatcaaaaacaattttatgattccaatgccatcacttttggtgtttttttctggcttgactaatagtaatatataaaaccatatgaacatatatattgtgttcatatatatatacatatgaatgtatgtatgcataggacacagagattaggcaagtcggtgctaaattgagatagtaatgatgttacatacaagtcttcaatttaaaggctacaatcacacatgcctttgaagagtgtttttttaaatgcctggttttttttaaatgattaattaaggagtaaaacaagttgtgagaaatggcatccataagatcaactgagcaccattaaaatgcagactattagccaccaaaagtagagattatcctgtgcctaaacggaactcatatccctgtctatacatcagtcacatcctcatcagataaaaataatacattgccctatggcaaaaagtacctattgcatgttctaatggtttttccccccatggcctttattccattttgcctttagagtatactctcaataggtaattgtggggggaaaagccagtcaagtatatttgcaaatattttctttactcttgactttatcttgccctttggtcaaactatttctgatgcatcatcaactccatgatgacactctttaggagaaaagaaacagagcttgcaaggcacttgactaaaaacggttgctaaacatgaaagcatgatagtgacaaattgccttaaaaccagagaaagagcagggtgtaaaggttcatcacaaagaaagcagagatgtaaaaataatgcagtataaaaatatcctctattgcagcatttcaaggaaatttgaaattgaaacaaaggtaaattttacaaagcctgtttttttagtttccactgcaagctaacattctcacagacttggtatttttgttgtggttgctttttaatgtgtgtgtgtgtgcacgtgtgcacgcaaactggaaagtttatggctaatgcctagcctgtctcttaactcattctaattatattcataatgaaattgaagaaaaatacttgactagagccaaatggcttgcacaggtgtctttttgtaagaatggtttagtgctagatgataaacaactggacctccatctccttaatttggcttaatgaaaagccctttataagtaaaactagaaggtgattcagaattaaaattgggccttgactcagaaattaattgagtggtaagacatcagctccattagaaaatgtggtgcttgtctttttgcctttcctgaaaacttttattttacttgcactcctttcttccatctacgtaaggtcactttttcaaagcaataaactcttcaagctgagcaaccagccaggcagccttcatgagtcagcttccctagcatccttacttctactgaatagacctgcttttaaaaaatagataacaaaacgcaaaatttctcctcaaaacttggtggaaagcaattatcttcacctattcttctaatagtggaattgagtggttggttttcactgcatcaatagattgtaataaaactgaaggttgggaggccttctatcctacactgaggcttctgcctaatttcttatgctttgcttgacaccacattgtgatcaccactgatgagtcctctaaaatatctgcccacttacccccaactctgactcaggccatctctaggagaatggtctctcctatttcccatattcatttttttctctacccaacccagcatgattctagttctaaaatacacgcaaactgatatatctggcttgcatttcattttgagaaaaatccttccaaggtcttcaaagtcctttatgatctggtcacccacaaggtctccaacttcatcatttactgttccctgccttgcccattgcattccagcccattggtaccctggctcttctttgaataccccaagcacattgaaagtctttgactgctccatctgtctaccgaacacactctcccagattgctactccactgtcaagtcctcagggaagtctctcatcagctaagctaaagtttctacccgcaccgcacaccaccacctgtattcaaatcctgtctccaccatttactatctagacctagagcaaatatttaatctctctaggcctccatttccacatttataaaatggagggaaaagttgtatcttcaccatggcaattgtaaaaagaatttcatgaaatgcacttatttacagaatccctggcacacagtatcaagttcactggtattatcatattagaatataatcagagtgtcctttagttaacagtctcagagctttagttaacagtctcagaggaccttgctgtccattctaactaatctttccacttctctggaaaagccatttcaaattattgtcttaaagcggccatcttcattctgctttaatattttgctttgagaatttcacacagcaccaaacatgtttcatatgacaggatattctcttgcttcgtgacccagggatcccatttccttcatctcatgacatttctcctttgttctgccagatgttctcaagcccaaccccacttggataatccaaagcctaccactttattatagaacttacgcctttatcataacccaaatgctatccagcttctccgacctgagcttgccttgcttctatgaaatattagcaaatctgtgatgttcacggtggcaccagaagagccaactccaaagtgataccttctctcagttgggaaatttgtaacactgtagatcccaaaatgttatcagttgaacacagggacagacagacacacacacacacgttctccaaactggaaatgtttcactttttctttcagttgccacacaatactctagctttgaaaggtagactttttattttttaattatctcaagagaactttcatattaacctctcaggagctttttttttttttttttttttttttttttcaaattttttgtaaagacagggtctcactatgttgcccaggctggtctcgaactcccggactcaagcaattctcctgcctcagcccccgaaagtgctgagactacaatcccaagtcaccatgcccagcctcgtgctattttcaaagcctgttatggaataagaatggatcctttacccagtactcttgtttgcctacattcagtcagacattctcatttgctcaagcacttgtcctttctccagccctcctctgtcaatacaagaattttccttaaatagcttctaggactatcataagcaccttgaattgtggcttttcttgatctggctcattcctactgctctgcagagttaaacattagatgtgatggctcctggagtactataaatttcctgggggcattctgctcatgttggaacagtggaatatccacactgagaattgtcatgtggtttagagaatggaatttttccctaaggataggctcatacattttctacctacactttctgaacagaaacatggaaaatgaatacactattatagaaaataagtagtggtgctggtttaagagtaaaagtaatatgtttggaaggatgacagcagatatatatatatattttaatctatgaactataaaaaaattatattggataattatgagtgttttcttttcattggcttatttatagttttctatttaaatgtgaagttcctcccacttccaaccatttaattacatataacacctttatttttcagaaattggaattctaaaagatcaaatacctaaagcctgagtccatgattactgtctagccagacagttagttcttggcccctttcctttttcttctcaccttgagtgtccagcaggtgaaaggttgaccctttcccatttccagcccattcctctgccaagtaacggatgggcagatctaattagtaccatctgtcccgctagttgcaggtggttactgtcttacaaagagatgaaagcaacaatcttttaagcttttcttccaggtccctaactctaggcacaatggtaacattattctttgacaccttgtgtgtattattctctgaatatctaattggcatctaagaagaaaccattacctcattgaaatattctttggaaatttctatgtgcttgtgtcatgttatgaaaatgttttagaaaaagtcgtcaggaaaagaagaatgatcctgaacaaatattagacccagaaaggcttcagaagctcctgtctgtaagcttggatttgtgatgctcagagcttctgcgagctgggccccctccgtgttaactgagcagaaatctccaccaaggagaaagacaagccagagcacaactagaaaaaccactttggtcaatgtcagatttccagcaggatctttttctaacagccccttaaatatttttaaaacacttaaagtgtaacccgtagagcctgttcagtgctctcctttcttcctctgcactttcaataatttatcatgaatcaaagtttccagacccttcatcaccaagatcacactccctcaaatgtgccctcctaaggtttggaaattgtctcagtcagatcaggaagctatagcaaaataccagagagtgtgtggcttaaataatggaaatttatttctcacagttctggagcctggaagtccaagatgagggcaccagcatggtcagttcctggtgagggcccttaccctggcttgcagatggccaccttctcattgtgtactcaaacacaagatcattgtgtcctcaaatacaagaaggagtgggctctgatctttccctctttctgtaagggcactaatcctaccaggagagccccaccctcatgaccctatctaaactttgttgccccccccaaagacccttctccaaataccatcacattgagggttagggcttcaatgtattaatttttgggacacattcagtgaataagagaaatcatacttcagtggaccgttttatttgcacaactttatcagtgcagaataaagcttcctcctatattctcacaatatcttcctcttactatgataaaatatttgattttttccttattaatattatactattgggatccaaaattgaatttagagtccaagttctcacttttaccattttctctctcagataagtttgtacaagtttaaatttccatgctgaaatgtgcacaccatcttgtaccatggtacaagagaattttgctttaagttttgcatattcaaaagacttatgtcacctgagtctcataacaacaggagctgggaccaaaacccaagtttttaactacaaattcattgtgccttcctcctagtattgtgatatttacaaacctgagcagtttgtcttccaagtccatatttacgtcctcaaatacattcaaaaccatataagacaaattgcaaggccatttaaaacaatggagcagttagagataaaaatttacaacatttggggaggaaattcaaatattgtgccaaaaaaaaaaaactcatccgacaaagggctaatatccagaatctacaatgaactcaaacaaatctacatgaaaaaaacaaacaaccccatcaaaaagtgggcgaaggacatgaacagacacttctcaaaagaagacatttaggcagccaaaaaacacatgaaaaaatgctcaccatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtggggggaggggggagggatagcattgggaggtatacctaatgctagatgacgagttagtgggtgcagcgcaccagcatggcacatgtatacatatgtaactaacctgcacaatgtgcacatgtaccctaaaacttaaagtataataataaaaaataaataaataaaagaaaaaaaaatattaaaaaaaaaaaaaaactcagagaagagacattccaaatttacaaagtgaagttctctagacatttggacaacatttagaaagaatttgaatcactaatactataaactattagactagtgggaatttaaataaaccccataactgtccatatgattacaattctaatttctagtatacttaccatacttttacttacatatagccaattgctatgtgtacatttcactatttaagtttatttttataatactcctttgtggttactattattcttcctattgtttccatttgggaaatttagactaatcaatattaagtagccttcctaaggctaccagctgggaatttgcagagctagaattcgaacccataactggaagattccaaagctgttactcttaaccacacaactgtagtttttgactaatttgaaaaaaaatgattacaagtgtctatttagaaatgagataattagtagattcagatgtagttcagataaagactttatgttgttaaaaactacaatgggaggaaaccaaacaggacacaaatgaattttctctgctcatacacgtactcaaaacctcattgtttacttaagacttccatcttgactattcaatttaaaacaaattcaacatttttaattgctttctgtatccaaggcaacattacaggtactcattcttgtgcctgggtcactggaaaaatttttaaaagtaaaataagcaccagtgaaattcaaacacacctagcagatggagaaggctaaaggatatgtaaatttatttgtaacaaacatttaatttatcttttaggaatgttagctaagagcacctattctgtgcaaaatgcatcactagaagaaaacaacaacaatcaagctcccatattccaaatgcttaaaggtagaaagaaggcactatgtccttattacaatccccggcaagtgaattaggaaataacattataaaatttcttagaactttcatcatatgtgttatttaattaaaaggtgaaactgcagcaaagtgtcacttcatccctcatgtcatgtgccagaaaagtattttcatggagtctataaattcattatttcaaccctccatacccataataaaaagagctcaattataattaaaatactatgtctactcacattcagtggtattccactttttaaaaaatgtttaacgtctttgttaaaacacagcaaacttacagaataagaccacagatcttaatagtattgtaagagtatttttagttgggacattttaaaataaaatttgtttcccaggcttgtatgtttgtgactcctttttctggcaattaattgtaaattttctctactgagttaaatacacaaaactgggtataaattgtctcttgtctaggtacagaccaacgaaaatatcgttttatgtctgtttatctgacataaacttctctggagtaggagacatttcttactgatctttgtagttccggcactaaatgaatttttaaaacaatgtgctttgtggtggttgtttcaagtaattcctcctagaacaatccatagtagttaggagcaatgatctcaaactactgaaatggggaatcagaaggaagagggtggcgagaaggtgaatggcagagatggaaacaatgcttaattcaatccattttgttgacagtaaattcaagaattaactgtttacatctctccaaatgttcctatctgccttctgagctctgttatacagctactaccagaggactaggtggactctagtattcacattttctacatgtcgaagaagtattattactacttagtttccagaaatttcatctcagtggcttaaaagtttatgagagaaaaagggaaaaattaaatgagcaaatcaagtcttttgaccaggctaatgaattttgcagtcttcaaagggttacctgaacttctgctagtacaacttgccagccttaaatgcagagagcaatggtggagagaacagtaaaactgtactataaaaataaattactgtcatgaatattaagcaacaagaatataataaacatgactgtttgcatgattctgatttattggtactgatatgcttataaattatgacactaagtgtttattctagttgtttcagaatatgggccaaacaaagctgggtggacacttcctgcagacctgaccatctgccaccaaattcctacttcatcgctcttgtcattgcgtttcttatgtcagtggcatcagggccatgtatgaacaaccattcccttttagttcactttgcagactgaagtaggttgcctttccaggacctggtgtgacaaccatcatcatgaagtttgtgatgtcttgcagtggaacaactgcagctgcaaagcatcctgaaggctgttccaacttacgctgttaaacagtactcacttttgacataagagggtccattactgtatttatgaacctcttggcaccagattggggatttcccaatgcgaagcagcactgcattttgcatacttgcttagcggtgggggctccataaaactggtgctgagaagttaaagacctaaaaacaaacaaacaacaacaaaaaaaaaacaaactgtgtattcatatagagtatttcaactgccataagataactacacaaatagcactgttgttctttctaatatccacaagtaaaagttattaagatttgctatcggtttttacattatttggaaccagatatttgttcaacagatggctagaataaggtatcacatgagaaaatagcattctcctgcttcaggtttttagctttcatgttacatctcatcaaaagttacttcaggagattaattattttaaaattttcttttctctaatgttggtggaaacctgcaaggaagacagccagtaaatttacagtaagcttaatgaaagatgcaattttcacacagtaaagtatgctataagggtataagttggtgctgcctgtaaagaactatttatgatataaacttagctgtagatgaaatgccaaagttcatgatgagacaaggcctgttactgctttgaatcagaactcttagaaaatttgtagaaggacttttggctatatttagcaaaagcctttaaaatgtgcatgcattgtactgacagttatatatctagaaatttaccttaggacattttcagagatatgcaccaggatgtatacaaacttgcccctcaaaacgttacttataatactgaaaaatgtagaagtatgtgtacaaacttaaggaaggttagataatggcccatttatattatgaaatactaagcaattggtaaattgtgatatagaaagcattatttcacaaggtaaaacaccagtaaatattaagagaatataagtatgatatggcatgtatagtataagcctattgtaaaatatgtttgtaaatatttatatgtagagaaaagaatgaaaggatttacttcaaaatattagcagggaatgattatacaggtttttttctcttttttgttttcctgtgttctgcaagtttctgcactaagtatatttgtagtgatttttttttatgtataagaagagggtgagtagataatgttgggggggatttcagaatcagttgtttgaaggcttctcaaacctggctttttgatccaactcacctttgtggaaacagattcctggacccacccaggtagatgttgattcattatgcctagggtaagtttccaaaatgttttctaaaaaaaatcatgaggaaaccctcaggtgatcctggcggcagtcacatttgggaaccattgattttggttctttttccttggtgaagccaaataagaggagagcagctcttcctactcgtagtatgttgacatcacagcaccttgtccaagccatgctatatgctcctcaaggagagtactgaagaagtaagaggtacattccctgaactagagaagaacatgtgagcacatgtgatctagcagcacaatgaatgatgaagacaataaatgttctacagaagggagagacaaaaatgcagtgtttgggaggccttcatgaaggaggcattaagagtatatggagtttggagagccagccagggaatgttggctccagccaagcactgactccagccctgagaccaggctgctgttttgtggaaagtgaggaattggggttgaaggcagcaatgattttggagacagcagtaggaaacaaaggagagcagatacagttaatccagtattgtgaatccctgaaagcaaagcagtaatttcttatcctcctgcctatcacagaactttccacagaaaagggactcagtaaattcttggtcaataaattaactaattaattgcggagaattcaatactgcagatgggttaaattttatgctgcaggcagggaaactccattaaagatttttgagaaaggtagtggaaagcagaaacccatgttttagagaagataatgtggtggtaattgtcaggatatgtttaagaggggaagggaagcaggaaaccccattgtgatttggcactacatttggctatcgcccaaatataaccttgggcaagtgacctgagtcctctgggacccatgcatggatatgcctcaagaggctcatgtgccactccccagaagattggccaaatttatgtacatgtgaatctgtgtattttctggagcaagattcctagatgtgtgacacctcccctccacccacccccccccaccaaaaaaaagttatagagtgttactgaaagtatactttaaagactggtagcatcagaatcacctcggatcatgttagactgtaaatttgaggtccccactccagacctcctttatgataaccagtgaatatagagtctaggaatctctttttacaagctctccaggttattaatatgcaggcaaaagtttaagaagcatctagtagcttggttacatctaaggtgttcaccaacttaaaaatatttcactattttgcaaaagaataaaaggaagaaatgaaggaaaagaagaaactttatgtaaaagattacaaaaaagaaaagttgcaatgatttaatgacatctcggttaaacggtcttggaagaaatagatgggttagggtttgaagctagataaccaagaggatagaaatgtacttgacagaaattgagaagctgtgttgatgagttgttttgcacacagtagaaaactgagtcaaacacaaattatcagtcagatgattattcttactggcattgctcctacagacagaatccggacagttgtaggggcaaaaaagtacaatacattttccttacccattttgagggccatggctgacacctctataacaaaagaaagattagtaaggggaaagcataacagatttatttaatcaaaagtgtgacacaggaactttcagaaatgaagatccgaagacctagggaaaactgtgcatttttatgttaaggtttgatagagaacgaacagccatgtagaaatgtggttggacaaaagtatgatctaatggtaatagactgggggtagggagtggaactcagcaaggcctgtttgctagattcttttctgtgtctctgtatgacattccttcctctgggtacagggcaggacacccatcacatcagggtcttcaggggagaagacagaaagttagagagtgacatttctaggttttatggcttgctttgaggaagagttctagtttatatgatcagcttccggggagaaatgagaggagaaaggagtgcaggcaaagatcagagagaacttcctgcttctgaggcccttctaatcttcttcagttcaaagcactcagcatgccaaaggaccatacttggaggtatcatgttctgagccccaacacaggtcagtgtacctttgtaaggaatttgttcaagattacccaactgaatttttacagtgactggaacgttgaatagccagtcagaagttgacagtgatcagaacgcaagttcggccagatcaatgataccaagatataagttgctgcgtgcaaaaaaaatcaagcctaaaacttggattctcacgtgaaaaatataaatgtgtatgcatgttaagccattttagttctagtcctcattttaaatgtctcgatggttcttgataaattatattcactttatagcacatacttttatctgagtatgtcaataacaactcagaccccttctatctgctatccaaatatagaacagaaagtatagaaaactgtatgttgggggacacccactgccatataattgcgacaccacttcgtacagtgagcatgtttggagtaaaagtaatatgattggatgaagatgtatgatgcaaaattcctattacataggtttgagattgttttacatctttaaacagagcattaagaaataatcaaaaatggttaattgaacaggcaaaaatgaactttggctaattttggcataagctctccagctctacaagccaaaagatatctttaaagtaaaatctttaaagtaaatgaaaccaactcccttgattcaagaaagagaaaagatctgcagattgaaaagaacttttaactctaagtctacactgtcattaagtgtacttagatttgtaccatataattattatgattgtagcaattaatcaactgattaacatgtagggtcagcaggatccagtgatcttatcttgaagcttgaattaattaattatactttcttcaacattattattttctatttgcatacccagtttgtacaagttgccccttattgacaaaatgtggtttagtctctgtacttatcacagcaggtatgagcactcactgaagtacttttgctcatataaagtcagaattataaggaaactgaaatgtcgtcaatactttctgaaataattgtcttttatttttcattatcaaatatataaattatacaaattaattagattcttttgaatggtagggaacataagatcaaataactcttgtctgagtaagtcaaattccgcgatactattgaagcatcacgtggtggctgtattattcaggaaattcagcttatattgcaagaaatgccccaacctgcaccttgcaaacacaagcttttttaaaaaatattttttaaatattttcaaatacataatctctcttgcagaatctctttggccaagtttttgcaaaatgttcaagatggcattattcccattcgttagatgaggaaactgaagcaaaacacatgaagtggtttgtccagagcctcccagatagctattctggcagtaatggaattgaaaagctctttcaccaaatatgtactgaaggatttcttcagcacgcactaatgttgaaagtagaaacagtaagatgagcagggcatggtgttgcactcaggaaattcacagtccagcaggggaaacagacatgtgatgagatatttacaagtgcagcaccataataaatgtatgaagggctgtgagagcagaagggtaagaatgtcagtgcattcttctattctgttgctcatggtgtttcagaatgacactcttgatggagttgtttcatatgaaagaagaaggtggaatgcaaaagaaaaaaaaagattgtgatatgagacctgttgcatatgctaaagcagcttttttctttttcctagaagccacttattagcagggcctgtctcagttggaggctctgccttttttgcttacagactgtctgacgcctttataaagtgggccactgcattgttgattactatacaccagggtggtctgtgagccactgttttctgccatcccacagtgagacagcatcttctgacgttctggtctcgtatgtccttagagaacggtttgtgtttcccaagaagcttaagtctggatgatttacatgtaacattttaaactccagttgtgtaatgccttgactgggatttatatatgctgaaaacagtttttcagttctgtatatgacagttagtatgtattgtattgtctaccctcatttatctatgagaccagagatgtgacccacagtaatgaggatctaaaaagtgtgtcctctactgcaaaataacatcatgcagtagatgctctgaccacatactataatctcataatcaaatgattaagtgcttgtcaatccaaataagacgtgtttaattttgacaaaaagaaaagaaaaccgagagtagcaattgggttaagacatgaaatggtcagtttctttctgcctgtgttgagtttcttttcacccacatactcttttgcttttttccaagagaaatggcacattttctggatgtgagagttggtcaaaagatcacaaaaaaagtcaaaaaataattctactctgtgaatgaaaaatggatatttgtacttaccctcataagcattaaaagaaaataatgcatgaaattccatagaaatgtgcctatcatgttatactgactcaaaccagaagacctagagtatgatattgctaatataatacatgtggtgggtatgagtggaagtatgtgtgtgagatttatcattgccatagtgtaaaagagttgaattagcttccacttgactagatgagagctcttagttcttattttgaaagcaatcaattgagcatggttaattaggatatcaccaagtagttaaaaaaaaaaaaaaaaagaacataaaaaaagcaaggcacttattagaaagtatactttgaatctgctcacattacagtgctgatcgaaggattatggaaagaatacaccaaagcaggagttgttaggtgctttctacatgaacacatttttcttcaatttcaacaaattattatagttattttatgtggtactgcaaggctgcctttatgtgaatcattgagttacaaacaaagaatacatttcagtcatccaagcagtaattgtaagaggacaagccaaaaagatctcatttggggaaaaaattaatctttaattctgtacttattctgtccgtcagagctcttttatctcaatttacaaacatacgtcgctttatataatgttaaattacaatgaaaattcaaaataactagcaacgttaactagctatccaagatttatatggtatcattgaaggtatgcctttcacttaaaatgtcccagtgtgagaaataaattaacttttctcattaatatggaaaataagaatggttttcatattttcacagacatgccctcttcattatattttgatgggtataagactcatttcaaagtaggtccagaaatctagcagcccaagagggctgagtattaatcctcggaatattagtccactcagaggattgatactgcagcacccagcttgttccctacatctactaataaactcaatgggagtcctcttaaccctgggcaaggttgaacacttgcatgatttgaggttttcaaacaaaagtacaaaaacaaaatgcacattctgccctaatgcttagctggtttcttgttactcgagttctataatttaaactttagccttcttgtatgcattaatttatgagttactgtgcggccaccactgaatgcagcaagtatcctgctatttgtgtgcttgaatgcagaaacatacaaatgttaaaattttacatgcatgccctaattgttcaagtaacagtattaggcagatctaagtgctagtagcctacagggtaattcagatttgaacatatattatttttccctgcagaagattgtttttatgtcaagaataagagccatttgttcctcttctcattcgtgaactcaagagaataaacttggatctacatgttgaagctggacatgtcaagtccttgactgttcatgtctactaaatccttgggctattttgggtttttccttccctccccacacctcctcctcacgctttgttataaaactacttcaatttacctgaaaataagtgtgaatccaggtaaaaacctaaataatcagaaataatggctttaaatttctaaatgaaaagagttaccttgtatccagtatggtagcagaggttttcaccacgccctgtagtcacaaataaaatgtcctatgattttcatataatcacagtttttccaaagaaaatcctttgctcataaagatgcagtgttaggtgcacatttctccatcttcatctatctttttgccattctgggagtgaacagtaaggtagtctttgcagttcaactatataaaagagggtcgtatctctatgaatataacaagacatagtgcaaaccacacttttagtctcagacctagtaatttataagcaagtcaaaagatttctctgacttcatttcataacccctagtcaatgtacgtgagtcttagcatagtcagggtcatagagagcaaggtatttcctaaaaattcctatatttatcaaatactgtaaaaaagcaaaacctctctctagcaacaagcttaattttcttctatcattcatcatcatcatcatcatcagtgtaaccagttgcataaccagcatgtggttctatatttcgatgtttgctgaagaagcaagacactgaaagtcagatctgttgttcatttcaaaacagtcctcaaattctcctttggacaaggaaagaaaactttggagaaactgacatctcagtccctggttaggaagtaaatatggaagtgcaaaatggcatttttaaacaaaactgctttcctgaccgtaactgaattttcacattgtcagcacttccattataaacattttttttagttgggagtttataacgcaaatgtaaagatttgctatgggctaaatctcaacccaagagcaaatgtttataccaattttgaaaacaatcagcttgcccatttgtagttatgcatgtgttcatcatctgttattgcttgtccaatgctctccaacttctgggagaaaaagcagacatctggagagaagaaacaatgtttgctctccagcagatgtagtctgttttccacaatcattgaataaggaaggtatcgaacaaatgtgtgccctttaatacaaggaaatgaaaatgacaagattctgcctgcatgccaatactgtggaaatgctaattggacagtctatgaattggccactttgaacaactagaactcagagctccacccattttacaggtggaaggaactagtatctaatatgaatgacaacagtgaaatactttcacctataaagtacattacactttagggattgccagagtaagtgaagaataaccatttcactaaaaactatttttaccacaaatatttaacattttccaaaattttataaattgtttcttgtcttccagtttcatgttgttggaggttttttttcttcttttaaattccgtcagtaaactaagtagtcaattttttccctggggaaaaaaatgataactctaaaaaatgttatctagctatggatcctgatgggctgagagatagatgctgggactatgcagatttgttttctccaaaatgatataacatttcagttttctttggtgaagtgtctatttttattacctacctgaggtggcactatcattattcaaacagcaagaatggtttaccaagaaaagagtgggttgggaagtgatttaaattctcctgcttcaggccctaatgagttccaccacatcaaacaagtcacgtgtccgctcagatctgtagtttgcttctttaaaatgggattattgaattaactaacctgtaatcatcttttctggttctaaaatgtgatggttttatggtgctataccttacagtaccttcctcggatgtttgcagttcttcagtgaaccaagtctttcatctgattttcccatagtattgggtactgcacccactaagtattctcaaggttaggagcagagccaaatgaaggagacaggaaagcacctttgccttgttttgaggaaggtaaaattgaaggtttttacacatggcaaatcctgattgtcaatacaattcatttggtattgctggggtttctgtggtacgtactgaagatgaaattaaattcttggtttaatttgttgtatctatatggtggcagttaacatacctcgctatttggtatataatgttattttattaccaaaatccttacagtaaaatatgatcttaaaattaactctagagtgtgattacatagcactcgtctcatgtttcattttcacccaaatcagcaccataggttgtgcatttttgctgtgctaaagttacattcccatgttgttctagaggactcctgcaggaaactcctgtatctctatgcactaagtacattgttcatacataagactgtcaattacttatatcttgtgatcagcagaaaaagtccactgcagtgaattcactgaaatacaggtttcctagtcttacccagaataaaaatcagggagcatttaaatttgtttgctattgttatgtgttcattttcaataaaagctatagtaatacaaaggtaaaattgttctgtattgaagtgattcatacagattttttcatcaaaattatgagcacaactttcacccctaaatgtttccccacgccctttcataatttccttcctccactccctggtccctgccccagagcaaataatttgcttttttatctggtttattttatgtagaacaatttattttaaatttcattaatgctgttgttgtgtatcaagtgattttattgctaagtagcattccactgtatggatacaacaaaatttgcttatgattttatttacttgttgatagacatttggagtggtcagtttgggcttattacaaataaagctgcaatgaatacttgtgtataagcctttatatgaacatacgctttcatttctcttgcataaatacctaggagtggaatgactgggtcatatggtagatgtatatttaactttaactgccaaactgtattgcagagtaactatatcatttttcattcctaccagcagtataggagatatgcatttcctccacatcctcattaacactcaggatggtcagttaattgtagccatttaagtaggtttgtacaggtattacattgtggtttgtatttccatttccctaatggtcagtaatattgggcatcttttcatgcttatttgccatcttcatgttttctttggtgaagtgtctattaaaatattttgcccagttttattaggattttacgttttctgattatagagttttgagagttatttttgtcttctggatacagtggaaataccatcctttctcttttttgtcatctctgcatttttatcagatgtctgttgtccatgtaagtagaggtttattttgagactgtccactttgggtcattgatctatacatctaactcaatgccagaaccacacttctttattagtgtaattttgatataagtttgagagtcagatagttctctacttttttcttattcaaacttgtttttgctactctaggtcaagggtcagcaattatatttttcctgtggagggacagagagttgatatttcagggcttgtaggccatatggtttcttttgtaagtactcagttctacacttgcagtgcaaaaaacagccataggcaatatgatatgactgtgtggctgtaaagctttatttacaaaagaaggcaacaagctggaagtataccgcaggtcatagtttgctggcatttgtgctaagtcctttgcatttccacattaactttagaatcatcttgctaacttatatatatttttaaaagcttgccaaaattttaattggctttccattaaacctgtagattaatttgggaggaattgacattttcacaatatagggttttccaaccaatgaacaagttatatctcattatttaatgaggtcttctttaatttttcacaacagtgttttacaattttacacatacctttggtcatatttatccccgagtatttcatattcttaattctattgtaaattgtatccttatttcatttcctgcttgtttgatgctactatacagaattgtaactggttttgtattttgttttgtactctgcaacattgcaatactcaattactggttctgatagttttttgggagagcatcagatgttctacatagaagattatgtgatccttggattaagacaataatattttttggctttctagctggatacattttttttcctgccttattgcattggctaaatctctagtaccatgttaagtagaaatgatgagagtggacatttctgtcctgttctcttctttagatggaaagcattcaatctttcattattaaatatgatgctagttttaggtttttccttcccatctgtcctgagtatgctaagagtttttaatcacaaatagatgctggattttctcagaagtttttctgcatctactgagatgaacataaggtttctcttttctagtctgttaatacaacaactacattgatagatttttaaaatgctaaatcaaaactacattcccagtacaaacccacttggtcatgatatattcatttttgagtttcattaaaattttctttagaattttcatatctatatttataaagcatattaatctgaatgatttttttccaccttatatctttgtatggttttggtaccaggacaatgctggccctaattgaatgagctacgaagtactccatcctcttcaattttgtgaaaaaattttaactagaaattcaatttctctaatagacacaggaacattcctaatttcaaggaatttctccatttcatctattttgctaaatatattggcataaatttgttcataatattttcttatcattcttttattgtctatggaatagtgatgtcatctccctcattcctgactttagcctcaaagggaaggagaatacaaatatttaaggaactgattaaaacttaagaaacatgaaataaaagagatgagaaataagtcttcctgaaggaatactacctgccccccatactgggtcggcattccttatcgcacttttcttaattgtgtttgtatagtctgggatgactagccatttaattcctgttttgtttccatagtgccagaacagggcacagtacctggcatataataggtgccaaaagttattcttctactgtgttactgtgttatgaatgaattagtgtagtcacttcccagattctggaagtttttctactattaagtttttatcctgaaggcaattaaaatccactgaggattttaaacaagtacatgacatgattagatttgaaatattacgtgtatatttagagaatgcaagggggtagacaaaaaaagactggggctagggagtcagtgaagaagctattggttatttaagcaatattcagggagtagaaattttagaatgggttggccaatgaccatcaacagtagagaataggggtattagatctagggattgagagaaaaatacagaacagattctcagaattatgatttggaagatttgttggagtgtggtgccattaagtaaattttaaaataatggtataatagaatgctttatatttcaaaatgacaggtgcccagtttgctacctatataaattggctctttgatgatttcatccctgcaatcatcctcagtgaggtcactataacttactcaaaaaggagttgagaaaagcataatatacttaggtttgtgataatgtttcattatcaggtatagcactgattcagccaaatcactacaattgatttatgtaagtgaattttgcaaaaagtgaaaaagccctttaaatatgaaatcttttggtattaatttttgtatagaaattgtgctaaaatgcatcacatacttccctaaagtattttcagattttgccagtcattctgagaatagatacaagcatcctcatttatccaattaataaattgagactcaaaaaggttgactgacatttctagtgtcaccgttttgaactgtcagtctgaaacccaagggtttttattctaaatctggcttctttcccccttgctaaactacctctatgtatattgtgatattatccagtaatgttctcttgaatatatggaaattaattataaagacaaaagaacaaccaaaagttaaaatatgacctgagaggctgaggaggcaagaggattgcttgggaccaggagtttaagattagcctaggcaacaaagcaagacccgtttctaaaatataaaacagaattggctgggtgtggtggcacacatctgtattcccagctactccagaggctgaggtgggaggactccttgagcccaggagtttgagaccagcctgggcgatatagcaagactctccatcaaaaaatgttaaaatacgaattctgataaactcatggcaaaggtaataacttatttccctggggcagcattttttcccataagttattggggtacaggtggtatttggttacatgagtaagtttagtggtttttggtgcacccatctcccgagcagtatacactgcaccatatttgtagtcttctatccctcgaccccctcccactcttccccccaagtccccaaagtccattgcatcattcttaagggcagcatttttcaatgaggaagtaaaacatggtgttatggagagaatatgagccttaaagtcaggtaaacttgggtttgaatttgggccctgctacatactgccagacacagtgtggtaatcaacaggatttcaacacatcaattttctcatctttagaatgaatctgttatctaactgataggattgttttaagtattaatatcttttgatgcataatttctagcatgaagcctggcactgttaaatgttagttttcctttcttccccatagtagagttgattttaggagcaaggattttagcttttgtatattacagccttactaaactaggtaactgcctggtggtatgaaggactttactaaccttggtaaaaataaaaaattaccatgcagtttggaagaactaagtacatagaccaaaaacaagaatcagtgttttcctgcttctacaaatccacagtttgactcttggcagtcagcctcaccaaggttgccccaccttaacaagtgatgccaaaaaaaaaaagttccaaaaggagaacaagacaactcagcattcggtacgtccattttccagatttatgtcaacaactagagaatatcatttggttttcttctaggatcaaaaagccattagcttctatgcagtatgtggtttttcactcactgcagatcttgtttaagcacattctcactctgaactgattaagtgctgcttgatttctggatggcagttgcttataagttataatatttcttagttataatagtttcttagttattgtgcagaatccacaatgatgcttaccttgcatacaagatgatgtttttatctgcagaagtcatctttgaccacactacccacagatctagagtaaaaagacaccacaaatggctgaaagtgtcaacataaataactatcaataaatgttaaggaatgtggcaaagcatttggcttcttgtgtcttcccaacctatcagagctaactatggctattattgtcaaaagtgatgctcccggtttagttatatacagtatttataaagtgcccatcaccatggtatctaaacacttgggcagtctaattaggctagtcaattacttgtgcaaaagtagaagaggtacccttccttatatcccactccactggaaccaatttgattgtgtttttaaaagcaagaaaagccttctgtgagaatagctttttaggccccttgttccaagatgaaaagactgtctgggtaaagaaatgactgtttcttattccttgaaggtgataatgttctgaatcaagcaactctccagtggtagaaaacaccacagcccagagatcttgattgagaacattttattcccttttcttttgaacttcactctgggggcaggtaacggaaaagtgctttctaaaagcagttcacctgcatgtgaattatttccaaagccttccttggtgagaaaactgtgttctctcctggcctcctgagtcagagaaagagtactcctcctcttcaggacatttaactgggtcagacctaaagcagaacttggtcacaaagacctcccttctgacttctattttggacagacatggacaaggtttctaagacaaagtttctggtgtgtgtgtgtgtgtgtgtgtgtgtgtgtgtgtgtgtgtaggagtgaggacatgttatccattagtaaaatcactaataaacatttttagaatttattgttgatcaaatactttaaaaaagctatttgtggccgagcgtggtggctcacgcctgtaatcccagcactttgggaggctgaggtgggcagatcgtgaggtcaggagatcgagaccatcctggctaacacggtgaaaccccctctctactaaaaatccaaaaaaattagccgggcgttgcggctggcgcttgtagtcccagctactccggaggctgaggcaggagaatagcgtgaaccctggaggcggagcttgcagtgagccgagatcgcgccactgcactccagcctgggcaacagagtgaggctccgcatcttaaaaacaaaacaaaacaaaaactgtttctgtacaaatgaaatactatgtttatgtgtttctgaggcaaactgaataccacgcttattcagaaaaatagtatgtcgctgatgtacacttcaggctaaagaacagttgtctttttgtactagcaagatttcttcctggaatttattatgaattcaatttgatatgaatctaatttacatgatatcttatttcataatgtttttcatagctatgcaaaaatcaagtcaacatggcctgtaatgtttcaaagtataatttaaaagttcagagaactagcattttaccttgaaaatgagtaaactattgttttgttctctagtcattccacctatgtctatcatatcgcttattgcttaattcagattttaaacagtcttattttcctgtcatttcttcatgtcacagtctctcccctcctgatttgatttgttgatttgtcattgatttgttcctattgtggccttgggacataatttcgagactttgttcagttcaaattatttcagtacctcagtccttctgattctgttccttcagtttggtgttcctgttttgtattcattccctgtcataacagttctctcctatctttcaatatacattttttgaaaacatccctatgcggccacatcagttccttcagtaactacttttctttctcatcagaatcatttgaaattgtaattcccagaatttcatcttttagagcactggattcctcttgagccatcttcctgtacagaaattcttaccaagggatcttaatttgttctctggccattaaaatgatggttgcaattattgaacatctacttcatgacaggaattttatgtgcattatcttgtttactctctaccactctcttataagctaggtttatcttcatcgtaccaatgtgaagactagagttcatagaagacatgtataggcagtaatggacagagcagggtagaacttcgggtgtatttgtatcaaaagcctatactcttaaccattatgttcatatcttgtatctcagaattaaactttcctaattattttctcctgtaaactactgagagacttccaattattcttatgttggtatcaagtactgtgtcagttggatagggtttagctgtaattgacagaaaatcaactcaaaagggtttaaggaaagaggcaattttttggctcatggaactagatatccagaggtagggtaaattacagggtttgttcatatggggattcaaagatggagatcacagactcaggcccatttttttttctgctctgccacctgtagagctggcttcatcctaatgctgattgcagcattgtggagaatgctcaccagtagcaacacaaaccatgtccttcctctgtcacttctggtaagagatagaggagggcatttttcaggaatctcaaacaaacacttcctttcacttaattgatttgacttctatcacgtgcccatttcttaatatagctaggaaatttccatttgagttaatcacagcttaatctcgaatcagggactgagttcggctaatgatgagtcctataatagatcactgaacaataccagaattctctttagaaagagaaggagaagaatagatgtaggatagacagtcaacagtatctcctgcccaactcactgactacctatcaagcacatgcacccttctgttcaacatttactttcacagccctcgtatctacttgaaaccactcactgctcatgcaacctcatacagctactcttccatatatgttccaaatatagctggcttcaaaaatcagaggtgtgatgtgacttttctatcttaacaatagctatccgccaccaaagcacttaaaatttgtaagtagggaaaaaagggataacaataactaaaatttctatttggtggggatctaatatgcggcatagggggtgatggacatgttaattactttacttgtggtaactattacacagtgtatacatttatcaaattatcacattgtgcagcttaaatatattcatctttattcattaaatttttttaaaaaaaattctatttggaaaagtgaggagcttatggtagtttgtgtgatattctgaccaagaagagtgtgtctttcatgccctggctgggtagtgatttcctgggtcagccagtctgatagctcttagttctactttctgaaagattcttaggtatccattgctttccacagtcacgggtgagaaaggaggacattctctagcagtatcccttccaagccactaccgccctaggggctagtggagacattaaggagttgtctgcccttcctaggcaggcatgggtttatgtggtaatacaggcccttttaaaaatttagaagacttctggtttgtttctagtctatttatcagctttcattagttctagaagtcttttgtgggaattctggaaatacccatgtcttagcaactagtttctgtgttctgcccatttctctggcacttggtttagtcaatgctttttatcttggagtttttttttcccccaagagaatttgaagtaataagtgggtgttcatcttaaggaaacatgctagaagtagccaccatgggccaacatcctgaattttgaatttttcctaccattgttcctaatctgtgggtagacacgtggtctgtgttccaaaatacaacagatgtgagtctcaaatgttttgctgccatgtgacaagaataattgcaaacttcatagactaggatgatggggtccttcatcccttccatgctaactcttccactcaaacttacctctctgtaaaacctattacttaaagtgtaccaatttgatctgttttttttaaattgtatcaatacattcctccttcctcctccacattctgtataattcttcaactgttgaatgtctttcctattctgtaatcccagaaattttaggagacaatgggaattccaattgcatttggggaaaagttgtttttgccgatactgctttcaagcagataccaacgttccatagtttttggcagaatttgggaaccaacaaagggaaatgtaccctaacagattaaagcagggttagtggtttaacctgtctaagaatcaaagggttggaaacaaggaagactttattttaaaatcgtaagaataagaatgaaccctaaaatgaacactttatgaattattaggagatcatttcaggaaattactcacttagcgacagacctgtgtaaaactcaatgaactgtacatgtgatggatctccactggggtcatcttgatttgagtaccagtatgataaattgaaaagtaagggctatgtgcttaaagaaaagattgggcttaccatacgtttccttgagataaatcttctcctaattaatgaccttttacctaggagtagaaacaacaaagagagtttgtgatggccagcaaataacacaaggctgtgtcctcattgtatctcatcccacgttctattagttttctattgctgttgtaacagattaccacaaacttagcaacttcttacagttctgtagtttagaagtctggcactggtctcactgggttaaaatcagagtgttcttagaactgtgtttctgtctgaaggctctagggagaacccatgttcttgccttttccagtttctagaggcctcccacattccctaaactgggaataaccagcttcctgcatcttcaaaaccagcaacgttgcatctctctgacattcttccattctcatgtctctcactgaccacaacaaggatttctttgcttttaaagaccaatgtgatcagatcaggcccaccccaataatccaggataatctcctcacctcaaagtccttaacttgatcacacttgcaaagtcccctttgccacgaagatagcattttcataggttccagagattaggatagggccatcatcattgaaggtctattattctgcctaccacgttaagtcgatataacattgcttacatgataaacacttgaaatgtgacattgtttttatatagattaataaaacaaagaatgttcaattaatgtcaattatgaatagagggagaaggaataaatgagagagacaagggtacaaaaaaagtatgtcttcttaaggagtatgtgttcttattaagaaaataagattttaaatgatgactccttgaaaataagtgctcgggaggagccaagatggccgaataggaacagctccagtctacagctcccagtgtgagcgacgcagaagacgggtgatttctgcatttccatctgaggtaccgggttcatctcactagggagtgccagacagtgggcacaggtcagtgggtgcgcacaccgtgcgtgagccgaagcagggtgaggcattgcctcacttgggaagcgcaaggggtcagggagttccctttccgagtcaaaggggtgacggacgcacctggaaaatcgggtcactcccacccgaatattacgcttttcggaccggcttaaaaaatggcgcaccacgagattatatcccgcacctggctcggagggtcctacgcccacagagtctcgctgattgctagcacagcagtctgagaccaaactgcaaggcggcagcgaggctgggggaggggcgcccgccattgcccaggcttgcttaggtaaacatagcagccgggaagctccaactgggtggagcccaccacagctcaagaaggcctgcctgcctctgtaggctccacctctgggggcagggcacagacaaacaaaaagcagtaacctctgcagacttaaatatgcctgtctgacagctttgaagagagcagtggttctcccagcatgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaagagaaaactggaaactctaaaacgcagagtgcctctcctcctccaaaggaacgcagttcctcaccagcaacggaacaaagctggatggagaatgactttgacgagccgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaactctacgtctgattggcgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatacccagccaaactaagcttcataagggaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaatgagcaaaatcaccagctaacatcataatgacaggatcaaattcacacataacaatattaactttaaatgtaaatggactaaattttccaattaaaagacacagactggcaaattggataaagagtcaagacccatcagtgtgctgtattcaggaaacccatctcatgtgcagagacacatataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagaactaacctaaatatatatgcacccaatacaggagcacccagattcataaagcaagtcctgagtgacctacaaagagatttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacaccacacctattccaaaattgaccacagagttggaagtaaagctctcctcagcaaacgtaaaagaacagagattacaacaaactatctctcagaccacagtgcaatcaaactagaactcaggattaggaatctcactcaaaaccgctcaactacatggaaactgaacaacctgctcctgaatgactactggatacataacgaaatgaaggcagaaataaagatgttctttgaaaccaacgagaacaaagacacaacataccagaatctctgggacacattcaaagcagtgtgtagagggaaatttatagcactaaatgcccacaagagaaagcagtaaagatccaaaattggcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacacaataaaaatgataaaggggatatcaccaccgatcccacagaaatacaaactaccatcagagaatactacaaacacctctactcaaataaaccagaaaatctagaagaaatggataaattcctcgacacatacaccatcccaagactaaaccaggaagaagttgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaatagaaaaagagagaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcataaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaggcattcttatacaccaataacagacaaacagaaagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccaaccccatcaagctaccaatgactttcttcacagaattggaaaaaactactttaaagttcatatggaaccaaaaaagagcccacatccccaaggcaatcctaagccaaaagaacaaagctggaggcatcacactacctgacttcaaactatactacaagactacagtaaccaaaacagcatggtactggtaccaaaacagagatatagatcaatggaacagaacagagccctcagaaataatgccgcatgtctacaactatctgatctttgacaaacctgagaaaaacaagcaatggggaaaggattccctatttaataaatggtgctgggataactggctagccatatgtacaaagctgaaactgtatcgcttccttacaccttatacaaaaatcaattcaagatggattaaagccttaaaccttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcagaaagtgggctaaggacatgaacagagacttctcaaaagaagacatttatgcagccaaaaaacacatgaaaaaatgctcatcatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtcgggggaggggggagagatagcattgggagatatacctaatgctagatgacgagttagtgggtgcagcgcaccagcatggcacatgtatacacatgtaactaacctgaacaatgtgcacatgtaccctaaaacttaaagtataatttaaaaaaaattaaaaaaaaaaaaaaaaaaaaagaaaagaagtgctcaagggaagtttgttaatttaatctttgggaaaatgcaatttatcataatttgtgataacttattataaaatttcagaaaaaaaaatacactgatggcagggcacggtggctcccacctgtaatcccagcacttcaggaagccaaggtggattgcttgagctcaggagtttgaaaccagcctaggcaacgtggtgaaactctctctaccaaaaatacaaaaattagccaggcttggtggcatgtgcctgttgtgccatctactcaggaagctgagatggaaggatcacctgaacccaggaagttgaggctgcagcgagctatgtttgcaccactgcactccagcctgggtgacagagcaagaccctgtctcaaaaaatacatatataaaaatatattttttaaaaatacatatttttaaaaagagaaacatttaaaaaaaaaagttgaaggagaaagggttgaagcatgttttgtagatttagtaattttagaatgggaactaggtaacactgttcgcaaatctgaaatgaagtctaagtttcaaatctcataggatagaaagtactgtgtagatattcagatttatctggatcttgacaatatgttgatgtaacactcccatcacttcctaaagggttaccttactgccttgattctattttctttttttttttttcttttttgatcattgcattgttttcagcatacagagcaaagttaggcggcagctttcagctctgaatggctaatgaattgttcatctgtgtgtagaatctccctggtgcaagctctgtgtgagtctctattcctccctattcaaagatgacatcgtcaattgtggtgatcctacccatgtatgcagatccagctgaaaatacaaatgagagactagcattcctttctaaaacccatgctttaaactatgtcctttgtttgcaggtgcaattagctagtttgacaagcctgttatctgactcttcttttttatacagcctacatgaccatctcagtctaaataagtcaccccatttctttttctgcagttcatctgtcagttattttcttgtcttagagaagcctgaagttctgatatacttgtggttcaaatcactcttattgcaatcctttgatgagtaatttcagctttccatctgaagctaaatacatagacaattccaatgaaactcttcaagaattctccataaaatcaaggatctaggccacaaaattattctgatttataccacaaaatttggttccaataatatttcccaaagaggaaggatgggagaaaaattaaattcatttagaggtaaaatataatttaaaagaaatagtcttctctctataaaagaatcagaattttaattgttttttaacattggaattggtaaccaggttgaaagtctaaactatcaggcctcagacccctgagcttaaaccttaaaaccttaattatagctaacattgattgagcatttatggaccaggtgctaatctaagcacactaaaagtatccacttaaacttcacagcaaccctaggagatagatagtataattgtctctatttttcagataagaaaatttcaggtatagaaaacttatttaccttattcagctgcccagtagaaaggcttgtgttcaaacttcacctgtgtaatgtcaaagccagcttccttacccactgtactatattacctctcccatgtctcctattttgaggcatagttggacatgaatcacttacctataccaagatggaacccagtgaggaaagcacaaacttagatctaatgcctagaacagtgcctagagtacagcagattgaatgaattaatgaatgaacaaactaaacctcccatgttatggctcagacctttgaaggacagccacaagtataggtaccatgtggaaattttaaaaggtaatgatagcaacagccatggtttgttgaactacatttcctagttcacagatgacaccttctagctgtgtccccacaatgctggaaggggcaaggcagctctctggggcctctttcataaaggcactaatcccattacctaattaggtttcaacatacgaattttgaggaaacacaaacattcagatcctagaaaatatattttataatccagcaaaacacttgcctcagggtattctgctagtctgggaaaatgagagttctcagacctgaaggacagggagatggccacagggctccagtatggagggagccaggatatatctgatctgagaacaccaaaatggaggcaaaagggcaccaagtggaagtccagtgtatcatgctgaagttaagtttaggctgacacaagcaacaagggtagcatcctgttcaagctgtgtgtgcaaggcatgtagactagagtttcttaaatgcccattagtgcttaaggtaaaggcagacttcagacaccagggaggaattgagccccagtgtggcagtccatgaattaccatggaatagacagaagaggcttgaaaactctaagaatcagaccccatacagaaaagctcttgctgcttctcaacatcctctgagcaaacccacttctgctcccaaccacatttcagccacctttatttatatcttctacttttattcccctcataatgagaagacctcacctgtttctctgtatttctagtgctactgtattttttcctggtgtcaacgtattttctgtgtaaaacatgtatcttatattggaggttgagccaggccagatgacaaaatctgggtttgaagatcagcgagactgatgactcagacttttgcccagcaaaaaggcagtgcaaaggatgcggaagatcagggatctacctaagtgcactctgcccacccgtgccaattcttcacagcagcataccccatgttccagagtgttcgcagcctgacagagtaagggacccgataggtcactggagaccagaagcctctgttggcatcctgctctttgttcagccagtggtggtgaacacatcaccattcaaacccaccctaccaccttagaccaaatttctttttgtaccccagtaacatctacccaagtcctcattgtctcttattccatcatcaggtccactgcaggcaacagaacatgccctggcctgttaaatttacaggaaaactgtgttttatatgtaaaactatttctaagtatatattttaaggaaaataattgctttgcatattgtgggcttccaaacatgaacactttatctctgtttaatcagcaggtgaattgatgcactgaactgaggctaaacagcaggccaaggacaaagaaagctattggcagaaattactgaaaaagtactctcaggaatactcatttgttcttctggctttcattacactacacctcctttctatagttatattttctttaagaaaatctgctaatggcataccatctgagaaaatcatgtgtcagaaagctaaataacatagtctatgtaactagttgaacaacaattgaacattagtatgaacaaggttcatgcaatataatgcaatgaagacacagctttcggttttcttttgaaggggtccttttgcaaaattattattttgatttggtggttcaaaagttaggcttttttaattagttttttttttatatcgctgggggatttgcttctaggtatgcatgtatagtactctgagtatttctacttgagtggctgcctggaagagtagctccttagaatctgtcatgagcaatggctctttttgacacatcagaggagttagctaaagtgcatcattcttgatttaggagataattttgcctttggtgagaaaagtgaaggattattgatttgactaaagaacttcatctttatggacatcttagatgagattattttagatattgttttatctttgcaaaattttagtgtgattaagcaaataacacacttataggtgtccaattaaacaaatagtggcaaaaaaagtcattgcatttacttcaggaatgatctttagttgggtcattattattgaacatgaaaaatgacctacagctgtactgtaccttcagttcgttttgctggaggtactttcatgaaatccagttacccatcatttatccctatctatctctgtataatctttaaagatgtcattatgcagcatattcaactgtctcctaacacattatttgtaaagtttttgattgtctttatgtattcctttaaatataatgtagcatatccatataggtagcttcataacagttgcttaatgtgaattccagcctgcactatcctcttataagctgaagataagagaattgtcattcttgatctattcaggttccataataggaactttacagaaggttttatgtataaaacagacaaatagtgtgtacttggtgctatgaaatgcccattgttaataaattttagaaacatatcagtaattataacttaggtcctgtcatgcctgctttaataaaaagaatattttacctacataaaggtagatgaattacattatttggaacaaattggtagattttcacttcaagagaggtataaaatatagagagagtcattaaggtctggtaaaagtaaagcactgagatatagtattaggcagacttatctgaggtgggcttcagtgtaaactgaggttctcagatatgaaaaaaaatctaagtggaacataaaaacacacataaatgacagacaaaaacccataaagtggctcattgttagaatacaaagaactatcacaattcatggatgtaaagagcccaactatgagacaaatgcccataaacgcataatagaaaactcaaatgatgttaactaatggatgtcactacagatattttgtgatacattttatcacataatatctgtgataaattttgattccaaaatttagcaaaaccgcactcgagttaaactggttcaatttaataaaaagtggcagaaactaaactcaggtccactgatacatgtaaaatggaagtctggcccaaaaagacagtccagtatgagactgggccttcctccacttgccttggaaccttgtcacactctagtttgagaataagttaaataaaatgaatttccacattatttgctttgccgatggtagagatatccaaagacaatggtaaagcacataatttagagttgattgaaactatagtttgaataagcaagcaaatcaagaagttactgagacacaacaattttgcattcctgtactttcaagaattactgaaaagttgagttaaaaaaatatgtcagaaaggaagtatttacttctctccataatagagtgtctgctaataaactttccctcctattctaaagagctatgaaattggacacaatataagaggcattaagaattatacagaaaaattaagaaaagggaaccacacaatacgagccccatgattgtgccagctttccacctgggcacacttgatgctacagcatggggaagattcaatattggtaataaattaaaaaaaagaaaaccttgattcttactttacaacatatacagcgtttgagattacttaaaggtaatattcaattctatatagcatctagaaaacaaacagagtgtagactacctttgagacctaagaagtacgcagagacacagaaagcacgtttatgggcataacacaatcttttttttagacggagtctcactctgtcacccaggctagagtgcagtagcatgagctcggctcactgcaacctccgcctcctgggttcaagcaattctccttcctcagcctaccaagtagctgggattacaggagtgtgccaccacgcccagccaatttttatatttttagtagagacagggtttcatcatgttggccaggctggtctcgaacccctgacctccagtgatatacctgccttggcatcccaaagtgctgggattacaggtgtgagccaccacacccggcctaccacaatcttaatgtaaaaatataaattggattttacaaagtcaccattaaaaaaaatgaaaaggcaagccttaagttgggagaaaatgttcatagcacaaatatctgataaaggccttatattgtgtgtgtgtgtgtgtgtgtgtgtgtgtgtgtgtgtatatatatatatatatatatatataaacaactcctgcaaattcataagacaaagtcaaacaaccctatacaaatggggaaaagaataatagtccttcagaaagaagatacacaaatgatcgatgaacacatgaaaagtttcttgatattaaaagtcaccagtggataaaaattaaaatcccaatgggatatgagtttatacccaccaaaaaggctaaaattaaaaagactattaatgtgaaatattggtgaaaataatgagcaactggaactcttgtacattgctgatgagagtataaaatggtacaatcattttagaaaagcatttgtaagtgtcttaaaaattgaacatgctcctaatccatgaccccaaaatccttctcctaattgtatactcaagagcaatgaaaacatttgtcaaccaaaatgacttgtaccagaatccacaagcttttttcctcatagccaaaaactgaaaaatgactcataagctcatcaaaagggagatttgtcaacaaattacacagagcactcaaaaataaggaactgcctctattgactacaatatggatgaatcgttaaaattttttcttgagctaaagaatccagacacaaaagagtatatacctacattattccgtttataaaacattcaagaataagtgaaattaatctatgactaaaatcagaacaatagttgcatatgagggagatggagattgactggaaagatgtatgcaggaaatttcagggtgagaaaaatgtcctgtaactcgactactgttggttatgtgagggcctacatttatcaaaacttacaggcatacctcagagagattgtggggtcaatttcagactaccccaataaagtgaatattgcaacaaagtgagtcatacgaattttttggtttcccagtgcatataagaggtacgtttatactatactgtagtccattaagtatgcaatagcgttatgtttacgaaaacaatgtacaggccttgattttaaaatgcgttagtgctaaaaatgctaatggttatctgagacttcagtgagtcataatcttttcgctggtggagggtcttgcctccatgttaatggtcgctgactgatcagggtggggggttgctgaaggttggggtaattgtgacaattacttaaaataagacaacaaatagatttgccacatcatgggcccttcctttcacaaaaaattgctctagcgtgcagtgccgcttgatagcattttacccacagtagaactgctttcaaaatgggagtcaatcctctcaaactctgccactgctttatcaaccaagtgtatgtaatattctaaatcatttgttgttatttccacagttttcacagtatcttcaccaggggagattccatctcaagaaaccactttctttctcaaccattaaagttttgtcatgagatttgagcaaattagtcatttatcttcaggctctacttctagttttagttctcttgctagttccaccacatctacagtcacttcctccactgaagtcttaactcctcaaagtcatccatgagaattggaatcaacctcttccaagctcctgttaatgttgctattttgcccttctgcctatgaatcatgaatgttcttaatggcatctaggatggtaaatcctttcaataaggctttcaatttacttcgcccacattcatcagagggctcattctctatggcagccatagccttataaaatgtatttcttaaataatcagacttgaaagtgaaaattactccttgatccatgggctgcagaatgtatattgtgttagcaggcatgaaagcaacattggtctccttgtacacctccattagagcggtaatacattgacagtgatctgcttctctgagcagtaggactcaacagagggcttcaacattctgtaaaccatgctacgaacagatatgctgtcatccaggctttgttgttgaatttatggaacacaggcagattagatttaacataatttggaagggccctaggatttttggaatggtaaatgagcactggcttcaacttaaagtcaccagctgcattaacccctaacaaagagagccagcctgtcctttgaagctgtgaagctaggcattgacttctcttgtctagctatgagagttctcaatagtatcttctaacataacacgtttcatctccatttaaaatttattgtttagtgtaaccaccatcatcaagtatgttagctaggtcttctggataacttgctgcatcttctacatcagcacttgctgcttcaccttccacttttacattgtagagacagctttctttttaaaacctcatgaagcaacctctgctagcttcaaacttttcttctgcaactttctcacctctctcagcattcattgcaattgaagagagttagggtcctgctatggattatgctttggcttaagggaatgttgtggctgctttgatcttctatcgagcccactcaaattttcttcatatcatcaagaagtctgttttgctttcttatcattcatgtgttcactggagtagcacttttaatttccttcaagaacttttctcctttgcattcacaacttggctaattctttggcacaagcaacctagcttttggcccatcttggctttcaatatgccttcctcactaagctcaatcctgttctgcttttgatttgatttaaaggaaaagaggcatgcacctctttctttgacttgaaccacttagaggtcattgtaggttttttcattggcctaattttaatattgctatgctgcagggaacagggaggcctgagaagagagagagacaagagaatgacccattagtggagcagtcagaacacatgcatttattaagtttgctatctcatatgggcgcagtttgtggcatcccaaaacaattacaacagtaacatccaagatcactaaacacagatcactataacagataaaataataatgaaaaagtttgaaatactgcaagaattaccaaaatgtgacacagagacacaaaatgggcacatactactgggaaaaaggtgccaacagacttgctcaaccaaagttgtcacagaccttcaatttgaaaaacaaacaaacaaaaaaaccctcaatatctgcaaaatctgcaaagtgcaataaagcaaggtatagtcaaatgatgtgtgcctataattaaattgtatatttaagatttgtgcatttcagtgtctgattaccacctcaattttacttcaaaaaaaggaagtgattgaaagaccatttatggtatgtttcagtttgtgttattgtgttttgatcatacatggttccagtactcatcccattcattgtgaatcttcatggttccagtaattctaatattgacccagagtgccagttaattaggcttaaagcaaaagagatgaaatagggaattcagacctgatgagcttgctcagggatttatgtgtggtgaacagcaagtgttttggaatacatggttagtgtatctgttaactgaaccatgaatggaaccatggaatgtgtattgtttatcttttgacattggtgtagggaataaaacaagactccttggttgttggaaccctcacccctacttgcatacggcttttctggattttcccagaaagatatatttttcttcctcaagtacccacagaaatttgtaccatttttctgtgccttgcattttaattatatctgtgtcatatcacccctcctagttggtgtggctaaaaggctaaactctgctcactatctctgccacccatagcacctataacattctttaatttagatcaagtacttgttgaaagttttaaatatttgatggatttgatttgattggactggatgaaataacctttgtatttaatggaaccacagaccaggaatttgaggaattgaattcatttgtgccttcatataatgaagttattgagtacttatcacatgcaagacactgagctaagaaatcttaaaactcaaagatacataatatgtagtacctgcatgcaaaattctaccagtctgatagggaaaagacaatgtgtataactgatacacaataaaaggcagaaagtcatgtgaaaaaagagaggaagagaggctttcttatgaaaatccaaaagaggtcaggtgcggtagctcatgcctgtaatcccagtactttgggaggccaaggcgggcagatcacttgagcccaggagtccaagaccagcctgggccacatggcaaaaccctgtgtctattatacaaaaacataagaattagccaggcatggtggtgcatgactgtaatccagctacttgggaggctgagataggagaatcacctgagcctggggggatggaggctgcagtgagctgtgatcatgccactacattccagcctggctgacagagcaagaccccgtctccgaaagaaaaaggaaagaaagagagaagaaccaaaagaggaagaatatctttgcctctatttacactttgaaacccttactttcttttagaccaagcttaactcctatttggagtatgcatcttgagaaagccaaaataaatactagcaagtagtttttgaaattttcttgtcaataaaaagtcaagaaaaaacaaacattccttagaggggaatattcagtattccttctagaattataagtgaatgggaagtgatgccaacagttccaaccaagtttgttcctttcttcctcacaacagcgagcattagcctgtgagaagccctggtttctaatttcatctctgcccaaaactacataggtgtcctggtcaattcacttaattcctctgcatcatagtttttacatccataaaattagagaagagaacagaatgttttccaaggtctactccaactctaaaaatgtcatgattctatattctgtggctctgtgatcctaattacttttgataagatcatttatgtgattttggggattggaaagagattgtcaagtttcccaaacttcattgatccatatgctaacttcactgattgtattttcagtagtatcgatgttaattatttttcctaaaagcaaatgacttttatacttaaatatatttagctttatcctaagcaataatatctatgaaagcatacattttttagtgttacttatggttttttaaatatgcattaaactaaataaccattaaatttgtctcttatgccaccaataacatatatgtattctactttaagaaacactgctttgctgtagtaagtaggaaagtctgatccaatatctttgctagttgattagaaaagtcaatcataaatgctatcagaataggtcaacctatatgcaccagtatccacaaaggctaaaaaaaaaaaatatgctgcactcaaccagaatcttcaaaaatcctgggattcggctcttaagtgggtttgtgcattacctggaaaacaatttgcaaaacagatttttaaagttcagagtaaattggagaaagggctacattacatttgaaccttaataaatacttaataacccataagacaaatagccatgaattactagaatgatttcaagcacagtgcttctgcagagtcaacctgctcttatttttgctcattataaaacaggagttataatattgcaaagtttattagctctgttgatttgtgtgttttataaaacaagacatttgaataatatagaaccagagccattaggaaaatctatttcctttttcttctctatctagtctcctctgcccaagatagcttgaaaatgtctttctcgtagaaacagaaaagcatgaagattcctccaactctgtccttttttatagatgttgtttatttcttgaatgagggggtgcgtgtgtgcgtgtgtgtgtgtgtgtgtgtgtgtgtgtgtatgtgtgtgtgtgcaagcttaggtcctcaggtggaaccgtggttcctgtgctttcgtcctcgaagctgtttttctggaagggaatggaggcagctgtgtttacagctcaagtcttggcatacatttaccagaatctattattcatatcattcagtatcagggagagatctcaggccacctgtctatctgacaaattcacccttttgtgagctttctgttcatagcaaattatgttcacattgatgaattgagtttttatgagcattgctaactaacattctcacagaaggccaggggcaagagcctgcaagtgtttctggtccataagtaaatgattaaaaaaaaaaaaaaaaaaaaaaaaaaaaaaggaaaaaaatggtagtgtttaaagacaatttgccatggaggaatagttaaatcatttggcaatgccttaatatttataattccaagactttccataaattattgcaaatactcagcttataacaaacaaaaacatggaaaaaatccacacaatatttttctctgtagcacagaatattattgaaaaattgttctgcattttgacaggtaaccattgaccagggcaaaacatggggtagttgaagaatgcccagcattaataaatctagcaattttatacaataatgtggaaaacttgcagcaattgtagcttaaattccagcttggtatttccatagatacaaaatggatttccttttaatctctagtaaccctatactggttatggagctaagccatgtggcttgagttaaataaatgagagcaatctttcacaaaaggctaacagaaatccttctaaatggtgggtggggagatacccagtgttcatgacagaaataaaaattttctttggtttacatgtagaattggttcttctcttgggcctccatggcccttgcatttaccctgactcttagtctgcatttcatttaaaacagctgaaaaagagaaggtggtttcaccagagagacacgttctagttttcctgtacccacatttcaaagcgctaattccaaatctccttaaaatgataagcctgcataggtggcagagccactagtcagtatatatttacataaaaagcaacaaaacagaaattttacagggcagtgagtaatattatcaataaaaatccatgacttctcagttcactcaagaactgtgatcctatcctcccaaaagacagattactacctttgataagggacaatcctattctctgaaatcttagtgaaagtcagtagaaaattctaaatctcttcatagtagcctgccaaaatgtgtcagacacatcacctttcagtgcaaagacaccatagcacaaagaacacttggcattatcccttgaaaatgcacacctttcgaaggagcaaatgggaagtgtagtctgttaaacaccatatgtgatggagctgcaccagtctcatttccccttccaaacgctacaagctgctacctcattgtggtgtgtgtgactctagggggaaatcagtgacagctgagtgtctacctggtcccaatgtcagttggcttgttgaccacttaagtatgcagttcaatgtgatactatgctttagtgacctctgagaaatagaatccctgggcctttatgttaatttagtagcgtatgtgaaacttttgcaaactttccagtagctgcccttgccttcagatttgtgggtaaaatgaggagactggatttgcagtccttaaagtatggaaagatgcagacgggcaaatttctttgaaaatttgtcttgacatttccttccagtcctaaaactactatggataaatgcttctgttttattaaaaataaatttgtggagagtcatggccataaaagtcttcatcacaggtttgatcggaattttctgtggtaagcatagcgaccattcatccagattctctataaatagttcagtttccatatagttcttccttttatccaaccgtatgttcctatttttgttcagacaatatggtcaatgaggctttaaggcaacaggaccaatttacctgcaagaatttttcactctaagattacagaaattaacacaggagatagaaatcgaggtgttttgtctctaagcaagcaatttgagataaagaatgcattctttggtgccagaggcatggcaagcagcactctgcagcttggtgccctattcatagtgtcaagcagctacaggaccaccattttgctccttgaaactgctacagcattttaagtaatgctagaaggctaaaagttgactgcagctagtagagcattgttctttttttaacccatgtgataggtatcttcagcagtgtcaaacaaatttgtagagctggtgattagttgcccaaagagcataatgtatgcattattaattaaagaaggtaagtttggctaattgtcatttctatacagtagcagtgcactaagatacattttaacaatctataaataattgataattttttttctttcatcttccttcctagtttgcataaaactaatgacttggtaaatgttactctcttcaaaatattccaccgcttctatgaaaattaaactaacgctgtaaccttagcaaataaggagatttttttttttccttttattgcaggttaaaaaaagataggaattataacacttaaaacaaaaatgtgattctgtggaaagccaaatgagaatcataaataatataaaatcagcaatgaatgtgactttaagaaatagaattgactttaaaaatgtgaaaatgcaaaaacatgattacatatatacatatatacacatatgtatgtgtgtgcatgtgtatacacacacatgcacagatatatatatatgtacacgcacacacacattccagcagccccaaagtcttgcttgttcagctttcaaaagcctaaaactacaaccaaaagctttgctccaggatatcttccaagtctggtgctggtgtttcagtacttaccaatagctacatgaataatccttcaatctcattagcagaggacacaaaatttttctcagctgaagtatttgagtttacttcctatatactttgctaatttgatcatagcacctagatggatccttatgagaagagatttactgcagcaaacctacccacttctcctttttcgcaggagttctctgttattcttacgaatccacaatctgccagtctggtgtaatagcacaagagcttgcttactctctaattttcagtgcaactgaatacattcccggagttattgatggcactgtaattttacgtttattttgtttggaatacattgtggttaaaaaaagatttctttaagaagacccacaaactaaagtattgcctaagtgacatattgttatttaagccttcgtcgagtcttacatatgcttcattatgataaaaaacaggttgtaaggactgattctgtgacctttttttctcattttaaccctactgatatgtcacccatggcaaccttaaactgattttaatagagtcgatcctattattcatttaaattgaggtgcaagagcacttagaccagggaaatttgcattcagcaaatggggatttgatgagcaaaaatgataagatatatgttgtataacatggcctattttgctagcaaataaacagctcttgaaattgataaacttcagaatattttatcctcaaatgtttatacataaatgattaaaatgcattagcaattctgcttttgaaaaaaaaacatattgggaaaacaacacagttgtgttgcttaaatttgtaattaacaaatttattactaattctgttcagttctttaatatgctgcattcctgaagaagaacattaatacacaatggcagaaagaagctaattttaagactttggagaaatgaatgtcttttaatgctgtgtgtttctcttatctacatgccacattattgtaataagtacattcaggaataatttcttttcaaatatttttacaaatcttgctcttatttgcatgcaagtaagttgtcagcttaaatctttgaaatgcaaaatatatctcatttctatatttcatcaaggagcctttcatgtttaataaattacaacttagatcctccaagactttgtttttcattaactaaaagcaaaaggatacatttaaaatcttaatcacaacctgcaagggtatttgcatgttgctgatatttgtcttgatgggacttttaatatttgcaaactaatcaggatagcaaggttataccaataatttctgaagacaaaaaactttctgcattattttattatattgaagaagaaaacttaaaaaaaaattccagtgtcttagcctcaataatctgtacacttttttgcacacatttatctcctaaagattttaattggacaaatggccacatctcagaagcactattgaaaaatgtgtacaagaatgtcacatctgggttcagtctagtcttttattagtgcttgatcagcatgtattggacagaatcgttaacacaaaacaagcaaggtaaatcatccactacacactaccaccctgataaccaccttgtgccactgaataaaaatgtggatccaggagaaatcaaaggacatccttcactcatttgatttgattccagtttagacagggggttaagggtgtttctgcttttttggggttttagtggttctttttagtttaaccaaataccctagctgatcttgcagaaagtcttctggactctgaaataggatggatcatctcatctcagcaaaaacaaaaaaaaaaatcttgacagcataatatccttattggggggtcccatgggccacagcaatacaatgtcacagaagaggcaaacttctgctgaacttgctgcccagagaccttcagttaatctttctctctagaatggaagatcaaaaaaccccgagcagcttaaaaaatatgcagctaatgtcatgtagttaaactgatgtagcatgcatgttgttttgcaagctaaccggttaaatatggctttgctttaagattcccatcaaatttcgtttttatagagaaatctctgaaagcagtaggggttgagggaaggtgaggtaaaaagaaataaatcattgtagtctcaggaacagtaatccttgttgaggattttggctgattgatataaataacatcgtccccgccatctgtccgaagagagacctttccagtcagtgttaagctgcaacggcagaataattaatgaatggtgtcctttgtgctggtaataaagacaagacaaattatgttataatccaactgctgctcatttgtcacagccaaataaaatgtcaaataaaagtgaggggggcactgtgtttgtttaatggactgcaagctacctgtttctgttgttgacagacaactagaatgtaagttttgaatgttgcaggaaagcaaacctccacaccgaagtcgcatttgctcgggagaggggggtgggcttgtagggtgaccatgggggaggcctaacacatcaacattgaagtaagttttaattagagagctataataccaccggctcctctgagtaagttggttgtgattacagtgcagaagcactgcctggaaagtccaagttcaaaacacagtcgagctatttgcaaatctgtaagaatttggtagggctctcatcttgcattttcaggatagacacattcatccagttgctaggaaagccaaataatgaaaacatagctgggatttagcaagttccattgggaattacctatgatagagggcagggctgcacttcctcagaacatgctcctgctgtaaaaattcacaaacctggcattcatacaggcatctgtcgcttgctctaatgccagttcatagtatacatacaaacatctgcttccgtgcacaaagggatacagagcgcttgacaggtctgtgttagcagggttcgcaatgccagttctttatgcaaaaaccctaatgcttcccgtcaagccattagaagtgatacaatcagcccaggccccattaagccatcagtgtccacctgtgataaagatggccatttgttttcttaaagcccacttaatgtctgcttaactcaatttgtcaggaaatgtagaacaatttcctcacagcctgaaatttggtagtggttcaaagtcaaaaggccaggtctagtcctattcaaatgatataataaacagtcttcaaatcgaaatctctcttgagaagctgatgtttactttaaaaaaaaaattatgttagctggaaaagaataacatttgtgtccagtattattattttttatttctaaagtcctggaatatgtctaccagtgaaaaggtccattgcttgattgtatgagaaaataattttattctctttacaaattcagccagaaattggatgtagaaaaatgaaagagggcctggcgcggtagctcacgcctgtaatcccagcattttgggaggccgaggcaggcagatcacgaggtcaggagtttgagaccagcctgaccaacatggtgaaacccctctctactaaaaatacaaaaattagctgggtggaggctattcaggaggctgaggtggagaatcgcttgaaccctggaggtggaggttgcagggaaccaagattgcaccactgcactccaccctgggtgacagagcgagactctgtctcaaaaaaaaaaaaaaaaaaaaaaaaaaaaaaaaagcccttgcaaagcactactctcaatatagcaatcactcccaacccctaaggaatcccactgtaatatgcacacatttactttttagtctaattctatttaaaatatttcccaccttgcttacatttgttggagattagtattgtctttttatatcccttaaaagtgaaaattaaatgactgtttttgaacatattttattgtgaaaatggtataaatgccatatagaggcttactttgcccccatctcaaatcacttttaatcacagggccaatttcctgtgcttaaatgtgtctggtcagaaaggaatccgaagacacttctaagattaaccaacagggggctctcttaaatattccagatacactgacgtcctactgtttcaaattagtggtccatacaaatctaacaccaattttgacttaaaactgagccaaaaaccttaattcttgtttgtccaacaacttctgcattcaaaatatttaacttctggttccttgtgttcccgtggactagaactgggagctatcaatgttaattctaaagaatattttctcagctcattttgcacataaggtacactgaagaattgagtcaactgtctggactagttgatcgacagatattaaatgggcatctaatacttgtagaacaattgaggcaaaattaaagtttagggatatgaatcagctgggtaactatcttatttctctacttttctctgcaagtagagaaaactttaacggacctatttttcttaaagaaaagagggattgatatggcttaaaggctcaggtatgagaaaaaatgtgtgtttcaatacaaatattttgaaatgaacagctgactattttcttacttagaaatgttactgtgacttctcatccatgaactagtgttatgtgtataggttttattttccactctttggaggctcagtccaataagcaatacaattccctaagaaaggatttgattgaggaagagccagaaattagaatatgaaactagaatatatttacatacatggcactgcagggtccttagtcctccttcagactgcaaatatatagtctaaaggcattttatatcttctgtactctctctgcaagtgcccctacgcccaataacttcacccaggagaagatagtggcaaactcagactttgctttcttgattctagaatatattcactaaataaaaggttaactgcaacagaaatacctagaggaaagtctagcacacaattttccctgaagtgatttgatctgtgcaaatagtttatctttcttttggcatagaccaaactaaacgttatcattttaccaacacagagaattacttttattatcaaaataacacaaactcattattgaaaatgtggaaaataaattttaaaaatgaaaaaagaatccatactcctattatttaagcataacttatcagttaatattttggtatattcctaccagtctttttaattaactgcttagcaaaattatatggtatctaaacaattgtacaaaattatttttaaattgcttctttttacagattaaaaaataataaatatttattgaagttaacttgaaatttacagaaaagtgaaaagaaaaattactctaacaataaccatgttttggggctatttcctttgacatgttcattctgcatttgttttatcctagcctgcttaattttaaaacatgtgtaacataggaaaattcatatgtaatacctaattgcttgattttctagtttttatcactttaatagccctccactcagttttttcaataccattattatagatacaaagcaggtttaccaagtattcctacgaagagaagtaaacattatgccactctctgcagctttgatatttttgaaaggaataaaaaacttgtttagtatctctccagagcaatgttccaatgttgttttctagcaaactccagaatgaacagcaccagtcattgttttaaataatcatcaaatgcccccagagctttcacctgaaccatcaagggtggaccacaagaaaggcatttcctgtcaccaagagctaagtggaagccagagagaagtaatccaaggaggcctttggagttttagatccaaattaagtaaagaagatgcttagttttgtttacagtgtctctattcttgagttgtaaattttgattcatcacttagtagaattacataagccttcacgtaaacttttcaagaaagctgtcctattataaatctttgcatacatgagaatgtctttgttattttaacatgcaaaagacaattttgagtatgcacacaatttgagggccacaatttctttcctataaattcaaaagatactgccttgttttcttttaggatttagtgagaaaagtgttaggaaagactaaatgtttatttttttagtcttctttttctctgaatatttgtagaatgatgctctatccttgccatttgaaagttttgccagaatatatcaagatagtataccacctcgataatattttcttagaacctcactgtcattttcaatattgaggtagttttttaactcacaggagttttcttaattttgtgcttgacttgcatatttttcaaatgttctggtttcttcctcaagtatacttataagctgtagataatctcttcattctttgacttccaacatgtcttctttctcatcattttttatgtctccatattctgggaaaacttctctggtttgtcatccgtatcacaaacctaatttttctggagtaacaatttgaacttcagtgcaaaatttaattttgttttgcatttttagttttcacactgtccttcctcaaatcatctatataattgtcatcttattctagtgatcttttcatcttccctgtcctctcctatggcttgctgatccttctcattccactccctgtgtcaaattttattagagatactaagtagcttcttaattgtctagcagttactgtaagagttctaagctttttatgagcattgttctctgagttctttcataggtcaaacgttgttggaaattttgttatgtttactcatctcaaaatgtagaaatgtatgcaacattctatgcacactgatttttaccctctgcttcagctccagccttagcattttgtcttgaagctatactcaaatggcaaatttataatcacagctcttacattaattcttatctagcatacttgttctcttaaggcactagtatcctgacatcgaattttctcccaccctaattccttgactctgtggcactctaaaagataaagtgcataaagcattagaattccaagaatttcttcctaaagaattttgccagtctccaccctttcttccctttatgttttacatatgggactacacaattcctatggggatatgtgccattatcaggactttccttctgccttctacctacaatatcctcagttatacttcatggaaattgctatctttaaatgatcccagtatgaagagaagtcttgatgtgtagcttagaaaggaaggcgactggtgagaaggggcagaagggaagcattcacactacttctaaacagcattaactgtgtaggaaaaagctgcccagttttttggttggcataggcctggaggctttgattctaaaaatcagacacttgaagaaatataaggatgcttctatctgctttcaggaaggcagactctctggttcagtacttcaatagctcatgcaccactggcactttccaattaagaccaacatgtcttcgagtaagttattcttaaatttttgtcactatgttactctcagtccctgtttaaattattataagaattctattatgttttctttgctttgaagcaaatttagtgacaagtttcaagaggtggttaggtgttgccaaccagatgccatttaaaaccaaaagtcatgatttgcatcagctctttgcagagggcatcacactgaaagtttgcaatcaaattcttccttggggtgtgacctctgcctatggctacttctttacagttgctgttgcgtctttacctggaaatgataacgggccccagaggggaatgtttatttttagtcctgccatttacaagggcctttgagcttctaagaagatgcttagagttacaaaatgtaaatcaatcatttcattgtaatgatagatttcagagtattattttttccatttggggaaattttttttcactatctaaaccacaccttggttctttataaaaagaattttggattttacatcatagaaaaaaaagtttctcttggcttgacttgctggtaaggaggtgtgcgaatggtctcaagttatacatttgcagagaaaataccatccagatgctcaagtcagccttttttttggcagacagctaaaaaccataccaaaactgagtctcaagtctttaacaaaagaattccaaaagctcttacctttggaacggacattaattaaaagaagcagtcatatcccccgtgatcagagtttaactgctattaatcagagttcatcacacaattaacactttgaactgattagcaaatgaaattatagcaagaaatgttgaggttaggacagcggacggacgtactctcttgcccaactcacagtccctcatcttttaaaagaagggaaaaaaaatgaagcactctggtcataacgaattgtgcagattttgttttcagtgaggtgtttgccattacatattgcacataatgtatggcactgttaggaggaaaaaattggagtcaaagtggctggaaagttaggtctgctctgtagcactgtgagattgttgacatctgccgaggttggagcgctcagtaagcaggaaatggggtgtcactctgagtggtagtttaccattatcctggcatcctaatgaagtgtctgcagtgcacagagcttctggatggcatcttaacgcacggctaagcaaaagcacttctctccctgtcactgtcatccatctgcctgcaccctactgtagccaatgggatggaaccatgctacaatgtgctataagccatttagagttgcacattgcataatcagtcccatcaaatatgtaaaaaatggctattattggttattctcctcaaactggcacctggagtttgatacatgaaagttcaactttttcaagtactgtttctgctattaattccactccccccaacacattatctaaatgggaatgagttgcatcttcattgtcttaaggcttattaatggattgaaagtgttgtatgaatattcattaataatttcactgtacatcacacttggagaattcatcaatttacaatataatggaatggtcattttctttgtgataaccatttttaagaaaaggacaactcccattgcagattggctgttttcatcttagttggcagggagagtttgaggtcgttcaataggttttctttttaaagacatagagcacttcaccaagtacatttgaattttaagctattattgccaatgccagatgatggaatttggtgttttaatattacctccgatgaaattaaaatgcagtgcaaaagaggatatctgttgttaggtgacagaagtagagcagggtgtgtgtgtaatcctcccgaaacttctggataggttttgcaagcaaggctgcaaagcagctagactctcatggtaagaattgaagtagtaagatggtcacaaagttgaggaggagctttctgtaataggcaggggcaacaataatctgctaaattggggcaggggggcagggagggtagggttagataaataaaagggcataacataatttggttgcatcaggaattttttcacagacattaaaactatggtaaacataacagcggggaagcttgcactgccgcacagtgggaagcttaaagcgtctgcctgcactgtgcctggctcaactacagctagaagtctccgactttcattagcactcaacaattcacccagttccccagaaaaggaggaaacccaaggcagcaaagcccctcgctaattattgtaaatgctcccaggttacagtatttgggtgacaataatggcaagagggtgtgaaactagaaccaaagagtcattctgaaatgaaaaagaatgaaggagttgtttgttgcttgttatttttatttgttttaaaccagtgtagcccttcgtttgatgggtaaagcagtatgttggaatattaggccaccattttacaatgaaattttagaagactgcaccaaattgtgtgcaacttcttttgagcaacggaagtacaggttaatttcacaaatgacctcctccccttggcctccaaatttatgtgagtatatttcacaagtctctgcaacagaaactgtttcctttgaaggaaatttgtaataatacaaaaaattacatggaaccaaatgttgcaaggtaggcagactaacacacatcactgcaagatactgcacctcaggttaaagttgatatttttttccccttcaagaatggagtcatttgagaaaaatattggacttcttcaaaggaagaggggtctactttggatgcctgtaagcatttaaagtgatagtttttttttaatggaatgataggtgtttattcttgctaaatccagactcgggaatctggtttcttcattcatatccccccagctgctgtcagcaatgcagcacaccagcgttccttcatgtgcgaatatttctccagcactcatttgcaagagagtcgaagcaatattaaacaccacatctaaacctcttttaaacacacaaagcaatgggaaaacacatcagaactagaccattgagaaaatcctcctttcaaatttactgtttgcttcacatgctagtataaaatatcccacaaagtcccgtttgtgatccatttgaaacaatcttgatttgcttaaattgtcacattcttcttgcacatttctttctaaatgcaaaaatggcaaagaattctactccctcttcattataaaagtacagaatttctggcttgtttattcctaatggaacacttgagaaagaagaaaatatataaatatctttttcagaagattagttgtctcaatctttttaaaagggaggatttgttcattttttctccatggtaaacaacttgggctttgcactgtaattttccattgtcaaattaatgcatttcattttactgacttgaactcatggttttaaaacatcagaccttttaatatctttatttcttccatactacgtattaatgtatgtcattaggacgttgatagttagggatagaatccaagcatcttataaaagaaatttgttggaggaatcttctactccattataacttactaacagtctgaaagaactcactagcaaaataaaactggtttacttcttataagaacatatttccaagctaaggatttcaggcttggaatgagctgttttgagtatttcaaatcaagcataagaaattttgtctgatctactggtaaatattctattgacaaggtcaagaacagagaaagtctggacaccatgtcagaagagagaataattattttttttaagtagacagtctttcaacttcaatttctaaagtactgcgcaggctttatacagaatgtgcaggaaagtttcttaactataatgaaagaatgttcatatttacatctgccatatatgtggtacttcaaaaattaaaggcgtgaatttaaaaatggctaatattttcaagaaactataaaaagaaaggggtgggggagaagaatacaagctgtggcaaaaatctaggctcagcagctttctgggggaaatggtgaaatgtgactatgtgatttataatgagaaaaggtatctacaacatacaattttctacctagctgcaaataataattcatagtgatgtcccttccagataaaagacctttgctatgtaggacccatgtggtaaaatgatcatgataaatgtcagaccagtgcaggtaacggctttacaaaccattaagattagctggcagttttttttccgatgataacagtaaccatgctgtgactctatgtggtaataatatctcagtcctgataaatgccagagccaggcagaggtgtttatcactcccagttcagaaatgctgactaaagttgccacatgttgcctgtttttcttcttttacaatagtctcacaatttaaaaagctgaatcataaaattattttataacctatttttaaaggattttgatgtttgtttaattaataactctctctgctctcagcgtcactatgtgaccatgtcagatgaactagctggacagtttactatactaaccattatctcctcttcagaggtcttttgttcaaaatgaatggttaaggataaagtttaatatgccttcttcaaaaacaatatttttaacccaaagacaggaaaagtgtttcttaattcacatttttcttaattgtgatatagatcctagttgttttcaagtgagttttctaatcccttataaatttaattggtctaccaatggaaagacacacattgaaaacctcaaaccttgaaaagtatttgtaggatttccacccttatgaaaatgtacaaagataatgcttaatgtaaatagctagttgagtatttgaattactggcttatgatgaaaaagatttcaaatgactcaaaatagtaaagactttttttaattaaaaaaaaggttgtaaaaccagatataaatgaataaatatagtttcaagaaaatcttcacaggaaaattgaattagagaaattcagagaaataaacccatgagctttattttctcagcacagactatcgcctaaggatgaattagtatctttgtaggttacagaaatgtacttggccaccatgacacctccaaaattactttgaagagcaagaaattctaggaaggacaataggatcatgcttttcctgtgaagattgctgctggagtgtcagccactgccttacgctccaattcagacaaatagaggcatcactacaaaactgaggagtgcaagtttggtttaagaactggtttcagattggttagtctgaggaaatgttatcatcctaaaattgattggaccaaagcaatatcccctttattaaaagttacttaagcaggatatggtggctcatgtctgtatcccaacactttggaaggctgaggcgggtggatcgcttgagcccaggggttcaagatcagactgggcaacacggtgaaaccccacctctacaaaaaatacaaaaactagccagacatggcagtgagtgcctgtagtcccagctacttgggaggctgaggtgggagaattgcttgaacctgggaggctgcagtgagctgagatcatgccactgcactccagcctgggtgacagggacagaccttgtctaccaaaaaaaaaaaaaagttacttaaagactaagacttgaatacattttccaaactcgccccaatgtgagatcatagtgcatcataacatagatagatacagccacatgagaaagaaaagatattattactttcctgaatgtatttgtgaatgtatcaagaagttaagcataataattttgaagacttccagaaattgattaaatagaattttacactcgttgatttgtatcaattacacatctgaattattttggaatgagtaacatctcagaagctttttgagtttcacaattatcttagatgatcccttcagttagaagaaagacataaacttcactgacacctacataatgacatgccttatatttaaacatctattatgacaccttttgtaatttatctgcccctccagattgtaaaatgaaaagatagcaaccaactttgtatctgccacaggttgcacacaggcctgaataaatagggttttcttatttatatataagatagatatataatatatatataatttcttaagaaattatacctttatttttaataatttatggctagagagcagggatagaggtagaaggaaacagagattaccctttagaagatcattcttaacatccctcctaagagcatgctgtacatggtctaattccttcgggaccaggaccagaaatggttctggaaacagtgctaaaggggccagtgagttgaagcttccctcatttaacaaatccataaacttatgccaattaattggccagagtaatttttgatactgacaattattgactataaagagttgttcccattttttaaattcttcctaagagggcttgtttattcaaaaaaacagccaaaacatgaatatctcctggaaggagaaactgtgaatacaaggaaatctggtgtagaaaagaggtgatcagttccaactctcaggtgatcctccctagagaaagaaatgtcttatttgagtcagatagattcagttcctgcttggtctttcctgcaagtaatgtacctctcttctcaggttgaactgttttgacacagtttgtcaacatcaaaagccaaacttacaatgtatttgacattgccttccttttaattaaatataaatatggcttttctggggtttggggagaagggcacagaaccttgaaaaattgcaaattgccaactacgggctacgctcaaggcggtggtttttccttgtttatgatgcaatgacacttctatttatgatatactgtaactacttaggaattttaaccaaattctctgataattgacagcattccatatatttacaaagctacaacatactgtaccctgttcctacttttaggaaagcatactaaatagtaaaagtatgacttcatttgatttcagaaacaaccttgaaccaggagcagttatgtatcagggatgatagagaagacaatgagaaagaaatatgttttaagggaagaggacttacaggggacttacttaaatgatcacttactatgtgtacatttatgtgcactgaaatatttaattctacgaaaatccaataagatgtataatttttctgtattttcaagtaaagaactagaagcatcaatagttcaagcaacttgcccaaaatcatacagcatagcaaaaattctaacccagtcttttccagattcctgagaagtggtatgtcactggatataccgattttcttatttataatgtgagtttgaagcatgtgtatatttgtatctatttgtgagatttgaatttgcccccagagcatctcctcttaaagcaactatgagttactcaaagatatttatcaagcaattgttgtcatccctgagatgactcctcaatgggcaactcaagttttggcattaaaaagtgtatcctcagaggtttgtatccagttgtaaggcatgctgaaacaaataaaatgatctctggagatactccttcctcctgtaagcaagcacagtctctaactaaattcggaaatggccacagtacaaaaactataaattgaatagaaactagagaactgctattcttccaaatatagctctgacatatagggactaccatgtttttcatacagggtgcattagacatttcagaataactttcagaagcagaacagctgtggtaccactgacctctttaaaacaaaggaatacagttgtcctttaagaactgtagacaaatgagatgaatattactccctatacattgattactgggataaactggtcttttcttcctctgagtggacctatataacaaagcagaatttatttttaaatgtgatttaacatgaagctataagaacaataaaggcatggatgataaggacagaaaagtgtccagggacattggatccaaggttcttcactgtacagaactttttccatcatcatatacagctttatcttatctcttttctaaaaggcattgggttgtaaacgtgctttagtaacaacatttcatgcagatgaatgcaagtgtaactatcataaaccatattttgaaaaatgtgccctcaaaactataaagccacattcttatcataacattaaaggctatttcacatcacgtaggtgttacttctctgaacagcatggaatcattttttaaacttgtttacaacaatgagtttgatgtagtttgagaagatgggggcaggttggtgaggaatgggtattagtaagaaacagttgagaatcactattggatggaaaaaaacgaagcactataaaaagttgtgtgtgcaattgtgggttcacagcttagagattgaagaggctatttggatatgggtggagaactaaaatggaggtatttcatggaatagaggcaaaaataaatcataatagaataagggcaggagtaaatgcaaatgaaagagggaaagaattatggagttcattacttctggaaagattttgtataagtctcttcacatacagtttgcctaagagtacaaaaagttccttcctcctcccaccagtcataatgtaaaaagttagtgatatctcaaagtcttctcagaaccttcagcgcttcataatgagaaaaacatatgctgaaggagaaatattaatagaaaatgctgtctttcagatgctcactgaatcaattgaagacagttgacacatctttagtaagctgtttatgaatcttagctcattaaccactcctgtattatgtatgctgattccaattcctaatatgacacatcaataaaccagatctgaaaaggtgtcatttcgattttaatgtatccaattgtatttttagatgtttctccacttgaagtgtttgtgttatttcctgattttacaagctatggaagagtgggtgtggtattgatttgaatgaaaaaaaacactgctttactataaccttttcagaagattttgttctgattatgttgtaagaaaaataaattgttcctccttaatatttcagctctctctaagccatggtacacttccccatttagcacttaagtataacttggccacaaatatgcatgcaccaatatccaattgtctgattccccaagaatgtgtgaaagtggaaaaagagagaaaaatatttctataaaatattcttcatgtagaatgtttcttataggcaaacttggaaaccgacatgtacttttcataaggatacttatacataactgacctgctcaccaatcagaccatcaatttctcagcctatcacaaagtatttaggttgttgtgtaatgttgggctactatagcaattgtactttcaccaactggcaccaactcagttcatgaattagcaactacattttgaatgtccctgcaaccaaatagtatgctaactgctgggattaaaaggtgaacaagacccagtggcttgggcctcaaaagaggtgagaggggtgcaggggaaggtgaacatttatatagtactttgttttacttgtaattgtgcttggtacattacatactatcttgtttattcaacaaaactacacttttagatcttattcaaagagagtaagaaacttctccaagaccacacggctaataaaaagctgttacagaattcaaaccaaggtccacatattccagttcatggtcacaactttcattagttcactcactaattcctttttcattcatttaacccaccacatgctagcataaaaattgcctagctttaaaggaaaattccctatttaataggggaatttgacaagcattcaagcagtacaaataccatgtgaagtgttgtgtaagtagaatattctaaatgcaacagaactcaggagagggagagctgactctaagaaagctcacaattattttacctgttggcttaacggacttgactatgtcttaattcctgcccaaacaccatgaaagtgtccttgcaaatcagctctttctaattaagcaacggccaatcttttctaaccccaccctgactggatcatgttccctataagtaaagtttgctggttggaaccaacaagactactccccacttcttgcctgtaaagcttaatttatagctgctacttctgtagccctcaatgtcaactggtcccttttttggagactctggcattaacctgattattactttagtcagagacttcagtgaaattagaaaggtctcttctcctcctctctcctctcctctcatccccttcccagtttcatactgattgcttgcacctagtagttcaccagatcctcaggtaaactgtactggaatcatgccaaactgtacagaatgtatccacctcttgaatgaatatatatatatgagtgtgtgtgtgtgtgtatacacacgcatatatacacacacaattatggttgtgtggtattagcttcaaacggttggatagaaagcattcaagcatccccaatagctctgacctgggcatactatgccaatttcactctcatcttcattaacttgtactttttttctggtttatgatatttcataggccccagttggtcttgtgaagcatcacattttcttaccatcattaagctccaagagggctttttactatttggcagaaaagatgaggtctggtataggctatgatgttgcaactttcttttttttctctttctcgctcccctttgtttcttttttttgcagttgtccaagccatattatgttggaactcttctaagaataactgcaattttgaaagctttgactgtgggaggcattatttataggcctttgtggttttagaaggaaaaagaaaagcttccaagcagagttctactaggaagactgcccccatcccactttagccaaataccatcttctgcaggatattttcctgtaattccttataaaaaaattcttttgcgacaacatattaaagaacctgccagtttctaaactaactctttcttatcctactgtcataaagtttatatatctattgaattggacttttgtaagtacatcttattattaagaactgtatttggccttagtatcagagatccatcctcaaaggcttcagtacacagggcttattttcttatgtcaaagaaacccagtgggccaggcgtggtggcttatacctgtaatgccagcacttaaggaggccaaggcagaatgattgcttgagccctggagttcaagacctgcttgggcatcataaggagaccctttctctacaaaaaataaagtgagctgggcatggtggcatgcacccgtggtcctagctactcaggaggctgaggcaggaggatagcttgagcccaggagttgagactgcagtaagccatgttcacaccactgcactccaggctgcacagtagagcaagatcctgtctcaaaaaatacaaaagaaacccagaggcagacagtgcaggactagtatgactgctccacagattcgagaaagctctttctacctgtgtatttcactccacagagcttcagttccccagattagctcatagtacagccactccatctacattcaaagaaacagaaaggaggaaaggtacacaggctaaaagctaaatcagctcatacatgctctcccagaaggcctgaccaaccctgtcacttcagtctcattggccagacttggtcccatggccactccagctccaaggcagctgggtctattaccatcctcttaacagtgggattgtcttgctaaggaagaagagaatggttattgggtggatgtttgccttacatattagtcttttttatatcttattttccagctgtggcctgtttagaatcatcaagagccctgtgctagaagttaaagtatagaaaggaaagtgcatgaggtgtttaagttcaataaataattatacctctagatgataaggccctggttaaaactgtggaaagatgaattccctagtgtactaagtaaatcaatttttacttttccatctataaacaaaacaaaatgagagaaatcaatgtggtatgcagttttgaacaacttcctattttataaaatgtttatgaccaggaaatatgctatttcaatttttttttctgttttaccctcttattttaaagcaaaaacaaaatgtgtaagggaaaaaggataacatggaaataatttttaaaacaattttcccttctacaaaatcaagcaacaatagaatatttgtaatcaaatcacactatatgtccttgtttagtttcccattgctacttaacactcacacaaacttaaaacacaaacttatcctcttacagttatggagggtgcaagtctgaaatcagtttcagactgaaactgaagaggttggtaggcctgcggtatccctagaggctctgtctccttgcctttcccagcttttggagactgtggcaattccttagaaagcagcccctcatcgcataccctctcttttctgctcccgttgtcacatgagaactcatatcaccttttctgactctcattctcctgtttctccctaataaggatctttgtgattccactgggcccattgagataatccagaaaaatctccccatctcaaaatctctaactgatcatatctgcaaagtcccttttgccatgtgaggtaacatagtcacacattccagggattcagacacggacatctttggaaggcccttgttcaccctaccactccttgtaaaacaggacatttaagaaaaccaaatgttaagatcaggaagataatgtcaaagtcacattgttgttgctttcatgttaagattatctcacagtacagccattctatctacattcaaagaagcagaaaggagaaaaggtacaaaggctaaaagctaatcagttcatacacagcctcccagaaggcctgccactgtcaaattcagagtcaaaataaaaagaaactccttaataaccaggttgagtccacctattccctttgactactgactaggactcttagttgctagtctcagtccaaaattttctcaagaaaattttctcatgtacctgtacctatgaaatcttgttttttccctaaccttcctttttatttttttttccagaaaagcaagacaacaacacaagaattgaagctgtaaaatctcttgtacaaaaactccctccgccaaatcgtgacaccatgaaagtcctctttggacatctaactaagtaagttgtaaggatttctggatgtgtcattttatagtcatttcctaaatgggcaatattgaatttcacatctctaaggcaagagtttccaaatgcgtacatctcgtattttcccttgtagctgaactaggtctttctgcagaagctggagaatgtgttagggataggaaggacaatctacaaaaggaacttctgaaataacttatttttcaaggccctttcaactagtatatgtttgctgattgcttgtcagaaccatcgcctggaccctgggatgggtcatcttgactttgttatctaacataatgaaagaacatgaaatgattcagacatggattcaaaactcagccccaccatgtaccacgtgctggggccacaaataagttacttaaaccctctgcaaccaatttcctcatctgtaaaatgttggctcagattgataaggtgctatccatgtaaatagctaagagaggagtcttccaggaaaaaaaaaaaaaaaaggcaaatgtaaagccctagaagcccctaagagctggaagtatttgaaaagcagaaattaaacccgaactgctaggcccaaatgtggaggcaagatgggatcaggagctgaagtcccaagtatcacactagcatcagatcacataggttcttgtggtccacagtgagagatttggattctattctaaattcaaggaagaaccactgaagaatgctacaattgagggagtgtaaaagattgatctggctgctaagtggagaatgcattgcaaaggtgaagagaggaagacctaatggcagacaaccacagtagtacaggcaggagatattggtggcttgagtggagccctcagagagaaatgggtagagatattgtggagatggatcaggctggacttgctgctggttgggataccattgggaaaggaaaggagaaatcaagtgtgcaaattttgggtttcaacttgggcaagtgaagaagcgatagtatcgcagagatgggtaaaactgcagagaggaacaagttgagtaggaaaagcaggtttgagagctctattttggacatgttaagtctgaaatgactgttactcatttgccttctgttaacaccttcttcagataaggcagagtgcaacgcaagttatgaggttttagctttcatgatatatgcatagtaaaattgaagcctgacagaggttcaaatagattgagcagttttgcttttgtgagattaaatctccttaaacacctcaatcactcataatttgggatgagtcattcctacagattattcaactaatctattacatgatttttcattgtgaatgtaatacatgcaattgcaccccccaaaattaagcaacagtgatgcatttacatttaaaaactgaaatctgcctaccactcttagcctgctgaacagaagtaactaacatttttgtatgtatccttcctgacctgttcctaaacacatgcaaacatatgtgtgtatggttgcttctaatgttaaagtacatcatattgcacatattattatacaactattttgtaactcatatacagacttctatttcattaaacagacttatcttattatttctaatgatgtcaatagtatttcatggtatacacagtccataacttgctaaaccagttcattgcgttagggaacatgttttaatctgactcatcattttctgtcttattttactctcaaaaggggaactttatcttaaagttcagaaaatctcttactattagagtgttccttcttgtcactcccacatactggctacggtgagaaatccaatgtggtttagtgaaaggatcttgggctttaaagaaatagaaagagagacctagagtcaaatccttgctctatgctttactcccattatgatctcaggcaagtaaaatcggattaaatactatcaaccatatcttgtggttatgagaattaaatgagataatgcatataaaacgcctggcacaaggtaagcattcctcaaatgttaattcttttcccttaggatccagacacaccatgaaagcggtttcaagttacaagtaaatactggagtgcttatctcagtaactttaactggacaaagtcataaaacaaatggaaaagtataccctttaatgctatgcaataccttgtcttaaagttcttgagaaatatccgttactctgtcccaattattcccttttttttcaactgaagaaatagctataaaataaagaaactaagagtcagctaaatcctccttcaaataaaataaataaaacacacagaagagaatctatctagttaaaaaccttcaaaggatgacgatcgtccatgtccaggccacataatcccagttttaacaattaatgcctgatcctgttttttacatcccagttaatttcctaatcttgtcagaactttcatttagttcaatagagatggaaatagatgttttaaattaagatttaagatcagattattatatcacttcacagtattcacattttaagattgattattatacatgggaagaagtgttgtttgctagccaccaacctttcttgggtggtatgactatatttcaccctgtaccaatttataaactgggtttaattatgcacgagtgtgtgcacacaattatatcttgttaagcatttttttgctaagtttttgataaacagccaatcgtggcgtgtcatcaaagcctgagaagactaaataagaagattgtttaacaggaatttaaatatattcgtgtttgaaagaatcattagaatgttttccttagtcttaatgcatttggtagttcttcagaaaatctatcgtcaacccttgtatgtagtgtttattccaaattgttgcaaatatatatattttgaagtttgtttagtgagggtcagggaatgtaatgaagtgccaaaaattccacttgacctacgtactctacagtcaacagaaaagcactccatttttgcagagctctgagttaaatgcactcctcaaagcagatcagctatcaactgggaaagcttaatgcggcacagttggactagaaggtaaatgcaaatcctatccacaaaagccagaatttttaaaggattgtgattatattaagcataaggttgcacaatggctgcacaggctgactagtctcagagtccagagtcttcattcttaatcaaactcagggtcaagttctatgcatctgctatcatagcttaagaccaggaattcggaataagctatcatctcaagatcccgtcagccagaaacctttattaatagccattttcacaaactgacattacagtgataggccctggaaggtcctctggtaccttctgaatcatcatataaatggcaaaactgtctctataaaatacaagtgtcaaatgcattttcctatagcctgcttctttggaaaggcagagaggcagagtgaagatgaagttagtgggaaggaggacctagcaagatggtttacttgctgatggatagtagctggtggttgagagccagtaaaggggttaaataataactagggaatcgttaaccttttatgaaccagaaaattgcatgatgtgctcagtgttaatgtaagagtcatctgacagcagagtataggatgaaagaggtagaaagaggagagaacccaggaggtcccaggggagttgcaattggattggagtgatggacgtcaaaaggaaagaaatggccaaaatcttgagatttttcaaaggaaaagtccacacagttttcatttgtctcccatatccagtcagccatagagatacatctgagatttcaatgataagtacttatgaaaatagtccccctgatagcattatttttaaaagcaaaatgagatattgtttagaagggtgctcttttctctgttttccaaaaacagacatgggaaagaagatgacgaggttgtagcaaactaatgaaataggatgaatccgattttggcaggtgtgtattaatcaaggcctctatatgctgctggttgggatggacagctaacatatcggaaaacccgtatatgcaatgtatctcgagaatgcagacttttcaaagtttcatacctttaaaaccagtcacatagaggtgaaaagtttatgcagataaaattgtccatggtagcactgtttgcaacagtgagcatttggagacaatgtaagtgttcagtgataggggagggttatgtagaacaggatacatcatattgccttagtaaagtgtagttcatggtttttattttctttctgcttcaacttggagaaatgctgtgttaaatgttaaataaaatcagagatacagtcttttgcatattcaaagagagcataattataaatatgggggaaaaagttgtgaatgtagaaaagactataaaaatatttactaaaatgttgatatttctttgagttgttggattgtgagagtttcgttcctgtgtttctttttaccccctaataatggtataggaggagacattgaagttaagggaacaaagaaaccaggctttggagttaggctgatctgaatgcaagtcttggctctgccacttactggatgtataaccttggccaattcattcaactctaagcttccattttgtcatctgtcaaagggagattataaaagaacttatttctgtagtgagaagtatatgaataatgcttttgaagagtcttgcatagtacttagcacctaagtattaaataaacattttacatcaatgtattttttaaatgtattatattacatgtattattattacagtattttatagtgagggtaatataattattaatgaaataaatatagcaagaattaccaaggcagtgcaggctaaattactgctaaatttcatgatttccagaaaagtctttatcccatctcaggatctttttccaaaacttgagtttccttactgtcctgactcagccagtttcccagagtcccagtgagactatttcacatgtttgacaagctacatcacacccccattctcatacccaatccccactcttttctgtctcagacaccctgtcagcctggctggcatattgtcccctggtcttagttccaactcttttcaccctccaagtgatagtttgctaatgtgatcatctagtctgccggcctttggggcaggcataaggaaattggaaataggcacaggtctctctatgcctcttatgaagagcctcctctgttagaagagtctccctaatagacttctagttcccttgctttgttgtataacttctcagagtgattttcatgatcagaatttcctgccaagacaaacagaacaccagctttatgaaagcctgataagtaagagattttgaagccagcagggccatactctgtgtcccagtcaccaatataaacactcctagaatcttatcaactacatatccacctagaatcttatcaactacatattcacctggaatcttatcaactacttatccacctaggcctggtgctgccctttggaagtactagaacttttgttgtcatgactattagtatattctagatattgctgaagtctttttccatattttcatttccatgataaaaataatacataattatggaaaatttagaaaataaataaagtctttccacagagctaaatttaactagttgaccagatttcctttgtggcatgcattttgcaagccaaaacaatctcaaatttgtgaggggggtgtaaggactcaaaagaacttttatgtacacattatgcatgcacacattactcagagaaaataaaatgtcttagaaatgggcaacttttaataatgacttaggaagtaatgttatttgttgatttttaaaaatagctttggaagaatatatttgctgcagattttacgtgcaaataaacattattgtaggagacttgcactttgtaaaataggttgaaagttaaaatcttcccttttgcattgactctaaggaagttgtccagctgttcatagaattccaaggtgaaaaaatgatatggctgaatagacaaatctcatggactaatgccaattgaatgcctcattgaaagtagaaactgttgagccccagaaactgttgagctggggctattttgtgaaagtaaaccaatatttaaagcttctctgtggtcttcatggatattaaataaaatattctacaaaagcatgtcagaggcaacttaaatgataatgacctagaaatataagggttgtatcagaaaacaatggagacaaaataattcgtccaccctgtctttaaaatgacactgtaggtatttctgatgttttggtggggagaaattagatatgcttaaagaatggacttcaaagcccacagccatcacccttctctctggtcgtcaggggccatgctggtgacgctctctgcctcccatccaggcctctgaatgctcagctctgctgtgcttttgagcacgttatgtttttctgtgctgtcttctggcactccattctttttctgtacactttggtctttcacccaaccacaatacctgatatccaaagacttgcagacatggatatttttactggaaaatgaggaacctgtgcaaattattattttcttttactctctcttttctttttttttctcttttcctgtgggacacgggttgtgagttgtttgaaataagccagaagcttcatagctcctttgcttttgtatttgaaatggcaccctgatcactttaaagagctaatgtacttcctatgggcctgaaatttctcaactggactcccatagcagaatttggcctggtagttaagaaaattaattactctgatcgcgagggtgaagcaatagttcccaactccccatagtaatcattaaaatgtcatctacttaggagacatcttggcatgggatttataaggtttgtgagctgaggactaaggttcagtgatccttccagcagtgcctcctcgttctagaggaaggctgtgggagataaggttttaagacgggagtgaaattattactttagatctttagatttaacatttgaatggtaacattcaccactgaaaaataggaaacaacaaaacctaaagttgctaccatcccatctatcattgttgtctctattgttaagtgatggccaactgtatgagggtatttccctcatgagaggtaaaatttttaagttgccccacccttctctactatgaatcttggcctttaacctaatggaaagaatttggaatcagaagacatagtctcaggccccattctcagcccttagaaactgtacaacattgagaaaatctttcaaagtctgtaaccgtcccttttgttcaggtgttaattaagtcaaataaattcatatttgtgaaaatgtttggtaactgtaaaattctacctacaaattccttcaggaagtctcaaatgagtgcctgctatattccagacctgaacaaaatcaggggttggaaaagtgtggcccacaggccacactcagcctgcctcctgtttttgtcaataaagttttattgaaacacacatctatttgtttatgttttgcctatggctgctttcatgctacaaaggcaagaggtcacaataagtcataacaaggtacacaaggccaaaaatatttaccatctgacccttcacagaaaaaaattgctgacccttcaactcaatgttaaatgcataaagaggattcctaccctcacgtatcttatcgtctcctgaggcagataaattagtaaacaattataataaacatgatgcaatatctaaaatgctaggagaattctaggcagcagctgaaatttagcttagaaaaatcaaaggatgccccccagaggacatgaaacaagctatctttaaggatgttggcttggcagacaacagacctactgtagggagagagaatactctgtacaagaacatggaagagaactgcaatgtggtaaagaaatggtgagtcctctggaaggattagagaattaggaattataaagagaataaacagtggcagattatgagcctctaacgttgtaaacaagttaaattgtgaagaataccatacagtctgataaggagcttgaaattctttctgtaggctaagcactgtcgctcactcatttaatcctagcactttcagcggttgaggagggaggatagcttgagctcaggaattccagatcagcctgggcaacatagtgagaactcatctctacaaaacattaaaaaattagccagacattgtggcatgcatctgtagtcccagctactcaagtggctgagacaggaagatcacttgagcccaggagttcggaggctacagtgacctatgattttgccaatgcactctaggcaacaaagcaagatcgtgtcaaaaaacaaaaacaaaacaaaacaaaacctgtagacattaggaaaatcactgaaggatctcaagtggagaggtaaggtaatgaaatttgtattcataaagaccacagtttttataagagtgaaggacagcttgtagaagggcaacaccagaagtagggaaaacagtagaatgctggtatagtagtccaagctagagatccccagctaagggagtgatagggagaatgggggaaagtgatggatacaagaggcattgaagcagtagatgcaacagaacatgtgcaccaagtacatgcgagaggttaggaagacgaaggattccaggatggcacccagattttgaattagctgaatggtgatatccttaacttacatttcacataggaaaaggaccaaactggaggcatgaaaaaagcagaaattttgttaacataatgtgacttgctcattgttatattctattagcaaaatccagtcaaggataagatatatatgtttggaatgcaagaaaggtgattgagatctagggacaaattttggagttgttggtttaaagatggcaatggggtaaggtcatgaatgcctccaagggaccgtgtgaacccagaagagagtcaagggtgaacccagaagagaatcaaggacagattcctagagacttctaacattgaatggatggtcagagaaagagataacagaaaaggagtctgagaatggcacgcatattgatagaaaaaacatttggcaagagcaaaggtatattttgtgatgaaaactactcattacacaaggaacacctagaataacctcagcttaacaggacactgggcagaatttataacaatgaccagttactgttcttaccttcacccttcagctttaaaaaaaaaaaaacccacaggaataagtataatctagcaggaaaaaaaatgatattctatagcatagccaggtcctgaaaatataaagaactaacctggcttcttctgctcttagagcactggctccagaagggcagaaatttgtgtcattttgattcctgctatatcccctagcaccgtgtcctacatagatactcaataatttttgttgaacaaatggaatcgcgttacttcattgaacaagatgataatctaatagccagtgagtggttccaggtaacatcaactacgtaagcctagtgtattagtccattttcatgcttctgataaagacatacccaaggctgggaagaaaaagaagtttaattggacttacagttccacgtggctgaggtggagagacctcagaatcatggcgggaggcaaaagacacttcttatatggtggcagcaagagaaaacaaagaagaagcaaaaatggaaacccctgacaaacctgtcagatcttgtgagacttattcactatcacaagaatagcacgggaatgaccagcccccatgatccaattacctcccgctgggtccctcccatagcacgtggaaattctcagagatacaattaaagttgagttttgggtaagaacacagccaaacatatcattccatccctgaccctccaaatctcatgtcctcatatatcaaaaccaatcatgccttcccaacagtcccccaaagtcttaactcattccagcattaacccaaaagtccacagtccaaattctcatctgagacaaggcacgtcacttctgcctatgagcctataaaatcaaaagcaagctaattacttcctagatacaaagagggtacaggtattgagtaaatagagccattccaagtgggagaaatcagccaaaacaaaggggttacaggcccccatgcaagtccaaaatccagtggggcagtcaaattttaaagctccaaaatgatctcctttgactccaggtctcacattcaggtcatgctgatacaagaggtgggttcccatggtcttaggcagctctgcccctgtggctttgcagggtacagcctccatcctggctgctttcataggctggcatcgagtgtctgcagcttttctagacagacagtgtaagctgttggtggatctaccattctggggtctggaggatggtggccctcttttctcatagctctactaggcagtgccccagaagggactctgtgtggggactctgaccccacatttcccttccgcaatgccctagcagaagttctccatgaggaccctgcccctgcagcaaacttttgcctaggcatccaggtgtttctatacatcttaaatctaggcagaggttcccaaacctcaattcatgacttctgtgcatccacaggctcaacaccacatagctgccaaggcttggggcttccaccctctgaagccacagcccaaactctacgttggcccctttcagccatggctggagtggctgggatgcagggtaccacatccctaggctgcacacagcacagggaccctgggcccagcccatgaaaccactgtttcctcctgggcctctgggcctgtgatgggaggggctgccatgaaggtctctgacatggcctggagacatttttcccatggtcttggggattaacattaaactccttgctacttatgcaaatttctgcagctggcttgaatttctccccagaaaatgggtttttcttttctactcattatcaggctgcaaattttctgaacttttatgctctgtttcccttctaaaacagaatgcttttacagcacctaagtcaccttttgaatgctttgctgcttaagaatttcttccaccagataccctaaatcatctctctcaagttttaaaatttcacagatctctagggcaggggcagaatgccaccagtctctttgccaaaacataacaagagtcacctttgctccagttcccaagttcctcatctccatctgagaccacctcagcctgtatcttattgttcatatcactatcagcatttttctcgaagccattcaacaagtctttaggaggttccaaactttcccacattttcctgtcttcttctgagccctccaaactgctccaacctctgcctgttacccagttccaaagtcacatccacatttttggatatcttttcagcaacgccccactctattagtaccaatttactgtatcagtccattttcaagctgctgataaagacatactcaagactgggaaaaaaaaaagaggtttaattggacttacagttccacatggctggggaggcctcagaatcatggcaggaggtaaaaggtacttcttacattgtggaggcaagagaaaatgaggaagatgcaaacacagaaacccctgataaacccatcagatcttgtgagacttattcgctatcacgagaatagcatgggaaagaccagcccctgtgattcaattacctcccactgggttcctcccacaagacatgggaattctgggagatacaactaaagttgagatttcggtaggaacacagccaaaccatatcacctggaatcttagaaacttggtattttcagactagtactaggaaatattccatcttaagggtattggtaagcaagttcttcctctcaagtttatctcccctcacctgatatttttcttttcatcctgacaaacaagcagagctcttctgattataaaaataataatacttttaatggggctgtttgtttttcttgtaaattcgtttaagtaccttatagatgctgtatattagacctttgtcagatgcagagattgcaaaaactttctcccattctgtaggttttctgttcactctgatgatagattcttttgctgtgcagaagttctttagttcaatcagatccaatttatcaatttttgcttttgttgccattgcttttggcatcttcatcatgaaatctttacccgtgcctatgttctgaatggtattgcctaaattttcttctatggtttttatagtgtggggttttacatttaagtctttaatccatcttgagtttatttttaaatatggtataaagaaggggtccagtttcaattttctgcatatggctagctagcactatttattaaatagggaatcctttcaacacacattggggcctgttggaaggttgtgggggtgtgagatggtggatgggaggaaggagagcatcaggaagaatagctaatggctgttgggcttaatacataggtgataggaagatctgtgcagcaaaccaccatggcacacgtttaactatgtaacaaaccggcacatcctgcatagttactcctgaacttaaaggctggaaaaaagagatactcttaatattaagactgcatgttaaaagggtgcaagcactacaatgaatgagttctaaaagaggctggccacaccaagggagactcagtcagggaatctgtgaccacccatcagtgatgggtggagcctattagatcaattactgcagtacatagtaaaattgccagttcttctggtttcttatctgggattagtagcagatcttgaaatacaaaaatttatttctacatcttctgtcataattctcactactaaataacttctaccacttctagctcctatcaggtcaaccccaacttccttgtctatcatttgagatccaatattgccatactaccttgaattatttagcatcagctgaagaaaaaaaaaatcaccttgacttaaaaagcttgccctctgcttttaagtgtataaagaaatttggttcccttgttttatggagcaaacttcaaagtggaagggagaaaaaaatcaagcagacctcaagtcacctgatttccagtccactaaaccacactctgctttcttgccaataccaatactcgattgtgtttccagggaagaaggaatggtaaaacaaagagtgagaaagctgagccaactgtgatagaggcacaggccaatccctcagactccttttttctaattgaacaccagatataatcccagccctttaaataaaattacctaattaatcctaattaattagtgagcccttatatttatagaaggggttttcttagtgtctgtcttctcaccctccccacttccctgcctctactacatttctttccatctaaaaagaaaagtttcatttttaggggtcctttttaaaaacaatttccatgtcaacatttattaatgcttgtgtgtgtgcatgcatgcctgcatatatacacttagagcacgtttttttagaaggcagtaatggtgctgccttttatcaccttctttctcctctttaaatggaaagcactgaacccagatgcccaaccacggaagatattcttccagaagcagcatctggcttcctggcaagcccttcaggcaagttgtttggggagcattgctgttgtctctcggtctgtcacgtgtatcagataccgtggcctctctggctggcatgtcccggtagctgccaattcctttcagttcacctttaattctgagaaactagtttcctcattttcatttcttactggacttatttttctccccactgcccataggaattccaggacaaacctaagtcctcactgctttctgcctgtcaagctcctttccagacctccgtcttttgaacccaaatgaaaacctcagccatttactcctacattaaaataggttattttaaataatatttcttagccacttcttgtcagcaaagctccttgtaaactgtggagttgttccctgaaaagaaaaacaaaacattccatccgagtcatttattctggtctgtacacaagacatgaaagtgttcttgacatttgtgtattatttagttaaatcgtattggctccctacatccttgtcacaccatgaacaaaagagcatcacggggctgggaaagacgagaccatgctgcagttagtcaaggctgtgcagcctttacacatagcacccgctccaggaaactgcatttcttaaagtggcttttttttttttttacctgttaatatatattttttaattgtgaaggatcttctggggttttttatggataattgttaagaacacagagtccgatggtagcccacgcaacaggaagccgtgacaaggtgctgacaagtccggcagcagtacccagaatgcagaggagaaagcagaaattagagctgcagggtgacatccaggaatacttaacacagggtatctgcaaattttcatgtcgttggggtttttttttctcatgcaagaaaaaagtacatattatatatgagatttcagttctcaagactgtaatgtctaggctgagaaaaggctgaagttgagcaatggacaggaggaaatctcagccataaataatattttgtctgtagctagtagcagactcaacccacacttgactttgaagcagtacataactagaaccctaggcttcacttgaatgagagtccctagggggcaaagaaaggaggttaggggctgtcttggtcaggccattgggaaaaatcttttttggaagtagctacaaaacagtagagctcaaatttaaggttagcatttttgagcctattatgtttctgcctcaatgacattttttggtctataatttttccccagctccattcattaatatgtaaaaagaaagtttaaaaatacatgccaaactcacaagttttacactacattattgcccttggtatagaggttcctgtatcttatttctggtcatttcttctcctcttctatatcctacccatattctttttaactaaactgtttcctcatacatttttccactgttctctacctttcctcccaatattcatcatcctctgcagattctttctcttgtctgtactctgaaaactcacttcacattcaaaacattgttgcctacatcatctgtccacacatttattcatgaaacaaatacaggttgagtacttactgtgtggtagatgctgagctggaaatgaagacacttttaccaggaaagcaataaagctctaggatctggaagcttcccttcccatgtctgggagtgttcacatccctcaatctcattcttaatccccattttctggctctatatccttccacttctaacaggaatttgtaaaccagcctatttttaacaggcattaagtcagtccttccattggactaagtaaaccccttctcttctttctcatttcaaagagacaacaagtagaacacgttgggacagaaccgctgtaaggggtgggcaagacataggttggttctctggcactgaaaacacctcttttcctgctctccatgaactgatggtcaatagacgcctcttcatagtcttccctatatcaattttgtacattcatttctttacttcatttattgattttcatttacctcccatagagtttgtgatacgaaaagataaagaaatcactccaaatgaacttttgtctaattaatctgtgtatatgttgttgggcattaaaacagattaaatttgcttacatagtgaaaaggcatgtaaagtgatatgttatctaaatcagaatttttttccatctggacacttcatagcaatcatttcacatctcagaaagattccattctcaaacacatctcttctttgataacagcacaactctgcccttgcaactctgccctcttggcttcctgctcacccatcttttccacttttctttcatttccaactgccattccagagccacgtacttcccctggtgctaacttttaagtcaacagaagggaattccattctctctcctggtgccacatttcctatttagggccagatattccccacagagatattgaggcattttactgctagtttacatgtcctactatatttttctaactagtgggaaaaaagaaataaatgtacgccctgccctctctgacctcatcttcctttcatatcacatttaaaataaccaattcctggagtggcaagctcttaaagcaattcatacttccctggcaatcacagaaatgtacccttcatcttggcagaggaaggcctatttcttccacctgttgtcacattctttttattctctgcatgggtttcccacacatacaccctataataagttagataaggttagaagcaggtggctacatagagaatcaaaagaaatgttcattgtcatgtacgagaaatttctgatcccaaagcacttttttttccaagaaatggtaatatatagaaaattggcctgcagttagttgtatgtaggattgtggatactggggagagtgggggcggggaagatgatgaccagagagagcgttttgttcgtcatgaatgcagctacctgaaaaacactagctaattagcagtctgtagccacacaacacagcagtttagtataagaagtgaacaatactttacctaattgaaactacagagcagacttaggtaggctgaatgtaattacacagattggaagtcagccaggacgccgaggttaacaatcccttcactcacaaaaagcaccacgggaactttaatgaccacaagtggtaagggccgctatcctgcagcccagcgaaaggcctcacctctcgcaaccgagactccatcagaagagcctaatggcgtcaactaattgctagaaaaaaagactgccctctatcgacgcagatgcacctgtgccgtgtgactcattcaccaagcacagtaaacacttttaagtactagggcgaagggggattcgaatgaatgagggcatcgagggggtcaagtggtggacaataggaactgtgaagtctcctctgcctgccggtcctgtggccagcacttctgctgcactagcttccctaaaagaggcacacgacttcccaaacttcagtgtgctcacaaaccaaattacctagcaatcttgttaaaaaatgcagattctgggtcgggcacggtggctcacgcctgtaatcccagcacttttggaggccgaggcgggcggatcacaaggtcaggagatcaagaccatcctggctaacacggtgaaaccccatctctactaaacatacaaaaaattagccaggcgtggtggcgggcgcctgtagtcccagctactcgggaggctgaggcagaatggtgtgaacctgggaggtggagcttgcagtgagccgagagccactgcgctccagcctgggcgacagagcaagactccgtctcaaaaaaaaaaaaaaaaaaatgcagattctgattcaagaagtctgggatgaggcctgagattctgtacagagaacaagctcccaggtgccactgctgctgctggtctgcagaccacactttcagaacaggatctaaagacaagaaacaggaggaggaaagaggttctctgtggccaagaaatcaaagtctgggctaaaagaaagaggactttaacatggggtttgacacccagaattatcaggtttgcatcatttgtcctaggaactaaatgaagcagaaacatggagtgtccaaaataataatccaatccaaaacccactctcagaatggctttttccatggggagaagaaaaggtaaagaacatggtctctgaatgtgctttataaatgaggtgcctactctgcaaagtgtccagctgtagtgctgtggcagggggatatcagcagtggtctgtcaggacctgcaagagccaaaagtgtctgactctcaagatgaatcaagagaagacaagatggcagaatgcaaattgtcaaagcttaacctatgaacaaggatgggagtaataattttccttcaaatgtttgcaaaataaaatcaaagttgctgaaaaacgtggacctttttaaactttttttttttttggaaacggagtcttgctctgtcgcctaggctggagtgcagtggcgggatcttggctcactgcaagctccgcctcccgggttcaagcaattctcctgcctcagcctcctgagtagctggaactacaggcgcccaccactgcgcccagctaattttttgtattttagtagagacagggtttcactgtattgcgcaggctgttctcgaactcctgaactcaggcaatccaccggcctcggcctcggcctcccaaagtgctgggattacaggcttaaacttatgttatgcaaacatggtttactgctgtgctacctagacttccataataaagcctcagtatagcattaaaaacttaattgttggttagattaatttgtattctttagttatttcctcaatgctttttatactaatttctatgtattttgtgacttcttaatgacagaattcactttagatacttgaaaagaaacacacacacacacacactcacacacacacacacggcaagacccaattaatcactggttggtgcagtatggttttctacgtttagacatgctgcaaacatgttgtaaactagataaggctggagtttaaatatacatttatcctaatatatacctcatcagtatagctgtaaaaaatgccgttacttgccaacaatatataaatttaggatatccttcaaaatttatcatttgaagtgttcagctacctgaagctggcagggcaaagtacatatacaagcagaagcacataagcaccaatgaatgaagcatgcctatggagtgcctgctctgtgttccatactatacgcaggaaagtggagaagataaaagtgtgcaatcggaagtctaaggttttgcctttgcagtgctactaatgtaacaggaagggaacaaaacacttaagaaaaaacagaacagagactaattaactgttaaacagtatgtgcagcctgtaattcaaatgagaaatgggctgaaagagttgagaagtctccagtgaaaggtggagctggtgagatttggatgttccatggagtggctggagaaaaaccaagagggaaccaggatataggtgtgagcagcctgtcctgtggccagaggcaaaggagaaggagagacctgagtgcagggtggggccaggttatgggtggggctggcagaaacttttcttggaatctgacatctcaggctataggaaaccaaggcaggttactgagcagttgaaaaatttctgcttttgtatttaagtacagtcacacaccacataatgacacatccatcaataatggaccttacatatgatggtggtcccatgagattatgacactgaatttttgctgtatcttttctatatttcaatacacaaataccactgtgttaaaactgcctgcagtatttagtacagtaacatgctgtgcaggtttatagcctaggagcactagcctaggtatgtagtaggctataccatctaggcttgtgtaagtacaccctataatgttcacataactgtgaaattgcctgatgatgcatttatcagaatgtatccccctcgttaagtgacacactgccatctcaaacaacctatccattggtcctatgtgaaatggacttagggatggaggggctgaaggaggaggctggggctgaaggaggatgctggagcaaagccggaaagccaacagttctcttaacgtgactacggagcaattgttttggtgttggctgtggagctcattgggaagagaggaattcctagggcagctttgaagtaggtcaggagtattcgctggtatttttgatatgaatctccacaaaggactggaaagagtcccagacagtgccacagggtgcaatctatagattaaagagagtggtggtgccactgataaaaccaggtcatctgtgtactcttactgagcacctactgtatgccaggcactgttctaggagcttatcacacatcggtcaacttaacaaaaaccatccttgccctcatgcaggttaaaagggggagtcagttacagccttttgcgtaggaatgacatgaactgacttccgttttaaaggatcactgtgttgatagtacattctaggtgaacaagagtagacacagagaaaaactgtaaattatccagttgccaatttaattagaaagcagtatttgtgggtggacagtgctgtgtgcatctgcctctgataggttaagagaatctaaagaactgggctccagccccagcttcagtatgaggttccacagtgacttcaggcacgtcacttcacgtctcagccactgttttatcaccttatcatagaaataatacctaatttatccaccttcatgtgtgtgtgtgtgtgtgtgtgtatgtgtgtgatctaatgacataaagaaagtaaaatccaagagtacatactgttgcttcaagtttgccacaattggaaacccaagcagagaaattcgatcttacattaaatccagtagctggagtggagaggtcactggattcagaagcagaaaacccaagtttgcatcctaggtttatgactctaaccgtgtcaccttggataacagcttctctgagtgtcagtttcctcttcagttacaatacctaatacctcaaaggacttttagaaaattcagagttacatgtgaatgaaagcccactataaactctaaatcatcgaagagacaaagttgtttcttaccgccctgtcaggctctgactgcaaccatagagagctgtactactacccctggtgtaaaattgtaattaatccttcctcatatgtgggttaactttaatccttcagggcaggaatcattttttcctggaccttgtagtgttccattgaactggtagagagtcaagcaataggaggtatttaacaaatcattttagcaagtgggtaagtggaggtgtgatattaaaggaggaaatgtaggtttgggaattaggtttttagaggaatatttcaaaccatgaaagtgcgtgcatttaccaagcatgttcagagcccctgaaaaaaggatggagttaaacacaactttcggacaagcatagtaagaataactagccagcaaaggaaaaaaatgtagaaaataaaattcacaacgatcagcattataagagtctgaagagcatcatcaaatagtaatacacaacttctgctccaaaaggatcaaaaaacatttcaattcgctatttcacagaaatttcaatcagaaatgtctaataacctccacccacttatctaataaccacactctagcacagagataactcaagttcctcaggagagcttcaagattcagaagttctttctgaattaccaaaggataacaatgtggtgtccattgtaattttaatactaattttgttgttcgattattgttaatccacatatgataagtgtttttgaccagagcatttgcttaatcagaaccttctatactccatctaagtaaaagaagttttattgggaatgaaagaaaattgcacataaaaccttttttcatagcctgtttcttaaggacacagcagtcaatcttgtgacatacctagccaataatctccactgcctctccgaagcccacttctttgtgtctttttaactgacattttggaattcacctgaaaacaccaagaatttgccaagacaaatttggcctgtggagaagacaccatattcaacaccaatctggagaaaacaacgtactctgctcttttaattcattatgattttaacatttattatcacatcattatcacaatttgaggattataacttgttctcagaaaactggcccctaggcaataaagagttaagaccagaaagttcactccctgtgcccttccttttttcttatcacaacccctccttccctgtggttccacaaaatgaataatgccttagacatagttatggcaatgctaatatttgaacagtaaaagataccttaagaccttcctcaagattttttaaggactcatttaatgtcagtgtcaaggttctgtgaggaataattaatataacaaaacaaggtctatgtgcccatcgattgccagggaatttatgcaggtaactcattaatgccggtgggggttcagcatgtaaatcccgaagcctcgatgaggaaatgggaccaaatgatttttccccctataaaaaacacaaacaatgacaagtataaaagcagataacctgaatatctatacaaacagctatatggcttgtaaaagttttccatttacatcctgtcacctcttctttgtgcatgtataaaagatgggacaattatttcaacaaacctacccatataaatcaatgcagttttgctgtgggaagactgggtgtttaaggcatttaatatttcagcattgccagattatcaccaggatccatttcgcattgtggtcaagtgcatgattagcactgtgacagggtattggccattttcatatgaagatctgcaaatcctagtaaacaaataccagttggaaaaattaagaacaagtctgtggactggaatgcaccctacttgtaatgggaacaaaaagctggcaatcaattttaaagaaaaagctaaatcacagcagaatgacctactttaaggcatttgccaaagaggcagtgtttttagacagctcttctaaagtagcgtctttctgtctatgccatctgcagatttattactctgcctgaaaaaaacaaccaaaaaaaaaagaaaaaaaaaagctttatttgaatgatactgagagcctggtctataggaaagattccagtattgtgggtaccacacccacacctactgatgtggtccaaggttttgctttagaggcacctaattaagaaaccctgactcatttacatggagacgtttgatctaaattacactccaaaccacaccaaattgggagcatctgtgaatgtgaaatgtttgttccctgtgacggctagaacagggccagctctggacggcacatgttcaagtgacgaaaaatatttcacatgtaacgtacttctgagacccacttttccactaataattcatagtgaacctaaccaagtatctgtacctccacaattatttcaggctgtgaaaaattatgtcactatttttttcctgctgcaagaaagaagtagaagaccacctactttgtttgctgtcattgataaagggccttaactgcagccaatagcaaaaggcaaacctggatagcacaaaggctggtcactatatagatatataaatctcagcttgggatccacagacacagagcagtgatctaaagggctaagtctcagttaccccctccatcactgccctaacctcttccagcctttccactcggcttgctggttctcagcaaagctttgccttccaactccactgaggctgtacttgtatgcaaaagagccagcccttaggatgaggtgagaatattgatagggtagaggtagcatcaactgcaattagaggacatgtcatttccactgggtaaaatgtctaagaaagtaaaaagaaaacatttctgccattggatgtgatgaacagtactcagcctacagttcacacgaaagagtgttgtatttcaagtataataaacagagttttatagatacagtcaatcctgcactttggtacctgatggccgctttaccttattcggccatatatcacctatatttcagtgggagtccaaggaaaaagaaagaaacttttaaaaaaataacctcaggttcttttgtttaagaaagatattaatgcatttatctgatgtactgttttttgcagtagctagaatgagatttgaatatattaatattttcagcagcagagcccagggactccagttaataacttatggatggctacatagatatactttagacagaggtaaggttttcagctctcatgttggtaaggctcagacagatcgaatgaacggggctgttctccatgagtctttgttgtgggcatgcattgtaatggtatggagacagagttcttctggttgtctacacagcctggattcaataaactgttatatatgcatattatgacaatgtggtcaaggaaaccagattttttttactctaccttcaaatgcctatggagcctaaatctggtgcttatttttcttgtcctcattcaatatgttaacatattcataatttgacacaggttacgtttgttttataattaaagttatggagttagctggaaaagcattcagactatactgaattttttaaaaatgtgtatcttttttctatattatactgcagtgttcaatgtgaatctgaagtctggataatcccagactgtgttagtttgctagggcagccataacacaatacgacacaccaggcggcttaaaaagcagccatttatgttctcacacttctggaggctggaagtccaaggtcaagatatcagcaggtttgttttattctgaggtctctccccttggcttgcacatggccaccttcttgctgttttacccttcacgtggttttacttttgtgctttttttccctggtgtctctctgcgagtctaaatttcctctttctataaggacatcagtcaaattggattaaaatccaccctaatggccttatttttaacttaatgacctttttaaaggcccagtctccaaatgcagtcacattctgagctaacggtagctggtgccttatcatataaattggggtggggttaggtgggataactcagcccatatcacacacaaagggtatattcacatccaagctgttgacatgccccgtaccaatgatgtatttatttgagccccaaactaaaacctaaattaatatttgtaagtctggagtattcttctagtatgatttttcagtcacatcctctatgggaatgaaacaatgatgactttgtaaggtttaggggaacaagcagcagcatgactcttctcataccttcttgctagactggaaggaagcagttcctgtgtacagtaagtgttaccacagtgcccgaccgagccccaccccgccttcagggaccccggtctagaggcataagtgcctccctctccattactgccgccctccattaggagcagataatgcgtgagctaccactctcacaataaaacattgcacttacaccacacctttcaactcagcatttccaaatgcttgaaaaatcattattatttttattatttatttgtggaatcccagcagtctactcagcactgggaagtgcagtgaaagccacagagctatggtctcagttacgcagacttaaaccgacactcaagtttcctccgcgatgtaccagtaaaaagtctgaaggtggacgtttttgcatgtgcatgcatagcaagaaaaaaagtgaaaaggcaatttaggtctgagttacccctgcggctcacatacctgagaaaagagccatttgttagtattgttctgataaatgaaggacccaagcaagaacaaagcaagaaagcaaacacagttttagaccctacagctcagaaaatggaaatgcatttccctaatcaagggcatctacaataacacttttaaaaggattattaagcaatgcaggaagtagaaatcaatcaggctctgcttgttgttcactggtcattatttcctgggtcaaatctgcttgacattcaatttaatacagtctttcatcaagtcaaaaggccttagagagaaactttcactggccacccacattttcagcagggctgttgcctggtccgattcacttttgttttccaagtctttaccatcattgcatattacgcctacttctattgaaacagctactgcttttgatgatttccacagtggtgaacatatattgttcatccctgtaatgctagaagctggtccagtgcttggcatgtagtaggtgctcaataaatatgagatctgtgaaaaacaaattttcaccttacaaaggcattctcaaaatgaatttgacacatcctgctctctctacaaagttacaagctaagatagatcacagcaaagcagagatattgcagacacagattgaaaaccaagtgaaataatgatttagattgccttaaatcaaagtgactaaatgcatttttagaaagtacatgttgaaagttatcttgactagtcttccatttagccaggaagttttctggaagaagtataagtttagggattttttgtgaggtgagagggagaaatcataaataagtatgtgttctagaaagtggggtaagaccacagaggagtcctaaaggtattaatagaggtcaggaattggactttagaaaaacagaagaggcaaggaattgagaacagaggaaaatcagattacttggagtgttctaatgaatggctttcaaagaagataaagaccaccatatatagaaagctactttgaagatataaaagggtttgttagtaacatgactgggcatatactagagtagaaattccaaaataagagctgccacaacgcagccaaagtgagaagatatttctctggtcacctgtgcttggtgccagccaccatcctctactgttcttcattgtccctagagctggaggcttagaaaggcctagacacacactgtaatcgtatgtctctttcagtttgctggagagtgactcacaaaagggtgtttcccgtgctgacacaaaagtatgcaatatttctttgtctttcaaactggtaattcataaagactgtatactattccgtattggacaatgttgaggcttaaatatcctaagccccttataagaaggatgctgcaaacatgagaataaggggtgtcttctgaaaatgagtgaactaagccacttaggaagttgctggcctcatctcgaaacccaccaaataacagcagtacagctagaaatagagttcaaaagtcaaaagtgcctggctgccctaaaattttctcattgcatgacttggttcaaggggcttcattatattttgtatttagatttcacacgtttatattccacagtgcagtgtctctttaaaaatgtaactgttgagtctaaaaatcaggaagtagtaaagtggcttccagatacatatagaaggtttttgtttgggtggtgtgtgggaaggggttggttttgtttttaattttgtgcaatttcagtccagtcaacacctagagcactcctttaaaaaaaaaaaaaaaaaaaaaaaaaagggaaaaaggctttttttttttttttttgattcagtgtgcacagaatttattgcagacatctgggagtttaaccagagacatccaagaggccagtagaagtggagcagcaatagagagtaatagttgacttttatcctcatttttaagagggaaatggtctattggttttagaggtgaaacgctagaaaggaaactgctcaatcctctcatttcaaagatgagcaaacttgggactttcccaagtcatctagccactttgcatgttctataacccaaatttactttaaattgtggaaagaaaatggaaataaactaccttgaaggcatttgagctccaactgactaattattctaggtcgttaaatacagttagagttgttagattttctggtttccaatgggggtaattccatcacagagattccttttctatcaaattgttggtgcttcattttcttagctctgcctggtggtctctattacctccatataagaaggcttttcttttccaccaaatgaatgaattttctcatcaattccagtcatgcctcatacatctccctctctaggactttctccacactcgtccctccagttcaggttcctctgtgcgctctctgcctatcccagattctaccacttcttcagaggacctggctcaatatcctgctcttttagatctgctattcagagatctggtcctaactgcagagacttttccatactttgaattcatagcctttcttatgaatagctgtaaaggtgaatttgatgcttgcatatagcatagtgaatttagggcaaaggctatgcttattattttttgattcttgcagaatagcacgaatagacacaacttattgaatactaaccatatgtcccatatcttgctgaaaaattttaaatacatgttctcaattcaacaaccatgtaaagtcattattatcctcaatttatggaagcaaaatctagcatccagagagaaggtgttattttcctagatcaaccaactaaaagtgatggggtcagtatttaaaatgcaagtatgtctgaatccagagcccctgtggccagcttctatgcaaaattgccttccttctcagagttacttgcacataaaaatcactaaatatttgtgaattagacagatgaatgaatgaatgatttggaacctgttcctttcaccaatttgacttgcaaaagggaaaataataagaaattctgaatcttgttgcctctggacagatgtggtcagttagcacaagcaaagcagaaatgttctcacaagttaacagtaaaaatcactggacacctacatggaggtaaaatgactcacagggaatgaagcaagcctggaataaaatttggcccaaatccaacaagcatttggaacctcatagcatgcatttggaatactaccttcatcccttattttttcttcacctttattgtcttagtcattttaagtatattttaacttttttatattgaatgcatttttaaaatgcagtatattctttgtggaagtattaatcaggttaatatgaaataaaataagattgatgctcatatttacaaagtaagttcagaaacgtttactgacagggtagaagtaggtagctcacaacctcacatttaattttagccaagcatagaactataactgtgaagctgtatttcagggaagatctaaaatgtatggatttccaggaggtgtttaaataatacaggttgtcagtattaaaatcagaagtgtttaaaggccaatggaaaacatatgagattttcatagaattaaaaaaaaaaactcactaaacagtacacatagctcctggtttgaaaatgattttatctttaaataccccataaggtttgcaaactttaaaaaacagagatgagggttgactaaaagacatggttttcttgaagtttcttggtaaagtaatatcaagataataaggaaaccctccttccccatttttgtttttgggttttttttttttttttttttgagcacaccagatggcatttctctctgttgccatcactgacacacaattatgttttctaatagagagggaggctgggagccactgatctaccccagtcatgtcacatgaatatctccactttcataaagaaagtctttgtccaggatttctccagtggtggtaaaggagcagtaatgttgaggcaactctcagttcatgggaacaaacttaggtcaatggatgagccatggtcaggaggtcagttgggagaagagaaagagtacttattatcaaatcgtcattgtgccctctgctccatcagcgagcatcattgtctaagacaagttctcaaggacctctgaagaatctgagttgagccctttctaggaatgctgaaaaggatggagatctgattcattttaacggcaggcatgtgtgtgaccaaataaatcagatccctgaagagtctttttccagatgcatatgtagcatttgtacttcatctgagcccattttggagagtgaaggcccttcaaaagtaaaataatctgtgtggattgaggatttggtacccaagaacccagacttcaattcccagttacatccatcaactgtgccttcagttactgatttcatctctaagctagaaaaataaaaactgtcccaacttcgtttttcagaaaatacagtagcaagtttaacaaacttatttcccaactcgtgttgtaagacaagctaccatacattttcagtcagaagctataatttattcagagattaaaagaattcatttgcatttcttcatttgcttagtctatgagattatgaggaatttttctctgtttcaggacattgacccctacctaataagataaaaaagtgtgtgttttggggaggacttgggggaatatgtacaatacctaagatggaatttctagagtctttaaaatctttaagtccataatctataatatctacaaaattttcttaaaaaattatttaagaaatttcttatctacattttttactgaaaaactacttctgcaaaaaatttgttttaagaaatttctcttttatctaaatttgttttataaaaatcttaactataaccctgcccccattcatgttaatatttgatcttgatctttttgtgaagcatccagtctagtctagcaggtgagggccttccctaccttggtttagatgtgcatgaatgctaagttctcccttcgaacagtcacggtccttttctcatcagagatagccaggggcagcagcaaagggtgaatgagatccatcatgaaatgtccagtgtcaatgtgctctcccaatttacttactgaccttcagcttgcagccacactcctgaccctcatgagatggagcctaagggggaaatggcactgaggaccaattcctgtgtcctgttggtctgtggtctcaattaagtgctaattaattaccactggcatctttggcatcgcttgtcaaattgcatttaggagtatattttcactgtttaaacatcagtagtccaaaacccacgctaaaaatcccatgttctcataaatccccctttgttccctcgtaaaaaattgtgttttaaaaattcaacaaatacatctatagccactgcaggtagctttcaaatacaagaaacaggaattggtattgtcgattttgattaattgtacttcattaataaacatcctgttattctgtctccacctgcagttgctgatgttgcctggaatcaattaactcatataatttgatttattttacaaagacattttgggatgtgctgcgctgatgataaaggtcctattttagcagttcttgattgcaagttagattgtacctgaatggatttctgtttctacatggatatgtatacatgagtgtgtgatttgcaagtgagtaggaagaaaatactccttgaagaagtcttgaattaaagaattcattttaaacatggtggggggtattcctcctgaatattctgactttatctgaagactcctaagaaatacagatcctgaaatgtcgtgtcctctctcttaatcaagaccttttatttagcagattagcaaatattccttcaaattaaaaaacgaaatagtagtactaagcaccaaagttaaaacacccactagaactatgattttagagacagatattcgattcagcttcatgtataatttactttgctttgttttaaacgtaatttctttttctctcctaaatatttataagccatggtttctggatcaatctatttgataccattatttactatgtgaaaacctatcttaggcttccataggtatctaagaaatgctaagtttagtgcaagtgacaaaagcccaactcaaacagtttagacaaaaaagagaatttgctggatcacataactgaaaattccacaatcagacgtgactttgggcgtgactagattcaattgccaaagggtattgcatagaatttgtttctttccatttctaaactctgcttgcctctgggttagctttgacttaaaaatctttctccctggtagcaagatggcaacaccagaattgtatcgtatcagcttagcgtactcaggggcaagtaagcttctctctcactgtgtgaaaagaaaattctcaaaaaattattcttcttgtcctggattgagccccttattatttgttcgttcctgatccattctctatggcagaggactgcatggctctcattagtcaggcttgagacacaggcccactcaaccacacagactagaagtgagggagaagcagttttccccaaagatggtcttagcaagaagaagaagaatgactagaagtcaaaaaaaaatccacttatccacagtagtaaagtataactacaatattttttgtccaacaaaactatcctgtctctgcaacaatatttcaatcaatagacataaatgaaggctaactcacattaaggagcgctggtgcctataattagaaaaggttgcctatccctcattctcatttgctactactaaattgacaaggcttatgaagaatatcaaagtactatccatccatctgtgcatttcttcatccatgtaacactcatgagcacatgtgatgagacaggcactaaactgggcactgggactacaagaataagtaagccaggtccttaacctatatgtgtcaggcgcagtggctcacgtctgtaatcctagcactttgggaggccgaggtgggtatcaccggaggtcaggagtggatcacctgaggtcaggagttcgagaccagcctgaccaacatggtgaaaccttgtctctactaaatacaaaaaattagccgggcatggtggtgcatgctataacctcagctactcaggaggctgaggcaggagattcatttgaacccaggaggtggaggttgcagtgagcccagattgtaccactgcactccagcctgggcaacaagagcgaaactctgtcaaaaaaaaaaaaaagcaaaaaaacaaacaacacacctatatgtggagacagtagagtacagtgataggagataaggctttggaattaaatagagtagggttccaatcccagctcttttacttacacaaagtgtagagtgtatagttatagacaaagtgtagaatgtagacaaatttctcatttcttctaagcttcagttttcatatctacaaattattataagaattaagtgggtaatatatattaggtgtccagcatagagccaagcacataagttttcaaaaattaacagttactactctgtatatcaaatgagataatgcaagcaaattgctttacacaatgcctggcacacagtaagccctcaggaaatgatagctggaagctattgtcatatgaaatagaatgaaggactagatctaaaagaaagcaacatttcaaaacccaaccaacatctatcatgataaatttggaaaaggccttgagagttcacccagatctatccctaccctcagagaaaacactttagtaattttagacataatagaatatttttctctccaaagaaagtgtttgcaaagcaactctcttccttttgtgctcatatttcatcagtttacataatatttaattaaattacataattacaataataagtacaactggcataaacttgtttgggactctctcctgggactttcctctagtgggaacagatgagcgcagttgagagtcattaactagccgggaacattgaatatgttgtgggcattggtcaatatgttttacggaggagatagagagctgattaagtgggagtcagccaagagagtttctactgcattgcagcagtctcctgcattctcttcatttacatgaatgctcctggttcttaaaactttgtctcacatttgacctatttatgcattttctaaacatccttcagtagctgatatgcagaaagctttattactagaattgtaaacatgccttatagaattgttttgttattctatagtcataaccatgtattgggcagagaaagcaatgtaaactgaaaatgtagaacatgaggatgaatgctgggcactgccctttgtacatttcttctgccagtcataaacaataggttttaaattcattcctaagaagaaaatgatagaaacatgtctcgcacgtgaaaatgatactatcaattgagtagaaccaaaaagattcgaacatgcttatttaatgtcctctggctttctgactggccaaatgcatgaacataaggaaccattcttcccatccctaatggtaatctcatgaaaacttttgaaacctatttattttatttatttatttatttatttatttatttatttatttattttttgagatggagttttcactcttgttgcccaggctggagtgcaatggcacgatctcggctcactgcaagctccgcctcctgggttcaagtgattctcctgcctcagccttctgagtagctggaattacaggcatgcgccaccacacccggctaaatttttgtatttttaatagagccggggtttcaccatgccggtcaggttggtctcaaactcctgacctcaggtgatctgcccatctcagcctcccaaagttgaaacctgttcgtttactgcattgcaatcctcagaatcagagcaccacaaacctgagaagcatcggcagcatatatatattttttaacttgggctttggtgggggattcatgatgccattttcagttttaaataatattcactagcagatgaaatctattgaagttcttatttataaggtacttctgctgagacaagccttagaaacagctcaatctgtgcctcaggaagttaaatttttttttatcagagtagcaaataagctatcatatagaactggtcaaatccagaaggaatatgcctttcactagtagtctgtggagtcatttagcgttcttacgaataaaggcacatttcaatcctcaactgtggatttgaacatttggatttttcccaagtaatcactggccatcccagcagataccaatattgtataggttggttgactggttaaagcagacttgagccagatcaattcctttgacttgaacaacttccgggcctctcttcgaacatcatggagactaactgatcatcattatttatgtgagataggttctctgtagtcacgataatgtcaagcatttttggtgttaataacaatttaaagtttaataattacttttggtgagaaaaagatttgtgagcaaaagcatcatttttacttgtttctatttcttttcttaatccatgaattgactgagctctaaaatccgcaaatcacatgctttgctttgtaaagaacttacattcaccagcaattacacagactgatatgtccttaacgccaggttaaatgtccttaacgccaacaaaagacactctggttggtcccattccttggttcaagcctccgcccatgattcaaacagccgtaacgaaaacaaggtcaggtgtcctcaattgggagaaaaaggaatattctggtgaatgatcatggatcattttgaatgaagatcactggaaagagaggctagaaccaggttatcaaaggaataatgtgtcctattatggagctgagattttaccttatggacaatagaaccagctgctggtttttaagcagagaagactgacccagtgatgaggctaagagagcccatctgcatgcacactccatcttggaaggctctgtgacctgtgcttaggggcaaacagtgatcgcaggtgaagtatacttggaagaccagaaaaagacagcagccttagaagaagatgatagcaaaaacaacaagagggaatcaagctccctagcaatcctgctggggttcaaagctagattctggtcctcatgggaaatgaaaagtaaaaccgagaatcaatatcacaagcagaaaggccatttgggaaaactggccacatacagctcagtcctgctgcatcctgaaatcacaatcctgtgagctggcaaggtccataggctcttataagaaacttgagtgcagctgaagcaggcaagaaatagcgcccagagtccttgggaattttgcatcatcattccacttaaaattaaaatttgctcaaagctccaactcttctaaaattagaaccccagtatctttcaggttatcagaaagggttgatattttcttgaggtatttctggtctgatttcctgctacccttgaacccacaactcactcatgccttcccattggccaatgttctcttatcttgacaattccttttcattgttttccaaggctcactctaggccatagcattcagctgacttttactgaagattgacagaggatagagagatcacatcacacccagcctagctgataatttaaaatgcaaactatgtaaacttaaataataggtgcccctgttactaaaatgcaccttgatcattctccccacacccccaactaaggaattttcatagattgtcatttccatttggtctccaacttcccaccgtgtcattctgccccaacactctactttcataatctctctttttgcacacagctctcataagtccatttttgtgttttatgcagagaatttggttctctttttttctagctgtgtttgagagattatgtttccacaaccaaaatggtccatcaaaatgttttgctaagcaaaacagaaaaaaaaaatgattttctccactaggaggaattttgctgtcagatattaaaatagcattttccctcatatacatgaatctacaagatgagcgtaattatatctcttattagcttaggcaaggattgatagatctaaaccaatctgcagagaatctactgggctatatgtatatgtcctgaccgttgtggctaccactgtctgtctgcatattaggaacaacagatacatcagaatctacctcttgactttctgtgacaggtagaaatgtagtgtctccagcaaggcaattcccttgagccattacacatgcaaaatatttcctcaattgaaaaatgctactggaaattttcacagagaactctaggaaagaaattcctgaaattgcagtgtaaaaactcataaaagagctctgcaataagaagcaatattctcaccaggctgttgatactgtttgagaaatttacatcaaaacagcgtcagcggtggtgctaacaagcgcagtgtcaacgagatccgccaggtctgtcagttgatgtagtcccaggtacagcaggggcagtttgctgtcttattgtagaataaatgtgggccccaaaactgtcagtagcacagagctatttagtgccttaaaagacaatgaaattctctcaggaaatgagaaacacaggatctactcagcttccagtttgagggccatatttatgtgtttcagcatggatttacactgccttttgttttgcaaatgctaataccatcccatccatttttttccagaaatattgaagctgtggttaattgaaaaaaaaagaaaaagaaaggcgaggatttagcagctatattcaatgtactgtattgctataaaactacttcacatcctgtcactcatctccctcctccattcttgtcccacccaaaatcactgaaccaaacaatgacaaaaatataaaaggaccaaagcaactcacccgcattgcccagtagtggtcccttggcaaacacggtgaaaacatcactttggcagatgacagacacttgggccttggctagggcattagtgaacaatgttattaaggactaattagatggcttttgttgaaatatttccaaagaaatgagcaaaataaagctgacctaaagaaaatattttaaaacctcccactgagcatgctcagagaaagcattttgacttcttttatttttaaaatgctcaaccattttcttcaaaaacttggcttgatcttcctgattcagtgataactgaagtcatgccaactttgatgtttttagcttcagctgttttagagctatatgtgatccccccaaaaaggttggaatgaattttttttctgagtgaagaaggaagcatatgttttaaccctcatgtgccttttttgaaaaggatgaattaacatcctataatattttatctttgagcttaaaataaaagagtttagtttgaaagtcaaagagacatttttcagaaattgaaatggagacttgggccttcaagaattaagactatgaattgtatctgctttaccgaatacatttggagacttgcatgtctgctgctattgttttaaaatggcagcagagaccaggcagcctggagacttgagcaagatggaccacacacaaaccaaatttcaggacatcaaaaggacataaaactaatatgcagaaatgccggagcatcttgaatacattttttttccaaccagatatatgacatgaagaatgagaaataaaaatgaactcagaaagctttaatccacctgatgatcttattttcccttctaagttatagaaaaaggaagggaagaaaaaacaataagcagctagaaactgattggtaccaaatataattgatcccattaaagaaggagctacatagaggagacagttatcagttatcaggaagatttctgagagccaggtctatattcttttttattattgaccatgcccatgatttgtcagatttcccctgggaccaactggtctttggatctccttaggacacaccagaggcaataaaaaaaggaaatcacactaattatagcagatctgatcacaagctaggaaggtagacaacaattctagtcatgcacagagctatgtcaaatggctccatggttggtgcaaacctgaaatgagaagtggcttctgacttagggtgagacatttcccacgtgactgcagatggaaacacaggatatccgtgcttccagatcagacataggtcatttttgtggaagaccgtgcaacgccaagtctagaagtctaataatatcaagttaaatttcttcaagtcagaactcctactacattctggtacgtacccaaaacactggaaaaccaacaaaaggaaagaatcggtaaagaaatgacaaatgtctccctcttatgtcagaagaaatttgggcagaaaaattgaaaccagaatgaaagaaaggtttaaaaggaaattgagtctgtgtttacaaaacgattccaatctgaggtgaactgtccaactcaaccagttgctttggagaaacatgattaaagtgatgactgaggtgttttgcgtgctagcctcagtttcctttattcccctcacagtccagtgacagccaatcagaaaagaacctggcccggaggcttgtcagtgataataattgaaaacatctgtccatgcagcaagtgtgggaagcccatgcagctccctgacagagcgagttctcacacagcaaagccataaccacgactgctcatattctccttcacagacttttctcactgccagctgtctttattctcctgccaggaaagcaaggggcctggggctccaacccaggctggggttaagtgagctgggaccaggggaagaaaggggacaggctggctcccagctctgggtctagagacaagggatatctgattgggaactaaagagagcggcgactgaggaaaaagaatagcaaacagagaaaccaaacaaactgaagaggacagataggcagcgggataagaagcgttcagattctaaactcaggtgagccgggtttaaaccttggcacagcattttcactatgtcactgggcaacctccctgagcctcaggtttttcgtctctaaaatgggaataatagtacctgtctcacaatgttttcatgaaaaataagataatgcacttcagtagaacaaggcaaggactgaatacacattagctcctttagaagggggcttcccagacagtcattaaggtgtagaggtagaagacctctactgaggggcatgctacttcggtcatgtgtagggaaggccctactgatggtgttctattgacttggacagtctccatgtggttcccgcagatgttctttccctgcctgtggcctgtgttaagctgctttatcaacctgtgcctcttagtttcttgcgatctctgtactgactcctgtggcctctctctgccatgaaagccatgttcggggacagcactaggttgtacctggtctgtcttcccttgctcctcgtgtgccaatgcctcgttccccgtttcagcagtttgccagatctttcagcttggtataaaacatatcaaggggatatctggttagaagaatgccagcaaaacattatttcagccaactgaggagaaacttccagattgtaggttagagagtaatcaaaacacggaaagttggagtaaggggaagaaagaaaataaagtccttagtagcaaggtttggatgttctctctgccttccagaagaaaaaaaaaacattattaagaatataatgaaccaatagatttacaaaggaaatataaacaaaatgccataaaggacaatattttaaaatttcaaattatccagatcatttcattgtttaagataccctgtgtacataaattaatcacctttggaaactgcattaacagtcacatcacaattgtatttatagctaactcacaattatttgatgtatgatgttcacttggaagctggaaagaataaatccagcttgcaaagaagcagaacttacttttagggtggggcttaggtcctgagaaaatctagctcaacacatgggtggcaaggaataatacaaaaggagagacttggggaggccaactttgtatcattagttaagaacagttctgcattgtatatgtatccaacataaacacttggctaaggatgttattctactgacagtgtttggttttccttatggtcatcagctggatgactaccgctacttggctgagaagcacttcatccataaagaaaagcaccataagtaataatgagtgcgagtttgtgttagttgcagagcaagaattcagattcaacaagggatttttttaatccaattgaaatgaatcaaactgtttaacctaattgagcttctataaatcaggagtgttgtcatattagtaatccccctagataaggcactgcaaagaggcgccgcacaagagtgcgaatgtataaacacaaaatacagggaatctactgaagctcctttattcagcatccttgtacatctcccctctctttataatcactattgcaataaaattatcacttaaccaccaacattagtacatctttttaatcattgagagactattatagttttcctatgattctgtcttcaatatccacctacaaccatggaaaggcctgatcttttcatgactataaaatcaacaaaatatagggagggagaaaatgtacatccgttgggaactgggatttaaaaatacgtactatgaatattgtaaagttattgttttaaaaatgaagcagatctatatgtgctcacctgaagggatcaccaagacatatcccatttacatagatttctctaaaatccgcttcaaatatttatctttgtaaattacttctaatatattcctaaagtcactgtttgtctactttgatacctctattcctttaaattttcccttctttctatactcacttaagggcaacgtggctcaaaacccccaggagcttgcctctcaagttcgcagattccttctcatccaggaataccttttgttgcttccatagatgtatctggttaccttttgaaattacttttctgctgaatggcacattcctggcatacatgccaccattccccattcctgaacccatgttgacataactgagtgatcatatcacccttttacactgtgacttcaccttcagggtcctttctcacagagcaggcagccaccatcagccaggtgaagcaaatctgtgtgccatcccttctgccagagcaggtctctttgtccaatgccaccattcttttataagtgtaagaaaacaaaaactcagactatagacacaccctcatgcttccaagagatggagactcatgtctgtttccttaaaaatcttgtttctgcctttctatttcactcatcactttgataaataaatgtaaaggtacatataaacatcctataatatataaatgtatatttaaaatattcatatatatgcaagagattactacaaactttttacattttagggttcacttattttgcaattgatggctgtgcttgcaatgtgtttctgagcttgtcaactttccttgcaaagtatttcaagttacaggaaggaaaaggtgtttaaaattgttaataggatttgcagcacaaggaaattagaaattcttctgcccaactgtctgatattcaaaatgaggaaactgaagctgagcaaggctaagtgagtgcccagagtactacaggtagtaagaagcgaagccagaagagaaaaatcaggctttctgtttccttgttcaagttgatctttcgttccagtaattaaaactggtgtgcagtaatgaggcaaaagcagcttcgtcaaatcagcttttttctccaacttcctatggtattgtgggtcagttgacctcacgaatttccacacaattctatatgtcagtgaagtagattatttagacattctcttctgtatatattatttggattatgtagaaattacccgtaagaaaccaagacttttcaacacgaacctcatgacttccacattctatttttgataccttaacctaaagtaatttcacactctcataaaacctttgaaaatggagcatccacagatgatattttgcacttaccaaattcctttttcaaaaaaaaaccctctaaatgttacattatattgttgtatttgcaaattatatcctccagtcatcctctgtaattttttttcaaagaaagtaaaacacagaagataggaagaacatagggagaaatgacacagaaaaagcctcaacatctaacaaacatgaatgtctgttgacagcgttgttctgactgcagacagaaaaatattggggagtacctcacttctgttcagacagtcccttttgggtgagaaaaagcttaatctgtcagccaaacataaaacaaaaactatttgtaataagaagttactgaatgccctaacttttttaccacaaatgaaataggaggaaagctgaaggtaacatatcacctaaatgcaaagagtttgcaatctaattgagagagtaaaacatatgtgaatgaaataacttagcgataaaaataaaacatatcaacaacaatgtaatacaatctgaatgcttaaatgccaagaaagcaaataagcaagtgatcagaatatgattctaaaagtcttcctagtagagacatgcttaaatatgtttttgagtagcatgattggcataaatgtggcaataaaaatagtagtaatataagtgcaaaacaactcaaatgtgtgtggccataaggatacatgagcaggtaaattgacctctaagccctgaatggatgctatctgctttatcatcttttaactttttttttgttaatagatttttcaaaccagatttaggtttaaaaaactgatcagaatcaccactggggcctgtcagggggtggggagaaaggggaggaagagcattaggacaaatacctaatgcatgcagggcttaaaacctagatgatgggttgataggtgcagcaaaccaccatggcatatgtatacctatgtaacaaacctgcacgctcagcacgtgtattcatgtatcccagaacttaaaaaaaaagaaaaaaaaagatcggagacttcccatatacttcctctccacccaccacatacacacaatttctcctatcattaaaatcttgtgttggtgtggtatatttgttgtaacttatgagccaatattgagacattaattaaagtccatagtttacattaggcttcactctttacactgtacattctatggattttgaccaatgtgtaatgacatgtaaccaccattatagtgtcagagaatagttttttactaccctaaaaatctgctgtgttccaccttttcattcctccctccctccccaaaacctctgcaaccactgttctttttctgtctccaaagttttgccttttccaggatgtcaggtgcttggaatcatatagtatacagcgattttagattggcctctttcacctggcgatatgcatttaagattcttcttgttcttttatggtttgatagcttatttctttttattgctaaactatattccgttgtatggatataccacagctgtttatccattcattatccattcatttatcagaggacatctagaatctttaacttaaaaacaaaaatttttaaacttaagtttttaaccaacatatttctcaggtagaaaatatggttctcagaacacatatactttttaccttgagacttccttgtctgaggcaatacgttgtgattttttggaacacaatactaaactatcatttgtgttcttaaacttgaatcaaagtccacttcaccttcttgcttctgttcttaggcaacgtgagagcaattaattttagaatatagaacaaaaagatgagaattacaaaattaagttgtgaattttcaaatgaatgtggttactatcaaacatctactagaggtcatgtctttctttttctctgcaactacaacactatgttgtcttcacagtgaatcagaatataattccaaatttgaaattatgcctttttctctcttctttggttacactgttaattatgtccaaaaagcaattttatgatcttttcaaaagtgacatcctaagctgttgttgattctctaagtggaaacaaatgtcacctggcccacctatgtctttgtttttgatgtcaaataacattgataactaaatcactctaatatagggggaaagaaaagctgccctgccatttgaagggaatttgcaatgaaattttacttggccccacgattatgtatacctactggttttaagacagcacacaggaggctttgccaagaaaattttaaagttcaagcagaaaaaataatcacaatatctttcagtcatttgctgcgtgtatttgtttccttaaaatgcacagctaaatgctctctacacacagatatcacttggtaggcggagtatatcttattactgggttattttccagtacatttggcatagttaaggtaaagtgtattaactttctctcaaaataaagatgaaaacagagttgtagcggccgtgaatgcttcagccattgtcaggaagttaaaaactgacaggaggcccaaataatcaactcagcctgctgcatataccatagttttcccctgggatatctggtctaatccaacaatgtatctgactggcatgaatgtagaattactttcaataaagattttatttcaagcttggatgatttcccccaaaacatcttgtcactaaggcaaagtatatcatagaatatctgattttttttttccccctacaagtcagcttttgagagggggaaaaaaatacacattacaactcaagtactcaactcaggtcaattcactgtaaaaaatcacattttaacatatctacactgattaaagatttgctgtgttaaagaagtcagggtgctgtcaaagagagcttaccctaaagtctggaaatgtaaaaaataagtaccacacttgctccactccagtctgcattctgcctgcagtggcctccaatcgaagggcaggcaggacagatgagtccaccagctaacacccggctccgagaatatttgtctttttgcaagtaaggaacatttcaaggtcacatcttccaataagtatgaaattgtttccaggctataagagaaatatgaatggcctggtcatgatcacacgaaaacgatcttcatttctctatgcatccttctctctctctttattccattctcttccttcatgatgccacattaagtcagcatgttcaagataggggaacagtaggtaacagttcattactctattttgaattcccttaaacgtttcatttagtacttgcgtacattatttcagccttggtgtcacattgtttaatttatgcttggttcatataatcttaaaaatagcttgtgttacctacagagtttcaccccttactaaaagcacacaaatcatatgatttagtgctaatgggataggagtaattattttaacatttaataatcataacacattatatttatatgttttaaattcaaaatcccttttatctctattattatattttatgattaacatacaatgttacaataagtatgtacacgaaagagcactcagcatggataatagtagataaaactctagagaagcatggaaagggctagagttgagtccctggttctttgactttattagcactgtgtaacctttggacagatcattaaccaagaagtccctaaccctggctgcacaccaggctcatctgtgaagctttttagcaactctgagtcccgggtctcaaccctgaactaccaaatcagaatctctgtgcaattcctttcctttattaaaagcctgagccagagtggaaaaccagtgagttctaatctccctttccatgtttataaaacaattgacagaaagaaatgtaatcacatataataaaaattaatgtttctggctgggcgtggtggctcacacctatgatcccagcactttggaaggccgaggtaggcagatcacctgaggtcaggagttcgagaccagcctggccaacatggtgaaaccccatctctattaaaaatccaaagaattagtggggcatgatggcgcatgcctataatcccagccactcaggaggctaaggcaggagaactgcttgaaccagggaggcagaggttgcagtgagccgggacagtgccattgcactccggcacaggcagcaaaaacgtaaatcagtctcaagaaaaaaaaaatgtttctctagcttgcaaagggttttcacatacatttttaaatttaatcttcaaaacaacctatgagatcagttttgccattaacttcactttctaaatgaagaatctgaggctcagagaaatggtagggcccatctaagatcacagtcagtacctatagaactagcacttaagattttgagcttccagatcaagagcaatggttctttccctccagttagaagagaatcacatgcagagcgtttaaaatgtacccaggcctaactgcaagccgtttgcaacagattttatgtggatgggtcccagaggttaatatggttttgaatgttccacagatgatattaatatgcagtctggatagagaatttctgccctagaatgatcagaacaagtttggaaaatataaagtactatacagatatagcgtgatgattttatctcagttttgctgataattaagcatgaattcaaagggggagggaaatgatgcgtgaacacaaggctgttcagatctaggctccacattagatgtcaggtcttccctttcatgagccagctctatttctattggaacttctctgactccccagagctcatggttgctgtcacaggttagatttaacatggcgccagttacctattaacaccaacagaagtaaagatggagcagcatggggtagaaagagaagtcaaactatgacattgggccggacaaagcctggctacccacagaaggtctggggcatccagggcccatcacagttgtctccgggaggatgaagatggcttggccttgatacactcactgtgatcagtcattggccgtgggctgtctccaagagtcccctggggtgaggtggctctcttcagctgaggcaaaccctgcaggggctgacagctgaagctgcctgcggacttgacacttggaaactgggcaacaagtctttcctcaaagagagacctgggtagcacatcaagggtccagcacagtccaccctttgtggtgctcggagtgtgttcttcatgttcatttgagaagcagctcccccaggactctcagggagagaggagatctttgaaggggaatctttagaaggatgaactacaagctctgcagctacagctggacctgagcccagctcattgtctccatcctccactctctattcgagactcccctcatcctcaacaatggcgtctgctggtcgtggtggctgccctaatgtaatgtcccagaccctcatccatgggagatccaagctcctacataccatgtcttctcagacaagaatttctgccctgttaatgccccatcacaactgggcaacagagaacttggaagccctatgtggatcatctgggtgccactctgtccccctggtgtaacagcaaccttgcctccgccctttgatcacagttaattatacctgcctagatggtgactctttgccttgactgctggtgcctggacccaagaagctccacctggcaagaaagcaacagtagcttagaagacagtgatttgatatatcattcaaatacaatgatatacagagaatagcatccttcctgactgcccatttattttgttccagaggatgctatgttctagcgaccatctcataattctctgagtcgggcccccttggctgcccctcaaccctgccacttgttattaaaattgcatctacctggcttctagtaattaagccccaccagctggcctctattaccagtgtctcagcatccccattacaatcagtgagcctagttctgtaatggactctcctatagtcaaccctcatttacagagtaaaggcccctataatcacatacaacttttctgtagaatatcaacgatgcttagcaacagctcttcaattcattgaccttggagttactatccacaacctcccactattatttctaaatgcctcatactttacaccagctagtctcctccacagatctaatgtcctaattcaccaccagggtgagttttcacaattgggctgccaccttgtgccaggacccgcctgcattccacctgccaccatcgatggactcctcattgccagtcaggctgcgagtgacccagctccaaatctccatcttattgctggctttctgggaccactcatagaactaataatcatgggttcagttctccagaaggagcccctgaaacagagtttggcatccagggcattgttaaaggttaacccctgtggaaggaaggaggtgggcaacaggattgggcagaggaataagctgaactgaagtgcagacccaagaaagcttcagccagacccacaggaagctctggggcacatagagcctgtcaaagtcgtcccacagtgggcagaaatagtccaggctttatactgactgactgagtaggggccagagcagtggctcacacctgtaatcccagcacttcaggaggctgaggcaggaagatcacctgaggccaggagttcgagaccagcctgggaaacatagtgagaccccatctctacaaaacaaaaaaattttttttaattagccgggcatggtggcacacacctgtagtcctagctactcagcaggtcgaggcgggaagatcgcttgacccaaggagttagaggttacaatgagctatgattgtgccactgcactctagcctgggcgacagaataagctcgtctcttaaatacatacataacataaaatatatgttgacagatcagtcagtgtccttgagcaaggaggcttattgcaattgaggcaaaccgtgaagaagatagctggcagccatcagctatccctgcagctatgcaggtagtccttccttgaaaggagatctaagtggcccatctctgcaagcaaagcagccaccataattatcaaattgacaaatgtacgaatggccccttaacagactaagagccttctgttataaagcttaatataatgcttgatagtggtccctaaaagatgaggcatttcatgtagaaattcttagaacaggtgatcacagttctacgtaccggacgatagaatcatgagttagcccagcatccgtatttacagggacatatgcagaaactggcacaatccattccttcaacgtagtacagatgataaatttatatgtgtaaatgcaaaataaattattttctatctttgagcaaagtattacatacattttgaaagggtttatattcctgcagatgcatcgagcattttaccaaaaataaaattatatggtcaaattttagatggccaaaaaaatggcatcattatctttagcttcaatccaaccatagcataaaacagataaaaattactctctattctaaattcctctcaccagttttgttcaaattaggtacatgtttggaaactcattgtcagataatatatgcgaaggaaagacacactgaacaattacaggcccttaagttctcaaacagttgcgctttttatttttgccttcatcttcttgtcctctcatacattacaccaactagtctcctccacagatctaatgttctaattcaccatcagggtgaaatttaggtgtgcaggaaatgtaattattgtgccaacattaaaattaatttatttttcaggccctattcttctaaatgacttgaatttggtcagttaagactgtcttccagattttttctggtgatgttgttagttctggagggctatgtaaagccgaagcatttggtggaggggcagaaaggatatccattaatacagcgtttcaacaaatacttgttgagtacttaataccatgagccaaatactaatcttagtctatggatacagcactaagcaaaaacagataaagtccttgtgcttacggcatttatattctgctggagaaagataataaagcagattagcagcagagaaagtatctagtttttcccacctctgcaggctggtcttcattcccttttcatttgcagtcatcatccccaacttccaatcccaggtctggatctcagtcactcttcacagagtactctgtgagctatctttggccaccctgcctagatatacaaagcagcaatttctacttaactgctcctgatatactaggtgtaggcagctctggaatcctgccatactactaggtcttccccaaagagaagaatacagatctgtctgattctcaggatcctcaagccttctaacagcctgcactcccagggaacgggattagcaaggaccagggcctgggccacttacgtgggacctcatcaaagtctcacctttcctagaccctccctccccaagtccagaaaatctttctctagcctggcagcaaagcagcctggctctttatctaccttccaatctactgatcaggccatccatattttggctgcagctctgaggcctttggcacttaggcttttgaaactcaaaaacacagtcctttgcaactcaactgccttgccttgcaaaaattaaaaggacttctgcttttctgcatcacccctgaactgagggcacagtgttgctgactgaacattggggaaagacccaatgtacaaggaagggtagagaagaaggctcagtcattatctactatctcatcttatccccagatgatactttgactttcccagaatgctcactctttcatcattaatccggcagcccaaaccacacttcaaagattgttcaaccttccatccaatacaggaatctcaaacatcctgcctgaatacttctcttgatggggaactcatagccttttttggtataaaatctttaatatctttaataggtgctcccaatgctttgccagcatatatgggggggggggatctataccaaatatcaatagtggtaatatctaagtagtagaattatgagggattcttattgtatctttgtctgcattttctaaattttctgcagtacatgtaaatgcattactgttttgaagcagtcttttctatttttacaacactaattcttcatacaaaggtaaaatccatctctgggccaattccagtaactggattacaagaggaaagtttattctttctttcacatcatggctttttgcattgagtcatgacttccctaaatattctttcccccctgctaaccaaacaccttcagttcctgcgctcttccatttagaagccactctctgggcacattcaccttggtgctcactagttttactgtgtccctcttaaagtcactgcagaaagtgtctaaaactggccaggtgtggtggctcacacctgtaatcccagcactttggagggccaggcagattacctgaggtagggagtttgagatcagcctgaccaacatggtgaaaccctgtctaaaaatacaaaaactagctgggtgtggtagcgggtgcctgtaatcctagctacttgggaggctgaggcaggagaattacttgaaactgggaggcagaggttgcagcgagctgagatcttgccactgcactccagcctgggtaacagagtgagactccatctcaaaaaaaaaaactctaaaacttatttttcctcagaaagtaaaattaagcgcatacaaactgaatgatgatacccaaattgcaactgattctcctttgactatttttcagtcatttaaacaaggagacaattttcaagaaaactgctaaagattttatgtaggcgccctcaatgaaaagtaaagttgctcttctcttcacctatataaaaaggaaaaacaaaagagaagttgaggaatactttgcatactgaaaatattccttttatgtttatctaacgtcacaaggcaaatatttaagtactatatactccactaataacttataattaggtgcattattctgcttggcttaattaatgctgatccatgcacaacactcaaagttctgtctaaaatattactagcacatactagtttttaaatagctatattggactaattcaggtagaaaataatgacagtcttataatttttttattgcttaaagtactcccaacataatatatttgctagcctttctcccctaaatgcagagcgatgccttcccaggatgttgatattatcagtggttattggtgtatcagcagagctcagggaataaagattaagaattcttttactgctgagacagttaaatgcaaatggctaaaaccattttaaaagcatgaggaaaaacacctaaaaaaaaaaataactgaaataatcattgtgctaatagggcatttccatttacaatgagatatgaatgctttcagaagtttttaaatctgtgtgaatatggaaaaaaggtaatacatgttaatttggtttttcttccatctgaacacccttcttatctgtgcagatatatccttggatgtgaattaggtgattaaaaaatcaaaatatgtcacccaagacttcttgttgactctgactcacttttttcccaagtcttcctcaggtctcaggcctctccattaagaagtctcttgatgtcaaattcaaaattcttggatcttagctacttgcagaaaatacatttatatcacagagtaataaagatctgcatcttaatctaggctctgccacttactgcctgtgtggcttggatcaaattttcagtctttctcagggtcattttgttcatctgaaaaagttcacctgaaaattttctcttacgtctaaacaaaagaaaaaaaaaatgggaagagaaatatcccaatatacagtaaagttacagtgatttaaacagcagagtactgaatcaaaatacacacagaggctgggcacagtggctcacgcctgtaatcccggcactgtgggaggctgagatgggcagatcactttagatcaggagtttgagaccagcctggccaatatagggaaaccccgtctctactaaaaatacaaaaaattagccaggcatggtaacgcgtgactgtaatcccagctacttgggaggctgaggcatgagagtcgcttcaacttggcaggtggagatttcattgagccgagacaatgcgactacattccagcctgggtgacagagtgagactctgtctcaaaaagaaaatatatatatatatacacatacatacatacatagagattatcagcacagtaccgtataccagggtgtgtggctgactgcaggcaatctgcacaaaaaaggcagtaccacaaatcaatggagagtggtggtttattcaacaaatgtcatagggaaaatcagctggtttccagaaaaaaagtaaattcagagtaccatcaaatttcacacaacaaaaatatttacaatgaattagatgatatgcttttaaaatctaaaatcatttttaaaaacaagactttgataatagttatctgatctctttaaatggttggattttataataataaaaacaaagataaaatccaaaagaaatagtactagatatgactacataagaacttaagtaaataaaattaagaaacacaagaattgggagaatgtatgtgccacaaaagtaatgaaaagttactcttaagacataaagaaacttagaaatctacatatgcaaggatttcactgtagcattgtctgtaatagcaaagaattagaagaagcaacctaaaaaccaaccagcagagaaatggttagataaattaaggtatttccatactatgaaatataacaacttttttaaaagaatgaggtatttttatatgtactgacttggaaacatgcccgtgatatatagttaaggggggaaaagcaaattatagcacattatgtattttttatttcatcttttctaaaaaggaaaaaaattatttatatacaagtgtgtgtgtatatatatataaatatatataaaataggtagatggatagatgagtagaaaaacatccagaaggaacacccatctgttaattatagttatgaagaaatttgactaggaaacaggggaggtttttactttttacttttcaatagttctgattagtactttttttttcccaaaagaccatgtattagttttgctgtacaaaataaaatgggttaaacaaacaaacataaaagtatacactctaaataggaaagagggcaggagatattcacaggagaggaaacacacgactgcttgtttgctttattaacttcttccccatttcctaaattcaaagaatcctaagttcaaagaatgacagactatttttcatgtatggcagttatttttaaaaagaataataccaaattataatactgctaacaggactaataggccctcccacatgttatgttttaaggaaaaaagagccataacttgataatctggtgctggttctcaagatgtggttcccaaccagaccagcagtactgttaccacttgggaacttgacaggaatgctgtttatcaagcctctccccagacttgctgaatcagaaatctggaggtggagcccagcaacctgccttttaataccttccaaattatcttcatgaagggtaaagtttgagaaccacggatcgaattgttacatttctattattttacactaaggcagaggtcttcatctgcagctttattgccatttggggctagataattctttgtcatcagagctgcctgtgcattacaaaatgtttagcaggatcctttgcctctacccattagacaccagtagcaatttcccaccccacctgctcatgacaatcaaaactgtctccagatattgccaaatctctcataggtggaggggtggggcttgggacagggtacaatattgctcctaaatggggaaccactgcctaaaaaaatactccaaaatgtggaggaagagtacatgggaaggttttatttatttatctcacttataccacgaaagcatatggcacaattcattctcttccatataaggtaatgatgaagtgatatatattacatatataagtcataggaattattcctgttagaagtgaaaaatgccagatacagaattatataaagtgcattttctcaaagttgtatgtagatacattatacaaacatttctatcatctctaaatgccaacagtgtcattctcctgctcgaacccaaagaaatgatttccatcacccttagaaataagtcccagatttttaccatgacccctaagtccctccgcagcatttcctacctctttccctttgctccctggcctccagccagactatgctctgcattcctcaccaccagggtattgtacctaccattccccgcccagaacacttgttcccctgatatgtgcacctcgacaggactctgctcaaatctcccttccttagagagggcttccctgagcactccgtctaatacacgtagcacttcttaccactctctgctcattagtattacctgggggctattcaaaaatgaaggcagcctggccttgcccaatattcaataaaagagaatctctgggaatggattccaagccatcagggtttttttaaagttccctagggtcagtggaagaaccattacttctctttttcttagcttttcttgaagtacttcagggcctgaagtcacattgtatattgcttagtgtatggtttgttgtctgttttccccactagattttaagcttcatctgagcagggattttgtctgttttactcattgcactatccctaatatccagaatagtgtcaaacacatagtaagtacgcaatagatttttatgaactaataaatggttacatcgagttcccagtgtttattatactcttctaaacttttcaaattttctctaatagaatgcgtttatcatcaaaaaaagaaattaaagctgattttaaaatctgcctttaaaatttgtgatatatttgaagcacagtgattagcacatagaaggtattaatagtaacaaacagtaactactgtaaatgtttctttttggtattatctactatgtcagggttttggttctgatattccattttatctgtggttgttatcaccttacagaacatatattctaataagaaataaattataaattgaagcctgtgggccattcatttttttactttttagttctcacatcttattaaatattctaaatattgctttagagatactttagaatatcactgtaatgcccaatcaataaaaatatgaaacaagtgaattgaaaatgtttcaatcttctgcattgaaattcatgcagaggttcaataaatgcaaataatctggccatgttagctatcaaaattcaactgccatataacgctcctttgctataatgtactaagaattatatacacctaactttaaagctaattttttgcttttattcaaaagcaaaaatgtcagaatatagcaataattcctatttaggatgatagttgttttggaaaataagaatgacatgatgtttagatataaaattgaagacttttcaatttgtttaagctaatggatatgtaaactggcatataaaaaatggctgaattatctttgagtgaccacctcgaaacacactaatgttaaatgcaaaaacacttgtgaatgctcccctgcttttccaatacttgagaatgtttctggcatacaactataactttaaagaagaaggtggaatttctgctaagtcctcaatcttataaaaaggccagtgtagatagcagtacagtttgtgcaaattgagggtaggcaagcatatggttagcatagatcccccccgaaatagttatagcacataggaaacataagttgagcatattgaaaatttattctatttttaacagcctctctttagttaagtggtcaaagtcacaattaacatttcacatgcagtggctgagctatattttgcaagccaggtgtgacctgatggcaggaatacatttaccaccacactctccttactccgtaaaactatcctaaagttatgtgtgttggaaaatcatggcattccacagatagagaagggaacatttctaatacaccttcataactggagagttgtcctccaggcaattatgtgactttcaacacactttgcaagtcactatagtaacagcaaagcacaaacttaaaagaaagttcacatccataaatctgtttggagctgaactattattaaaggctttggtcttcttaattcagcattaatttttggttgtatattaaagttttctttcagttcgagtcatttggctgtgattttatgtgactaagaaatttctttgaattagcaattcagctcattttgggaaaaacttacccagcataaggcttttttgagaggatttcttttccgggggtccaacatctgtagcactggattataaattatttctaaaataaacttaagttgatggatcattgttcttcccatttgggcctgacaaaaggtagcactcacatttcctttttttaatgctgtaaactgtgtatcacttctcagctcctgttagaaaactgaattcttactcattctaagattttataaacttgaattttacttagtggtataagaaatgcttttactaggaatacatacaaagtgctatttcatgaacaaattcataaaatcatatttttgtcaggctatttaaaactaagcagtataaataaatagcctttttcaagaattgcagtttggggcctttttttctgttagttaagcattcagaggcactaaactttgagctcttcatgttgcttagaatcaggtatctttgctatgatttcttgggagtaaattaatgatgagtcaacatacatcaagaggaattcccaaatattgacataaggtctaaatattttggggcctccttgcccactatcatgctaatgtctcaaccacgtgttttccttacctttctcattcagattagttcttttgccttttggcctttgttttgtcataaaaggggagtttctttcatttctttgctaaaaacaggttaaatggtagctcaaactttacaacacagttaaggaatttaagggcctaatgaaacctaagccctaccagaggggtggaactagccggaatgaccagaatctgacttctgagttagctgctacagagctgtgaagccagggtggcataggaggataaaattcctaacattttcagacttgtatatggtaggtccttagcaaaacacatagaacagcatttcttcatatacactcttcagtgttactcaaaaaagagaacctatgtacaagattcaagtaatttagggaggacacaagttaaagattggcaaggattttttttttctgcaggacttttcagagcctttattatgcttttatgcattgtgaatatccaagaagaaaaagtggcactcaattttctccaaaacttttactttggaatgccatttttcgtgaagcatatcagagaaatggtgttttacagaacccactttattgaaagatattgccaaatccatggtaaaaatgtatatggtttctggatcagatccacccctccaacaatacaactcaactaaagctcaagctacttgaagtacacctgactgtttttgagagttttccatctaagatactaaattgagttatattattccatgaaagccttttatttcttccagcagcctatatttcttttctacatatgttttactagttgaaaccttcagaaataatctctagctggtccccacagtaggagtgaaattatggtttctattgatgtgaggttaaaaaaaaataggtaataattagatgtaaaaagagagacatataataatataattttgcaggatagtattctaactgtatatttgaaattgtggttgatttcctctgtaatcctaaatcaaccacttaactatttaggagtccagcatggtagggaatacgtaagcttccatttgaatcatgacatttataacagcattaatacattttcccagacattcccagtttgggggccttctttgctggaaatgtctatccccacataatttaaactttaatatgagaatgtattagtcaacatgaattatatagttcagtatttgatgacttctaccccaaattgatctttaccttcaccttttctaacctaaagacagtgatttcttcacacatgaactactgtttggttgatatttggaaaataaattgcatatatatatcttaataaattgcatatatataaataataaattgcatatatatgcaaattgcatatatataaattgcatatatatgcaaattgcatatgtatatgtatgtgtatgtatatgtgtatgtatatgtatgtatatgtatatgtatgtatatgtatatgtatgtatataaatatatttatatacatataaattttatgtatatatttatatagattacatatatacacatacatacatattttgaaatagtaaataagccagatagcctgtgttctatataatactatatctaactttctttcttaatgactcttaattttttttaaagttactacaagtaacttgattttcctaactcaggaaaaaaatttcaagctgctgaaaaaatttaacctgcaataatgcaaatataacaggaatacaaaactatgtgttattttttaaatttattttaaaaatttattttttaaatgagattatttaaaacgtgcataagttttattaaaagcaaatggaaaacgtgcagggaaatggacataaaggatagaggtttgaggcagaatgaatattttatattgacacatgcataaaagcacaaaatgaacatttttccacaggaaatttaggtaatttgcattcgcagaaattcattacaggagtcccccacggtggcccagtggctgagaagccttctcccaagggagactcagacatgcaggcacatggctttccccaaggaggtactcagacacgcagctctagcctccaactcttccttctataactgtatcttcaatcgtctacttttacataatctctttcccctttcaaacttccttggttcactcccccacatttggccctgctctggtttccaagaccaggtcttttgctgagcagggaaaataaaaagaatgctgcagaaatagtaaatagtccagccccgtttcagttttcctgctctcccttcaatgcctgagtcccctttgagagctgagttatccctccacccacccaagctcctccaaagctatagaccccttccagcttccactcccatagcctcagactatccctccactaatgagctctttcatctcccttgatttttagcctcacctttgtgggtctcagttttggctcccagataccttaatctcactgtctctgcaccaactaaaactatagccataattaaataggtaactctatcttcaatcctgtcaatgtttacatcatccttttgccctttcagatttcctggactccaagtcctaatgttctactaccctgttggccaagatgccccattcacctttgtaccttcaatacagtcttgcttttgcttctaccttctccatggcccatgacctctgagccctgttctctgctagataaatcttatcaatttaggcatttgctaccaatgggtaaagttattaaaagaacttttacctaataagtactcaattgattatttatcttatctatctccatatttgcctctaaaatatgtgtgtgtgtgtgtgtgtgtgtgtgtgtgtgtgtgtggtaaaattaatgaaggagttcccatcataaaaaggtattaatttaaaaccaaattgggaaaaacctgcattgcctgtattgtgagtcttactaatggcttttataataggcatatctgggagaggctcaggagagatcttaaactgaggtagatgggcatgttaaagagaagcaaaggtccattccacttgccctctacagacaggaggatgcttaattcactcaataggattttggcaaatgaaataacaaagtggcatagcttcttatgttccaaaagaaactttaaatttgaagtctcagataactcacactctaaaaatatgaggatcccttccagaaatgtagccatgccaacagtgctcacaggtacaaatgctatctgcttaaagcagaagaaaagggaaaatgggaagcagaatatcctgaatattcagtctaaatttgagtgattttggccacaagaaatctactatcaccaggctgtccattacaattctaagagtaaaaaacgaaaattcagaccttcttacgatggatcgtatagtcaggtggaaggtggcagagtgaaaagccggcccagttactagggccaggagtcattacagacactgacagtgatgcttccacaggtactggacccagactgcctgggcagtctgggtcagtgtcagcttgtgtgacactggctgtcacaccactctatgcctcagtcttctcatttgttgaacaagcttaatagaagctacttcatgggcttgttatgatgatgaaatgagacaataaaattgcttagaacagtagttgattattattaatattggtcaggtcaaatatgctttgctggccacagtatgtgccatgagcttgcttggtggtgggcaagtaccaggcagtacacacatggcttaggccctgctcaaactctttcaagagatggacggcatggcctcttggtcacaaaagtggttcttcagagaatcaggtttgtgaagggaaaaaaaaaatgcagcagtcccccttatctgtggtttcactttccacggtttcagttatccaaagtcaaccatagtctgaaagtatgaaatggaaaattccagaaatatgcaattaataagtggcacaccattctgagtagcatgatgagttctcccaaccaggacgtaactcctccctttgtccagagtctccaagctgtctcctctggtgccattattcagagagtagccttcctagttatcagatcaatgttgtggcatcacagtgcttgtgtttgaggattccttattttacttcacaatggcccccaacgtgcaagagtaggtgatgctggcaattcacacatgccaaagagaagccataacgtgcttccattcagtggaaaggtggaaggtctcaacttaataaggaaagaataaaaactgtatgctgaggttgctatgatttatgttaagaatgaatcttccatctgtgaaattgtcaagtaggaaaaataaatttgtgctagttttgctgttgtgcctcagactgcaaaagttatggccgcagtgcatgatgagtgctgagttaagatggaaaaggcattacatctgtggatggaagagaaacatgttccaatagatggcaatctggttcggtactatccaaggtctcaggcatccactggcggcgggatggggtttctggagaatatcccccgaagataagcagggactactataataccagtctttctgccacctgtaattcagagatatgtaggcccacttaggccaaacaaagagaggcctctaaagtccaaccacctcaacaatgttccacacggagctctgaagccagagaccccactgtcctgtaaaaaagtgttcctttgctttgctttattttctacactcttatttcccttgggtttggatgtctggtagaatgaagagtttgatatttcttagcactctttctttccatatgctttccttatttccttatcactaaaaccccactcttctgaattttaatataaaatcaagtaggcttcagctgtcagaatagcattacttttttaattatcagtttctaggatggggctttattttctttttaggagtcctgtgttggaacaggcaagtcattaccattaataaaaccaaatcctagtgtttcattggtattccagctctccatagggtcctcacacaagcaaatacatatttgattccaatggggctcttttcctgtgcaaatgctacaggattctgcattttattgtggcattaagctaaattggctgtccaaatgaatggagacacttagaattttaccatataccaaactgtctcagagcttatctcctctacaaaacatattccagttagcatttgccaggaatactttactcaacactaatcaggaaaaacttaatttttttcaggctactaattgtgcagacattgttctggttatttcatttgggttcttatatatatatttttttgcatgcctctcacctgtttcctcaattgtctctaagcattttaaaggctgaatcttattaatttcacagtcatttttgctgtttaatatactcattcatttcacaaatatttgttgagtacccacaatgctcagctattatgggggtaaaaagttggacaaggcaatgtatcctttccccaaaactcataggttctacttccatacagtaaagtatgtagggtagaagattaaataatgttataatgcagttacttttcctgaatgagaaaccttttttaatcactccaaagtagccataacttcacttcaaactccagtgaaattatttttttttctctctctccacaggatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 1873 - DNA, 115896 bp, Homo sapiens
ctcgtcatggccagtgtctgtctggcgcccggtgcccaggcactgtgcgagaccagtccgcaggggcgactcggagagcgccgggccgcggcgggagaagagcctgcaggtaaggggcggccggagaccggaagagcccgagagccggtacggaagggcggctgggaaggggcgcgccgagcgggccgagtgacacagcaagcctgacaggcactccggaattcatcatcggcctcagccctccatgacgcagagtgtgtgcgtcccaaccgccgacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtggtaaatcgggaagcgggccgggactacaattcccataatgccgcgccagctggcgtggacatccggcgcgccgaatccggatattttaaacctgagtctttcgcgctgggcatggcggaatggctgagtgaggttgtttggtgtctactgttaggtcatcctcactgcttttccctgagaatctcgaggtttttgcaagttaaccttgtttttcaattaaaacgagaaagcttgaggccaaattgggaactattaatcattgaactattcctccgtttcaagttatctgaatctcctactctctgttgtcaaatttagcaaatacggtggtccaagtcaattttttaaaggtataactacttttctctggcggcttgttaaaatgtagattctgattcagtaggtctgagttagagctgagatacgtatttttaacaaccccgccgcccacccacccgtggtgctacttgctagtcattatcagaccttattgagtgccagggtaaacatgacctgtctccttactttgttttcttcccatccgctattctctcgcatccaactacacttttccacaaacctttctaaattgctaagcccaattcacacttttctgacttctcccttcctaaaactcctactctaggtttggaatcacttttcccctggtttgggagatcattcttgaaatgctgacttttgatacttctttgctatcatatcccctccctgggtggattatttactacttggcttatttctagagctgtattcccatattgtcttctccaaactctagatctgtatttctagctatctgttagaaatctgtaccaattagtcctacttaaattatttcaacatttctctggcctttctaccccttctctccagccaatcctacacattaaaatataattatctttctgaaatatacacttaattgttttttctctgtttgacaacctgtgatggctttccattattttttttttttttttttttttttttttttttttttttttgagacggagtgtcgctctgctgccaggctgagtgcagtggcgcgatctcggctcactgcaaccctcgcctcccgggttcaagcgattcctgcctcagcctcccgagtagctgggactacaggagcgcgccaccatgcccagctaaattttgtgtttttagtagaaacgagtttcaccatgttggccaggatagtctcaatctcttgacctcataatctgccctcctctgccttccaaagtgctggattataagcgtgagccaccacgcctggccggctttccattcttatagtacagcattacatagggcctttcacacaatctccctaatctgttttactagattcatctccctctgttatctctcttactctagacatttcgaatttgtcacaattccctgaacacattatgctgtatgctctccatgtctctatgctctttgtacatgcattttttttttaaacttagaattccactttctccatctgtcatagttcaacaccagtttatcttctgtttttttctagttcctctggggaaccaatgcagttttgtctgttgtcaatatagtatttactgcattctaatatgttcttttatgtctgtcttttctaccggactacattttattattatcaagacctttattttacatgaatcttaaccatctaatttactgcctcctatataataggaaatgtttttcaacttggtatagtattcagtttaccaattttcacagtctctcatttagttctcacaataaccctgcaaggtagatagtattattcccatttcacacatgaagaatttgccttgtttaaaaaatgttaatttggaggccattaggttgagatagttccagctctggagcccaactcaatgtaaacagtaaaatgaaacttaagcttaactaacagaaacagacaaacctctaactaaggactttccactttaaccaatcaagtaagtatattttcttagtcttgcttccaccaaccccttataaaagttttcccctcgtgctgtaattgcccctgtgttcttttacacagggaaatgtgtaatttcacatttccctgtgtaattgcctgctgccttccaaaaaaccaatgcactgagaactacaaatgttgcagcagggaaagatgaataatcacagggccagccaacgaggaggatgggagatatttctcaaatccacctccaagaatgtagagactaggtttttaaaggatcggttggtgggcaggaggctaggaaatgggaaatgctaattggttgggtcagggatgaatcacaggtgtgtcagaactatcttcgtgaacctgagtcatttctgaggagtggggttcacaggtccaggttgtgtctgttggtctgccaaaatgctaaatttgaaaaatatctcaaagaccagttaattaggtttcacaatagtgatgttatctgtaggagtacttggcgaagttacaaatcttgtgacctctggttacgtgactccagggcaggaggctctatagaaaagcaagctaattaggctgggtgaggtggctcacgcctgtaatcccagcactttgggaggccaaggcaggtggatcacaaggtcaggagatcgagaccatcctggctaacatggtgaaaccttgtctctactaaaaatacaaaaagttagccgggtgtggtggcacgcgcctgtagtcccagctactcaggaggctgaggcaggagaatcacttgaacccgggagggggaggttgcagtgagctgagattgcgccactgcactccagcctggcaacagagcgagactctgtctcaaaaaaaaaaaaagaaagaaagaaaagcaagctaatcaaacaatgccaagttattgtttgagcatgtctattctttagcaaagttcaagcctctaccataattctaatcttgtcttatgaatgtagcttcaatctccatacaaggagttggggtggggggtcacttttccttgcctcaaagtttaactataaaccaaattcctggcatagttattttagcctccacactagaataagcaaaaaacaaactaacaataaaacgacaacaacaaaaaactagtttagcctgtgaggttttgagcaaaatggagtcagtcatgttagatttctctcattagttataattctgcaaaggtagtttaagtgcccctagatggagtttcaccacttgtggtttggtgctgcccaattcatgaatcactgtctgctcaactgaactgtttaatactttaatgtgtgttgtcttttaacagcttgataggaggttaatgctcagtagatgttattggttaccttaatgaattaatgaataactgaaataactattttaatgtcacataactagaacatagtgcagctgggactaaaattctatgaacactaaattgggttcttgatactttaaaaataattttaatgtttttatgtgttcagcagttcaaaggtttaaaacaaatcatttatgtcaactgtctgtctgcatacaaataacaattctggatccccctcccatatgcctgaaggcatgaaggaaaaatgtccgtaatgacagtagttctctcagagaaaatgcatggaatagttgggtagctggactaaacatcacagtttgtgtaaattgaggtaaacatcacagtttatgttctcaatatgatgttttcattaaaatttaattttaaaagccctcaatgcactgagaacagcattaatgcagattatacaggaatgaagttggggtcaatatggttcagggctggcaacttagtaggaaaacccaggcaaactaaagaaaggaattgtaacagggatggtatttggcttgtgtgtgaaagtgatggtgacagaatattgtttagcattttttttttaactaaaattcgccacatagactctggtgccaaaactttgggctggtatagcacaatacatacatgaaataaaatattaaaatgcattggaaaatgatagaaattttacatgtacagatcttagaaaattgaggctacaaatatgtcccccataaggggaatgttgaaaaaacaaagtccatatatataagaaaaaaacccataaaatgtgaaatatgggctgggcgcaatggctcacgcctgtaatactaccactttgggagactgaggcaggtagattgcctgaactcaggagttcacaaccaccctgggcaacacagtgaaaccccgtctctactaaaatacaaaaaattagccgggtgtggtggtatgcgcctgtagtcccagctactcgggagcctgaggcaaagaatcacttgaacctgggaggcagaggttgcagtgagccgagatagctccactccactccagcctgggtgaaacagcaagactctctcaaaaaaaaacaagtgaaatatgaacttcatctttaaggatggttatcagcttctaaatcacattcgtcttgccagtactgtggaacatgacagaaaatgtttcaaagctaatacatttcaatttcccaaaagataattgttttcaagcttttggtgcccaaagaggagaaaaacattcttctagtgccaatacatttagtaagcgtttttcttggcttttagtgagtttttttgttaaacatttaaggacactttttcctttgttttcatatgctttgaaatattatctagataattgcataattcattaaaagctggctaatgtgaatattcattatgatttttatcgtcccctcattgaaagtttatttaattttttttaaccttttttttttttttgagacgaagtcttactcttgtccccaagctggagtgcaatggcgcgatcttggctcactgcagcctctgcctctagggttcaagcaattctcctgcttcagcctcccgagtagctgggattacaggcgtctgtcaccatgcccggctaatttttgtatgtttagtagagacggggtttcaccatgttggccaggctggtctcgaactcttgacctcaggtgatccgcctgcctaggcctcccaaagtgctgggattacaggcgtgagccactgtgccttgccgaaagtttatttttaaaaagtaataataatgcattccttggtttaaaattcaaaagacgtaaaggatgcacattttcaaaccctaaccacccagttttcctctctggaggcttatcagtttcttgtgttcttcccaaagattgtttatacagatgcaagaaaatgttaacattgaatacttactcaccttactttatatatcttggaaaactctccatattgtatgggaagaagaaagcttttcctctaccctgtcatgttcactattcaagggcctatgagttaaactgaaaaaagacagactaacaggagaaaaatatcaatttcttatgcataaaacagccaacaaaagcagcagctgactagtcaaatgattaaagttaaaggcttatataactaacttagtagggaaaatggtgggggagaaacagcttttacagggaaaaaaatagaaacattgacttttaggagaacaaataagaaagtttgtgttcacgttcatctatacagttaggagtggtgttcttccgggccataagttagggtatttatggtagcatcattccccagaaattttgctttcagtgagataaggaactctctgagaaggtttttttcccccttcatcaaatgccttcaggttaaaataatatttttatactagctctggggttcctagtcagcctctgcaatatcagtatacaaggagcattcttttttatagatggccaaattttatgtgattttatgactatagcattattaattcagtgttgtttgatttttttcctaatctttctctgtaacaaacactgctcaaataaataaccttggacatcagcatatgtcatttatatgtataaattcagtgtgaatatatgctcacttcctagaagtggagttactgggtcaaaggacatgtgcatttggatttctatagccatcttctttcaatagacactcctaccagtgtatccaaaaatcttatttcagttgatgtacatattcactagtaagttcactaacttttctctattttacagtagaataccttaatgatgtcactcctcaaagtgtcttttcttttttaagattcatttttgttttcattttttgtagggggggggtctcactatgttgcccaggccagtcttgaactcctggccttagtgaccctcctgccttggcctcccaaaatgttgggattagaggcatgagccaccacacctggccaaaaaatttattttcttaaaaaacctacaaacatcctacaaagacatttttgagttattttgttaacatttttcttctgtgcaccctgggctacataagcgtaactggccatattcagtaccaagtggtatcctcttcattgggccttattgcccttgactctactgagtacccacttgctcccttccctactccctcattctccctttaaaacatccaatcactgctgtacaaatcaaggttgaattcctttcacattggactattttccctattgcagtagtaaattatggataaaaatgtgtccctactgtcagggtttgttatctttgacaacaaaaataaacatataactgcaagttataatgagtgatatgtagtgttaaaataattaaattggaggccattagactgaagtcgctctaatgcactgagttcctacatgaggaaactgaaacttaaaacggaatcacaagtggccaactagtcatcagttatatcgtcttgaacttcccacaagaacagtccaaataaggcaactgctcaaactttaaccagtcaaataatttctttgctgtgctctgcatttactctctgaaagctttcaactacctctgggggagccccaaaccacttatgatttggagctgcctaattcatgaattgctgtctgttcaaataagctctttaaaattttaatgtgccaaagtttaccttttaacagataggaatagtacagggtgcactgaggacatataatgaggtggggggccagaaggagttggagcactaatctagtatggactggcagagaagacctctctaataaaagacatttgggttaagacctgaatgatgaacaggactttggacagtgaaaagcagagggacaaagattccaggaagagagaattgcagtgaaaaggactagagacagaaaggaacttgaaacacaagtagtcttacaataaacttaaaatttgacataacctaattactaaccaaattacaacttgatataacctaattccaatttgatataaccttaaaagcaacagaacctaatacataatgatccaaagtcaaataagatatggtgcctactctaaggaagctcagaggcaaataagtgagatgtattcctattctctattcctttttcatcatgaaaaagaaatggggacagggatcaatacttactacctaaatgagcttaagcaaattatttaatctctttaaaacttggataatagtatctgtcctgccaatttcaactgttaatatctgtcagggtccttaagtgcaaggaacagaaatcatctataaatgatataaaagctgaaaatgaatttattaaaggacattaagcagctcacagactctcccagaagctgaagaaacaagctagaggttctcctcccaataaagcctctgagtacctaacactgcagcttgcaacaacacactgatgctggacactggttgctggtgatagaacattgcagtctcggaaacgatgtagttactgcggctgtcacccttacttcaacagactctctgaagtcctgcttctggttgtcattcaagtttgagttgagtccaccaaattagattggagagtctagcaagcaataatactcatgtcccagtaataaggaagactaggaaagccagtatctgtcactttcagttcctgtaagggtgttggggggcagggtaagggagaaactctgccaaaaggatgacaaatggccactgcaaatagggtgagctcaaatgagataattacatgaaaatgtttcacaaactaagggagaattcagccacataacattatctcattttgtgttgtattgatttttaactcctcgaaggcaggcaagttggaaataatgtgtaaaataatgttaaaatcccaatacatatgcaatcacatttaagctgttatcaatgaagattggaaggaaacatacagtaaaagttattttattagagaagtgggatttaaggtgaagtagttcttaaattaaaaaaaaaaaaaaaaaggacactttccattgaattcacagtcttccccacaaacttggatccaaattctaatgaaaggaagcttaaagacgcaaagcttctggtgaaagcaggaacggaacagttggtgccagaatcgcatccatacttcatgatgcgttgtgtacgctatgccgtcctaataggaaggaaaactaccacaaattaggagtttagaaaattgcacaatgctgcctaccacttaacttcaaatgtaacctgttaacaacgttagccgacgtgaggttacctagggacatagcaaaactcgctagagttacttcaagtaaggcacacggaggttgctctgattatcaagaaaaccaaacgttcacataaaatgtttgtcttccagccgccccgctgttttccactttttccaaaaagcactgaagcgtggtgaagaaacaaacatatcctcaattctcgcgagagctccgtgtgtaaccaagggctgaggcggaggattggtcactcaggatgaggagcctccgctatcccgcccccgttgccgggatacgccgcggcgcacggcagttagtgggtaggcctgagagccgaggaaaactgagcgtgggcctcagaaagaagttaaggcacccgcgagccgggcaactgccctccttccgcgccggcggaggtgagaatccccgggtcccatctcttcctccctccctcccacgtctgttctcttgccttggagatgctgatccgctccaaacaaaacaaattcaaactcggtcttagctaactgttaccgtcgggcctgtagccaggccaggcatgtaccaattctagtcgagcgaaggttgcgaacagacctcctccaacagcccgacccctccccgaccccccgcaggagacccgccaagcacagagcagagggaaggaccgcgatgggctgaaggattttagtcaaagcaatacatttctgcctcttacagtggaagggacttatttctgtctgttgatcacagtgcgggcagttagcaactttccacttattcacctgtgtgagaatggttggcttagggaggataacgatagtaataataattagaagcagatgttttaaatgtaatacttatcgtcttcacaacagccctgcaaggtagatgtcacccttctgttttacagaagatgaaatcctgaggggttaattaaggtggcaagattatgcagccgctaactttgtcagcactagtttgtatcgctaatcattctggatccaaaggccaggctgcctctctgtgtgaataattggaaattgtgtgactctttgattgaataaccccgaagttagtggtatatttgttgctaatgcccgcctcttaatcccactggtaataatataatggtaagctttttttcaccacagtaaaacggtggcaaagaaaattgggtgaaattttttatgttgtacattttctcaaagttagcaggaaacctagagtaatatcttttccactggaaagagatgtttattgtactcgttttcttctggaaaaaccattttgatcatacaccgtcttccttttcaaagagtcatttcatgaaattcctttttccatttgaaattcttttgctttgtacatagagttcaaaatggcaaggaattagaatcagggagctagtggggtcaggaagattgatgtgaacatattcaaatgagatatctgaatggaaatttcagataaacaattgaaaactcaaaattggtgcccagttgaaagggcagaactgtagacattgattagtgagccgtacacatagttggagttataaagatgcatgactgtagaaaggatagaagcagtccaaggactgattacgagtaatgctaagaaaagtcagaaaagtagtactggacatagagtgtagaaacagagaaatcattttagtccaacacacgctttgtttgccttttttttttttgagacggagtcttgctcagtcgcccaggctggagtgcagtggcgcgatctcggctcactgcaagctccgcctcctgggactacgcccgccaccacgcccggataattttttttttgtatttttagtagagatagggtttcactatgttagccaggatggtctccatctcctgatctcgtgatccacccgcctcggcctcccaaagttctgggattacaggcgtgagccaccgctcccggtcgctttgtttgctttttaacaatttagtaaatttttgtaattggcaatacctttatgtacgaggaaatttaaaagatacaagagagaacaaagtttttgcttatcactgagacagattttggggatataaagatgattaagattcagctcttgccataaagggtgagaaatacttaagcagatcatttcaagtggtgtgataggttctggaataaagtaatacacaggatgcatggtagcatgtagaacaggcctatacactgaaattgaagaagacgaagattccaagaccagttatggactggtcatggaaggattcccagagaaagtaataggcaaaatgtgtgttaggcaaggggaccacttaagaggctggtataatagtccacctgagtcagtgatgccctgaattggccagtgctgtaggaatagagagtaaagtacctgttaaacacttaggaacaaaatcagtagaactaaacaaaacaaactcagtagaactatgtgaccagccatgggagtaagggagaggaagatgtcaaggactaaatttcttacttgtgtgactaggaggtgacaccaagaggaaggacaaattttgagcagatgataatgagtttggattacatatgtttattttgaaatatttagacatctaagtggagatgttattatttggatataaacaccgcaagctgagtgctaaaataaggaagttgtgtggaatcagtttattaattgttaaaaccctgagtgtggataagggggcccaaggggagtttagagagagaaaagaaaaagatggtggatggtatcttagaaaatgctctatataaggacagatcaaggagacagaaaaaagaaccagaagagagggaagtgtcatggagatgtttcatataaatgtggacaccagtaaagtaggatgacatttacagcactggcaatattggcaggggtcatttgaatcaaacggtagcaatccaggagatactgggaaatgaagcagtagaaaatagtggatataagctattctttttgttgttgttgttgttgttgttgttgttgttgttttgagacggagtctcgctctgtcgcccaggctggagtgcagtggcacgatctcagctcactgcaagctctgccttccgggttcacgccattctcctgcctcagcctcccgattggctgggactacagacactcgccaccacacccggctaattttttgtattttttagtagagacagggtttcaccgtgttagccaggatggtctcgatctcctgacttcgtgatccgcccgcctcggcctcccaaagtgctgggattgcaggcatgagccaccgcgcccggctggatataagctattcttaggaatttggctgcataagggaaggatgtatgggacagttagatagaggtggttgcaggatcaagaaataagtttttgaaggtaggaaagaattgaacatggtaacagactgaaggaaaggagaaagtttaaagataattggtagcagtgaggttaatgccacaaaaaagatgggatcaagggtaaatcagagtaagattgatcttgaatgagagaaggaatggctgttgagactggagggcaggatggatgtagagaagtttatgtgccccaaaggtgatggagttcaagttgtaatttttttaaatgagtcatctgctgagagtggcaggaacagaggttaaatagaaaagtagttaagggtgagaatcatcaagtagagaagtatcttaacaaggataaatcatttctgaaatgagggtccagctaagatttgtgactatcactttgcagtaccccagtctgtacagttgtatgatttccatcagcaatgttcagcacttcagattggatgtagagaagggtttctgattttgccagatgggctggagaatagttcaaggatacaaattagttgatagtgctcatgagacactaatttcttgagagaaggaggagagttcttaaacacccttgtcaaggtatcactagtgacttcttgaatggggactccattggacatttcagttttcatcttacttgaatttccaacgtaaatggcatggctcagattcctgccttctcttggcgtctctgacacacactcctggtttttttctttgctttctgggccttaattttcagtctctcatactagattttcctcttgtgtgtaatctgtatgtattgatgttcctcaggacagaatcttgggcactattctctttttctccatattctttgtctagataagtatcttcataactattttatatgacctacaataggacatacatttttatattgtagcccagtaaacacatatgtgtaaatttatgtaaatatagctgaaacaaaaatttactgaaacaatgtttacccttcatattttcagtgagctctttttgtttaaattttatttcacgtttaagtatcttggtcataacctacaaaattgttttcagaacttactaacggatgtgaccaacaatttgaaaactactactctaaattatgagacagaattttaaataatgttatattctgatgaataaaggagagggctgataaactgggagagaatgagtgaattaaggaaatggtttaaaggcaggtgtagcagaatgaagatgagaaaagggtaggagaggagaagaccagagaatagagtatttcaattaagatgtttgaggtgaagcaattccagatgatgacaagctccatgtctcgccatggctataaattactgaaatggagttaagatcattgctaaagttgaggtcagggaactgtgaagctggagtgttaggtattggatctagtatctagatggaagtcatccagggtgatggtgagattggaatagagaagctgtgaactaggtacaaaagactttagtaaagatagaggagagattaggaagtcactaattaccagcaaccaggaaagatcaaggcaatattgttgcattcccagatcctcagaagaagtgaatcttgttttttttttttttttttgggtggggggatggagtctcgctgtgtcgcccaggctggagtgcagtagcgcaatctcggctcactgcaaactctgcttcccaggttcatgccgttctcctgcctcggcctcctgagtagctggtactacaggcacccgccaccacgcccagctaattttttgtatttttagtagagacggggtttccctgtgttagccaggatggtctccatctgctgacctcatgatccacctgccttggcctcccaaagtgctggggttacacgcgtttgccactgcgcctggcctcttgttaatttttttaaaggtgtggaagaatgttttgaaagtgaccctgaggagcaagaaaagtgccacctccttttctttaaaattgtgggacaggaagctaaaacacttggactaccgaaagtgttactctcaggggaaatcaagattctgttaaagttaagaaaatagaaagtatttgtaacaagattcagaatataagagttaatcatggaccagaaagtgcagagaaaggattaggggcaaagaaagatgttggctatgatgggagagaaaatttaccagagtatgggatgagaatactaaagaaatagataatagaggggcttgcattttggtaagataatagaaagatgaggaaggaatgttgcaagaaacaatctcatagttgtaaatggagcacgatgtcatatttgaacaaaattagccttgtagtggtacacagaacggcagtttgcaagaacaattgttgtgaattaaatgtaagggtatgatgggtcattattgtcttgctagagaagacatcaaaggattgaactatttattgtttccaaacagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcagtaagtttgaaacaaatctatttactttgggaggccaaggtgggaggaccacttgagtccaggagactggggcttcagtgaactctgatcatgccactgcaccccagtttttgagtttttgagactgtctcaaaaatctgttgaatgcttgtgcatatattgtggtagaagttggaaatcccctctgtaataagagattctactttgttgtttctttatttcataagcatattattaaacatgtttgttttgttttttggaaagcatctggaaatgtaaatgtggaagagtgtttgaaagacactctgggaagaagatgcctgctcctgcagatactcaatttaaagctgcaataattttagttgaatagtgtattggggccagaataaaatgaaatggaatagacctcaaatagaatcaagcatataagaatttagttaatgattaatgtgtgtttcaaattagttggcaaaacatggagcattcaatagaacattccaataattgttaaaccatttgtttaaaagtatttttaatcctctcttataccttttatcagaattctacatagcttagaaacttggtatttcaaaaatgaaaccataaatgtagtagaggaaaatgttggcaagtattctgtataaacttgatatgggctaggctttctaaacatgacagaaataacaagtactgaaaaggaaaatatttttattatatatctgaatttacaaaaaataaaacaccataaaaaattagaaatgacaactggtaaaaacatttataatatatataccatatataggatcagaatcttaaaattaaaaggtaaactttactaatttttttttttttctttttttcttttttttatttttatttttttgttatactttaagttttagggtacatgtgcacattgtgcaggttagttacatatgtatacatgtgccatgctggtgtgctgcacccactaactcgtcatctagcattaggtgtatctcccgatgctatccctcctctctccccgcaccccacaacagtccccagagtgtgatattccccttcctgtgtccatgtgatctcattgttcaattcccacctatgagtgagaatatgcggtgtttggttttttgttcttgcggtagtttactgagaatgatgatttccaatttcatccatgtccctacaaaggacatgaactcatcattttttatgattgcatggtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgacttgcatttctctgatggccagtgatgatgagcattgtttcatgtgttttttggctgcataaatgtcttcttttgggaagtgtcggttgatgtctttcgcccactttttgatggggttgtttgtttttttcttgtaaatttgttggagttcattgtagatagattctggatattagccctttgtcagatgagtaggttgcgaaaatgttctcccattttgtaggttgcgtgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtaccagtaccatgctgttttggttactgtagccttgtagtatagtttgaagtcaggtagtgtgatgcctccagctttgttcttttggcttagtattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccgtgagcatggaatgttcttccatttgttgtaaactttactaatttttaagtgctctttctgtattaagaccacaagccttatgtccaatcaaaatttcatgacatttcttttgatgctaggggtaatattataaaactattctaaaactcatctagaacaataccacaaaaataagaaaaagtacagtactctaatgtaaaatatgttatagacaatgagtgaaacaatattctgattgccacggcacctggaggtaaactctagtaaatgttaaagagcttaatataagagagtgtgtcataaatagtgaataagagaaacacatcatatgaggaaaagttagatgaagtttatgagttgatattctaagcagaaggatatcctgtaaagataattattacattttcgttatcattataatgtaaaaattgggaaacaacctagaagacttacaacaggtgaatcttaaataatgatatgtatatccctataaaggctgttagatagtcattacaaactactttcaagatatttcagaaaataatatactttaacaaaagtttaaaagtgatatcaatttaacatagaaaacataaatttataaatacatagaattgaaatggaaataaatgaatagacaaaaatgtccataaatttatctgattttcacacaggtgatttcaactgagaaggtgcagagggccaatactcaacctcctacagtaggctaagtgcaaactacagataatgttgggtcctatggttaactcataagaagagcagcattttttggagggaataattttgttaaagtcagattttcctaaagttttcagattttttttctagagtttcaggtaataatattaggacatcgtcatcaacttagactgaaataatttttctgaagtcttcatacataggatagtaagggtatctttttcttttattccagtaaaaattgataattaaatatttataaaaagaatctgacatttattggccacctactatttgccaggcacgttatctgtttatttgtaaaattttaaaatttgtatgtattcatggggtaggtcagttgtcttacatgcatatattatgtaatgatgaagtgtgggcttttagtgtacccatcacctgaatagtgaacactgtacccaatatgtaatttagcaaccctcaccttcctcccactcatcttttgtaatctttagtgtctgttatctcactctgtatgtccgtatgtacccattgtttagctcccacttataagtgagaacatgcggtatttgactttctctttctgaattgtttcacttaggatcatggcctctggttccaaccatattgctgcaaaagacatgatttctttattatggcagagtagtgtttcatagtatgtgtatatatatatatgtgtatatgtgtgtgtgtatatatatgtatatacatgtataccacattttctttacgtagccctccatctccattgatggacagtcaggtttttttttcatatattcgctattgtggcaagtagtgtgataaacataggaatgcaggtatctttttgaaataatgatttctttccttttgcagtgggattgctggatcatatgatagttctatttttagttttttgaggaacttccatactgttctccatagtagttatactaacttacattccccccaacactgtacaaaggttcccttttctttatatatttgtcagcatttgctattgcctttcttttggataaaagtcgttttaactggagtgagatgatatctcactgtagttttgatttgcatttctctgatgatcagtgatgttgagcaccttttcgtatacctgtttgacgtttgtatatcttcttttgagaagttgtctattcagaccttttgcccgttttttattgtattattagatttttttgctagtgagttgttggagcaccttatatattctgtttattaatttcttgtcagatgaatagttttcatatattttctcctattatgttggttgtcccttcactttgttgattgtttgctgtgcaggtgctttttaacttgatgtgattctatttgttcatttttgctttggtttcctttgcttgtgggatattactcaagaaatctttgcttagaccaatgttctggataatttcccctgtgttttcttttagtagtttcatagtttgaggtcttaagtctttaatccattttgatttgattcttgtatatggtgagagatatgggtctagtttcattcttttgtctatggatatccagttctcccagtaccatttattgaagaaactggcatttcctcagtgtatgttccttgcatctttgtcaaaaatgtgttcactctagatatatggatttatttctgggttctctattctgtttttatgccagtatgcttttctttttcttttccttttttttttaattcaggatgggtttggctatcctagatcttttatggttctatataaattttaggatttttttttctatttttgagaagaatgtcattgatattttgacaaggattgcattgaatttgtagattaatttggatattctggatattttgacaatgttgattcttccaatccatgaacatggaatatctttctattttttgttgttctcttcagttcattgcatcagtgttttatagttttcattgtagagatctttcacttcttgggttaattcctaggtattttattttatttgtagctattgtaaatgggataactttcttgatttttttcatgttgttccctgttagcatatagaaatgctattgatttttgtatcctgcaatttttctgagttttactgaatttactatttatcagttcagatagtttttttggtggagtctttaggtttttccaaatataagatcatatcatctgcaaacagagttaatttgacttcttcctttccagtttggatgccctttatttctttttgttgtctgattgctctagccaggaattccagtactgtgttgaataacagtggtgaaagtgggcatccttgttgtgttctagatcttagaggaaaggctttcagtttttcctcattccataggatactagctgtggatctgtcatatatagcttttattgtatttagatatgttccttctatacctggttttttgaggattttgatcatcaggagatgttaaatgtcatcaaatgcttttacaatatcaacggaaggcttttgtccttcagtctgatggtatgatttatcacattgattgatttgcacatgttgaactatctttagttacctggggtaaataccagtgagtcatgacaaatgatctttttaatgtgttgtttaattcagtttgctggtactttgttgaggatttttgcaccaatgttcatcagggatattggcctatagttttctgttttcttcatatgtcttgtctttttttttttttttttaatcaggataatactggtcttgtagaatgagtttgaaagcattttctcctcttctatttctcagaatagttttagtaggatcagtattagttcttttttaaatgtttggtggaactcagcagtgaagtcatcaggtcctgagcttttctttgctgggagacgttttttaaattaaaaaaaaattttttttttttttgagatgtaatctcgctctgttgcccaggctggagtgcagtgacgcaatctctgctcactacaacctctgcctcccgggttcaagcgattctcctttctcagcctcccaagtagctgggattataggcatgtgctaccacgtctggctaatttttatatttttagtagagactgggtttcaccatgttggtcaggctagtcttgaactcctgacctcgtgatccgcccacctcagcctcccaaagtgttgggattacaggcgtgagccacctcgcccagccgggacactttttattatggcttggatctcgttattgttattggtctgttcaggttttggatttctttatggttcagtctccgttggttgtatgtgtttagtcatttgttcatttcttccagattttccaacttattggcatagagttgctcatagtggcctctaatgatcctttgagtttctgttatcagttgtagtatcttctttttttcatttctgattatatttatttgagtcttccctctttttttcattagttagtctggctaaaagtttgttgattttgtttatcttttcaaaacaccaactttgtgtttcattaatcttttatattttttttgtttcagtttcatttatttctactgtgatctttatgaatttctaatatgaattttgtgtttggtttgctcatgcttatctgattctttcatatgcattattaggttgtttattttgtttttctacttttttaatgtaggcacttacaggtataaactttcctcttagtgctccttttgctgtatcacataggttttggatatgttgtgtttccattgtaatttgtttcaagagttttaaaaaatttcctttttaatctcttcttagacccactggtcattcaggaacatatttctatttgttggtatagtttccaaaattcctcttgttatcaatttgtggttttattccattatggtcagagaagatacatatatatttaggattgttgtatctcttgcttaattgattcctttattattatgtaattatcttcttgtctttttttttaaactgtttttgatttgaagatgtatgtatagctactcctgcttgcttttggtagtgtggaataccttttcccactcttttgtttttagcctatgtgtgtcttttagggcttgatacgtttctcatagtcaggatatagttggattatgttgttgttgtttttttaaaatcttctgctaatatgtatcttttaagtgaatatttcaattcatttacattacattcacagttaataatgatatgtgaagctttgttcctgtcattttgttagttgtttttaagttgtataaattatgtttctttctttttctctgtctttttatctttatgttttgatgaaattctttcatgttggtatttgattattttgtcctcttcctttgtgattgttctataagaactgtgagtttaatatttttatgcgtttttgtgatactgtatatccacctttaatttctatgttgaagacccctttgaacatttactttaggaatggcctagtggtgacacattccctcagcatttgcttgtcctggaaatactttatttctccttcatttatgaatcttatcctgtcagggtataaaattcgtggctgacaatttttttgttttgttttgttttttggttttttccttagcacttcgaaaatgacttcctattctcttttttatttgttgttgttttttttaatttccactgaaaggtctgcttttattctgataggattgtctttgtaggtgactagatacttttctcttattaattttaaaattctttccttcgcattgacttcagacattctgataatatgctgtggtgagggcattgcaaaaatgactttttctttgcagtgacttcacctatttaatatttgcatttttgaaaatagtagtgcttgtagtaaaacatacaaacaatggagaagtatcagagttccttcctattgtaggtataaccactatcaactgtatcttctagactttttaatgtatttataaacacacacacatacatacacagtttgtatgactttggactgttccaaaatcaagatagtactgtatacattgttatttttctcatctatttctttcagcaatatattatgaatatgtggccaagtgaatacatatacatccacttcattatttttaatgtgtacagttttaatttatatgttcttctctatactttgacctggtgaatggaaaacaaaaagtagcataattagttgagtaggtctcacagttatgcttgcataaagccaaagaagaaattattcagaacatttaccaggaagagatataacattgtcttctaaagatcactcgggttaacccttaactcattttatttgaatttgtagttgacagtcttcctgtgtccaacacattctctagaattagtactattcctggcccctatgctcaaaataattcccaagtaattcattaggggataaactgacatcttttcaaggggtggttgtgattcttaacaaggcaatggggagacatttaatccagggtaaccgggtttctaggactgatttggtcagttgactttttagggtttggttcattctttctactcttcctgaagagggtggatgccaagggatatggtattcccattttatgtctagcacctgtgctaactctctaatgacatgtgccatgaaatgggtttcattgtctgaatcaatgttttctattagtctaaacctgggtatgatgttttcaattaatgcctttataactgcattactagcagttgcgcttgagaaggagatagtctctacacagtgagtaaagtgattcactattatcaataaatacttcaggcaaccgatggggggcattttagtgtagttaattttaacactttggaatggtcttagccctggatctcttcccctgaggagtgattttcttagagcttgcttattagttttttttatatattaagcaactctctgtgacctgtttggctagggtgtaaattctgatacacccataaactctgaaaaccacatcgcacatagcttggggtctccagtgggctccttgatgtacttgagacaagacctccctcatgagaggtttggataacatctctctttgatctggtaatatccattttccttctgtgttttctttagctcctatttttattaatttttctttttcagtggaagagaaaatggggactgtggtaggggaaggaaggcaaggagttaagtgaaagacaggtgtttcagaagaaatggcggcttgtttggctatttgatctgcaaggttatttccttgacttgggaaggaaaagtcattttgatgccctgggacatgtacaatagctatctcttctggcagctggagattgtttaagacatggacaattagttctttttggaccaagtcttggcctttactattatgaccattctccgtccagttttttttcaatgtatgagccactccaaaggtgtacttagaatcagtatagatagttccttcttggttctgcaaatgtttcaaagcttggctgagtgcaaacagtttacaagtttgggcagaccaattattgggcaatctttctgactctacttcttcaagagtttttccatcagttactgaatacccattatgtcttttctcttcaattacccaggaggacccatctataaataagtgtcaccctgtcttgaagggagtttctcttaagtctggccagacctttgtatggtaatcaattagatctaaacatgtgtgctccctttttaggtttagatcccctgttaagaaactagctagtttgagtgaattatcagtagttaatgttaaatcatctttttttttaacagaatggtcttatactttaaaattcttgagtcagtgattcacctctctattttttggtttaagatagttctaacttggtggggcgtgcttactgtctattttcctccgaagtttaactttttactttcttcaaccaacactgctctagctgcaatggactggatgcattgaggccatccacaggtgactgggtctaaaacttttgacaggaaggccacgggctgccggttgcctccatgcttttgggtaagcactcctaaagctaccctgtcattcacattaacaaaaacgtgaaatggcttttctagggaagatagggctagaacaggggcagttatgaacatctgtttcagctcttcaatctgatgaattttatcgaagtccacaagagacggtcaggcttccactgggtaagtttttcatacaaaaatttactttttagtgagtatgagtcaatccatacacagcaatatccaattaatcctaaaaatttttttggttcttgcttagtttgaggcaggggtaaggacacaattcactcaatccattcgggccttattctttgcttgcctgcacttattaggtggcttaaatatttaacttcgggctctgtatattgaagctttccttttgagacccataacccctcaaactgttggtggttaagaatatgtatagagaagtcacccactttttttatatcttcaccagatatgagaatatcatccacatactgaagcaggcatatttgctttgggacaagaactttttctgatactcgttctagaatttgaccaaagacgttaggggagtctgtaaacccttggggtaagactgtccatcaatattgttgtttttgcccagaatggggatcttctcactcaaagacaaatatgtctcggctatcctcagccaaggggcatgcgcagaaagcatccttcaaatctattactgtgaaccactgatgatcataaggaatttggctgagaatggtgtaacggttggggacaacaggttgagtggtctggactatctggttaatagctctgaagtcttgtactaatcagtatgacccatctgatttcttgacaggcaggattggggtattatagggagacatacagggtttaaggagtccatctttaatgagactctcaattacaggctttaaccctatcctgccttcgaagggaatggggtattgctttctccttactatgtccccaggagtttttagtttgatgtctattgggggaacttgaagtttttctcgattcccttctcttgaccagacatcaggatgaatgtatttttcgtccacagtggtgagtagatttaatgaggtgaggaatcccttagggccagcttgaaggcctattcctaattttagcattaagtctttttctaatagattagttcccacctcagggatcaacaaaaattgaatgtgagttaatagatcttgatgtttgacttttgtattttccaagatttttgccttaaatccttctccttctccttttaccccagttcttctgaagagccagcaagattagatggagtgagacaaacagaggagtgagacactcctgaatcaattaaaaaggtgataagttcacatttaggtcccacctccaaatttatcaagagctcctggtgggactcaaattaaaagagacagagaccctgactcccctattcttccttgaaagtcatgagtggaaggacttctttttccctttttaatttgggacattgtctcttgaagtggcctgttccacatttgtaacatttatcttgtccttcctccctttcaattctgggattctttgactttgctcccccacactctttagagggcctaggaaatgaaggcccagatcctctaattggaggcttggttcctttgaacgggggttttttggatcctttatagttcttggctccctggaagtcttgttgagaagcatatgggtttggagccacctgttgaaaggtggatagcataagttttgctctttgtttttgcttttctgcgtctctccttacatacactttttgagctttcctgagaagtttacttagcggtcggtcttcccaattttccaatttttgtaacttttttgaaatatctagtcaattcttagtgacaaaatggagcttaaacatacccggcccaaggggatcttccaaatttaggcctgcatactgtttcatttgctcctttagcctgtctaagaattttataggcccctcatctttttttgttgttgtatatcaaatgctttagagaggttttgagtttggggtattgattccttaattccttttattatcatttcccttagatcttccatgttttcctggtgagctgcattattattgtcccacctgaggtcttaagcgggaaatttttggtccgcggtagggacattctgaccaggagagtattcacgtttccaaattgccatagcagccctacggttatgctttttttctcctccgaaaagaggatgcctgggatggatattaactcgacccaggtatataattgaggtcctaagaattgatcaacttaatcagccaccccataagggtcatccaacaggagctgaagctcttttttcaaactttgcacctctgaactggtcaagggaatatttacaaagccaatggctccccctccttgtggaacctcttttaaggggaagagagtcggggctgactccttaggtgtggagggaaatgggaaattttggatatcctttttacattgttctatctcacgttgaagtcctttcagggaggggtacttaataggctgggaggggacaggctcatgggatgataattcccaaagtcagggttataaggaggaggaataacgtgagcagggaaaggatctggaatgagacctgaggcggcagcagctgcctgagggggagggtcaggggcactgagcagaggaagatgatccagaggatcccatgtgttggtgggtgtgggttgtttaggaacagggactctttctcttttagaggagttggtttctggcttgttccctctggtttttaaagggtaaaggaggacaggttcttgcctccaaaaaagagcatagtctgtttccttttgggagacagggcttttgtcattaacatgttcgattaagagctgacaaatccactcttcattggaaccaaattttggccggaaaactgagggtttgaggatgggccttcagtccaaataaaacaacaatattgtatcatttgctcttttcttttatgtttagttctttcattatctttccaatattttaacataagtcccaagggactatcaggaggaatttcatcacgcgcttggctgtttatttttcctgtcttacgtgaaacatttcccatcttggaggtttgggatggtgtctaactgaaataggcctttccctggagcttctcaacctctcctactagagatttctcgccctccgtcctttcagaagctcactgaggctctgaggctcaatccctcatattagagatttcttgcctatcgatttccataggcattgttaaggctcagtccctcgtattagagatttcttgcctatcctttagccccacctgttggaggctccttgcatccttctttcgctttttccactctggctgcttcccttgtgggaaatggcaggatctgccacatgaggtgaccacgggaccgtgcagataggacccactcaatccacacagcagtagtgttaacatcatctacatacacttttatcctccaagataccctgaccacctaggaaatactttgttgttcttgtaccgtttttcaccttggtctgtgcacagagttacttggtcgccgcggtgttgtaagcctctcctttccccattgctgagagcttggatttgtttgtcacaatgggtgggtctcagtctcccatccctgaggccactgcaatgcgacagtgggacacgtctccccctgggtggggtgactgaagacctcttcttgaaggagaatgggaatccccgacaagcccccagaattgttagaaagaaagcttgaagtcgtaaagaaagacgagtactcaaacaaaggatttctcagcaaagcaaatttacttttgcgcagtagggtgcttcttacagggctgcttgtcatgagagcacactgaagaaagtagagtagaagcttttattcctaatgtgactcctgccctcgtgccctttccccattggctggggtcggactgcacaatctaaactagacccaattggctaaacatttaaactttcttagataaggtgggcgcatgatgggagagaggggagaggaggaaggggtcatctacagaggactagagagccagtcttttcctaaataaggaaaggaatgtgagctggggctgtggcatgcctgggcatgtagtaaaatcagaaagaagaaaaaaggagaagaaaggcagggggtacctggaattagagaataagtagctgagcaggctatttgaagagaaaccttgccatatctcacatcttttatatcttctcatgcctgtatgtattatatgaactgacataaagggagtcttttggcctttcctgaggtcgtatagtgttatgttggattttgcatacctgaagtagagaatcttgttgagtaataatatgaatgcttgtttaacaatgtaagccctttagtacttacatggtcatcttaggatggatttatatccatttgtttttacaagattaaagttttcttattttttcctgatttttaagggtaatagatactcattgcaataaggcggaaaataccaaattgtataaaggagaaaataaaaatcaactataatatcattatcgatcatcattactattttttcacatagtttttaaaatttttatttttgtctatattttttgtttttttaaaagacggtctctctatgttctccaggctggcctcgaactcctgggttttaaataatcttctcatctcagactgccaagtagctgggcctgttggtgcatgccaccatgcccaaacttccagcctttttttgttttaaaaaagtagagttttgaaccaggcacagtgattctcacctgtaatcccagctacttggatagctgaggcagaaggatctcttcaggccagtagttcaagaccagcctgaataacatagtgagcccttgtctctaaaacaaacaaaaacggaattataaataccatcttgtaaactgccttttaatttttattttatttacttattttgagactgagtctcactctatcgcccaagctagagtgcagtggcatgatctcggctcactgcggccttgacctcccagattcaagcgactctcatggcttagcctctcaagtagccgggattacagacgtgtgccaccacgcctggataacttttgtatttttagtagtgatggggttttgccatgttgtccaggctggttttgaactcctgacctcacatgatccacctgccttggcctcacaaagtgctgggattacaggcgtgagccaccacacccaacttaaactgccctttttatatactgcagcttatttaaccattttctgctgtggacatttaactcctttccagttttgaggtattataaataatgtctacatatagaatttaaaattttcctgaaatgtatttttaaatagtcatagaacattaaatgttaaagaaatatgttaataaattgaacaacagtatttaataattcagacatttaaaaaataaggaaatttttacaaatcaagtagaattttgtttttttaaaaaattgtctttgcagttttacaataaaagatgtacagtgttttttctggtttactaaaaatgaaatcttgtttgtcatttagatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtacctattttaagataagtatgacacttgggcctgtgttttgtaagaaataaataactgtgaacaatttaaaaaagtaaaagttgagtatattttgaacaataagtattacagtaccatttttttaaatcaggattatagcatgtaagaattattacatgtaattatggcatgtaatcagaattatggcatctaatcgttattctttgattcacaaaattattgtgatggttaaacaacagagtgaatatgaaaatacagtttgaattagaaagctatatacagatatgagctatttcagtcttcatttttctgacatggagctgtagtacaacttgaagaactttgaaatagtcttggagaaaagttcaagattgaaaattagatttttggtactatatagaaatactctgaaatagtttagatagttcctatattaaaatgacacttaaaatacttgtgtatttatgagaagtgagtcaagaaatgttactttttttctgataattagcatctgttctaatacttatgtaaggaaatgaggctaatttcctcatttatattaatctaatttcctagatttatattaaatctctcattatgcttctgcatatgtatttagagaagcataagaatatactatatattagagtttaaaatttagatctgtggtatatataaaccaaactatggtaaactcctttttcttttctttttatcataggcagtggtcagtagcctgtggtgagctgtttcagagtttttcgttttctgtatttttgacagatgatctatcaggaatgaagatatactgctagtacaaaattaattatatcatacatgctactttctataatacagtatatcatccctttcaagagacttaaattttttttttttgagacttaaattttttcatctacattctaataacatctaaatcactaaatattaaaaatgaattgattatttagaaatgtttgcttaatgattatcagtaccatgaaaaaatatttcaaaattacatagtcatttaactagccttttgaaagtggatgcacagaaatatttatatgtttaatagtattttaaaacatcgagggtaaaaacatattaaaattctatagtaaatttatcaaatgtttatttctgtattaatttatccttcaaaacagaaccaatataatttaagattgttagtctctacaagtatacttcaaagccttttaagagagaattcggaacattaccactacacagaactgtctactgtgactttcattcttaccttctctagtgccccatttcccagtataataagatactacctctacttctcagcatagaccttatagttaatacacctagttttacctctcatactttgcagggcacttcatctcttacaaggtttgagacatttaacctaggaacactttctttttttttttttttttttttttttttgagatggggtctttctctgtcgcccaggctggagtgcagtgatgtgatcttggctcactgcaacctccgcatcccagattcaagcaattctcctgcctcagcctcctgagtagctgggcttacaggcacatgccacaatgcccagctaatttttttgtatttttagtagagatggggtttcaccatattggccaggctggtcttgaacttctgacctcaagggatcctcccacctcagcctcccaaagtgctgggattacaggtgtgagccaccgtgcccggccaggaatactttcttagttctactgaaatgtaagaccatttcttaaaaagtctctgagacaaatgataaaaaatcatagtcactttctcacattgagtaatgtctgcagtgtccagtatgacagccagtagtcagaaatttaaattagttccccagtagcaccagccaaattttaagtgcttctgtagtccctctgtccactttattggacagtgttaatttagaatatttctgtcactgcagaaagttactctggacagctctgttccagattcccttagactcaattttcattccatcgtcctgttctgtagagtctactgtcttttaacagccccacctctagtcccatcttcgtagttttaattgaagcttcccttatgttgtgattctaaggtattagttctcttttcagtttcagtgattcttcttgattcattggggcattcatgaagactgtcttgagaattgtggagtgtaattctgattgtgctttggatttgctattctggtggcatttcgaactgaacactaacacttaaaacatttttttttaggtccccagaggcaaattttagacaaatcttactatcttgggcttcttaggtatgttaaacatatcttttcatccgtatgttttactcgaaatattgtgtaccttctgtcaaaatagagtatataactttaatatgaagttttagctaggcacttattaggataattaggtatctattgatttctaaaaattattttgtattctaacaatttctggttaatttggctatgctgtaaaataaatgtgatagtataattagtctgagatttatagttttatgaatttgcatgtacatgagctatattttccctcagtttgtttgtgctgctataataaaatacctgagattgggtaacttataggaatttatttcttactgttccggagacgcagaagtccaagatcaaggtgccagcagcttcagtgtctggtgggcacctgtttctcacagatagtgccgtcaaggtgtcctcatggcagaagagtggaagggcaaaaggtgctgagctagtttccttcaacccttttctaaggcactaatcccatccatgagggcagagtcgtcatgtcctgattacttcttaaagtccctacctcttaatactattgcattagagattaagttttgatatgaatttcagagggactcaaacattcaaaccatagcaaacttattttattttatttatattttagagacagagtctcactctgttgcccaggctggagtgcagtggcatgatcacagctcactgcaaccttgaactcctgggttgaagtgatcctcctgcctcagcttcccaaagtgctgggattataggcataagctaccaccacacctggcctcatagcattttttttttgagacagagtcttgttctgtggctcaggctggagtgcagtggcatgatctcggttgactgcaacctctgtctcccaggtttaagcaattctcctgcatcagcttcccaagtagctgggattacaggcgtttgccaccacacccacctaattttgtgtgtgtgtttttagtagaggtggcatttcaccatgtcagccaggcttgtctcgaactcctgacctcaaatgatctgcccatctcggccttccaaagtgctgggattacaggcatgagccaccgcgcccaaccccttgtagcattttaaaagttcacttttttcatctaatgataagaataatttttttttttttttttgagatagagtctcactctgtcgcccaggctggagtgcagtggtgtgatctcagctcactgcaacccctgccttccgggtttaagctattctcctgcctcagcctcgtgagtagctgggactgcaggtatgcgccaccatgcctggctaatttttgtattttttagtagaggtgggctttcaccatattggccaggctggtcttaaactcctgacctcaggtgatgcacctgcctcagcctcccaaagtgctgaaattataggctgagccaccgcacctggccaagaataatcttctatgttttttttcagtaattaatctgaaacgtgttactcatatcattaaaatgttaccagctacatctaataagaaagggaaaatatgtatacttatttatgttatattaatcagtaagttttacataagtatgtatttggtcagttgctaccaatgtggcctaattttaattaattcataagctttttttcttttttttttgagacggagttttgcttgtcacccaagctggagtgcaatgatgggatctcacgtcactgcaacttccaccgcctggattcaagtgattctcttgcctcagcctcgtgcctgtaatctgcaagtagctgggattacgggtgcctgccaccacacttggctaatttttgtattttttttttttttttttttttgagacagagttttgctcttgttgcccaggctggagtgcaatggcctgatctctggcaccgcaacctccgcctcccgggttcaagtgattctcctgcctcagcctcccgagtagctgggattacaggtgtgcaccaccatgcccagctaattttgtatttttagttcagacgaggtttctcaatgttggtcaggctggtctcgaactcccaacctcaggtgatctgcccaccttggcctcttagagtgctgggattacaggtgtgagccactgcacctggcctaatttttgtatttttagtagagatgggggtttcaccattttggccaggctagtcttgaactcctgacctcaggtaatgcacctgcctatgcctttcaaagtgctgggattacaggcgtgagctgccgcactcggcctcataaacttttgttatatgtctctggggatgcatctctaaatcaatgactttttcttattcttactattttcccacttacttgttctactgtcctatctccatcttcccattttacttcattttctttttggcacattatttgtatcttctttctcttttatttcgcttttgtttaatccaccctcccatcatgccctgaaagccctgttttcttttatttctcagttacctggatcctattgagtctcaaactcctagaaggcaataaagaaaagtatggtttccccccatctgttctcaaagctaagagtagtaagaaagatagtaaggccatcagttgtttagtatctctgacattcagccactttttaatcaaaagaaggaaaggaaatatagttattcctaatgattgcattgcctttctcccccaggatttgtgcttccacatcaaagaatagttctagctatttgtgtaattgtctggctctagagcagtggttctcaactggtggtgattttgcccccagggaacatttggcaatttctatacatgtttctggttgtcacaagtgaggttggaggaagtgctactgatactcagatccaggatgctggtaaacatcctgcagtgtacaagatagtgctcaacacgaggtgctaatcactgacccaaaatgtcattagtgctactgttgagaaactgtgctctagagggtagtagcagctgtgatgatgacagttaagcacctacatctgcctgtggcttgtactagtttgaccaggctttcattctggttctatttcatctttcttcatgaatctatgtcagtttctcctcagtttctcatcagttgagtagaataggatgggatatacctcattctttttttttttttttttttttttctgagatggtgtctccctctgtctcccaggctggagtgtagtggcacgatcttggctcactacagtctccacctcccagatttaagctattctcctgcctcagcctccctagtagctgggactacaggcgtgtgccaccatgcccagctaatttttgtattttgaatagagatggggtttcaccatgttggccaggcttgtcttgagctcctgacctcacgtgatgcgcctgcctcggcctcccaaagtgttgggattacaggcttgacccaccgcacccagccagaatatacctcattcttaatgaaataagccacctaaactttctgcattcttttagtgaatttcacaaaactatttatattattattacgtattaatggaaagtttaaattttgcttaactagagttttctggattaaaagtattgctgacattcttatttcttttctaatagaagtaaaataagtgaacttacaactgaagttaataaacttcagaagggaatagaaatgtacaatcaagagaattcagtatatttgtcatatgaaaagaggtgagtaataagtattcagtattcattcagtattttgtgcttataatactaactttgtagctatccatattgtttgtaatgttcattttcttatgtatatttttatgtacatatttatgaatgtatttattttatgctttcagggctgagactttagctgttgagataaaagagcttcaaggacaactagcagactacaacatggtattttatcttttctaagagaatttactgttaatattttcattagtttttactactgctttaaaaatacattagtaggcaaaggacatgcacagatacttttcaaaagaagacaaacatgcagccaacaagcatatgaaaagaagctcatcatcactgatgatgattagggaaatgcaaatcaaaagaataatgagataccatctcacaccagttagaatggctgttactaagaagtcaaaaataacagatgctggtgaaattgcagagaaaagggaatgcttatacactgttggtgagagtgtaaattagttcaaccactgtgaaagcagtgtggcgattcctcaaaaagctgaaaacagaactaccattcagcccgtcaatcccattactggatgtatacccaaaggaatataaatcattttaccataaagacacatgcacatgtgtgttcattggagcacggtttacagtagcaaagacatggaatcaacctaaatgcccatcagtggcagattggttaaagaaaatgtggtacctataccatgaaatactatgcagtcataaaaaagaaaaagatcatgtcccttgcaggaacatggatggagctggaggtcattatccttagcaaactaacacaggaaaagaaaaccaaatactgcatgttctctcttaccagtgggagctaaatgataacacatagatgggaacaacagataatgggatctacttgagtttggaggctggaaggagggaaaggatcagaaaaaataactaatgggtattagcttagttacctaggtgattaaataatctgcacaacaaacccccatgacagtttatctgtaaaacaaacctgcacatgtacccctgaacctaaaataaaaatttcaaaaatttcaaaaacaataaaacatttgatgaaaaaatatatttattaatttattatttaaaataccaaatagtacatgaatacatacttattgggaaagatgaaaccataaaaattacaacaaataaagtatccctttactttctgcttcatttccctccccagaaataacttggcttaacagattaatatatattcttccattgttttttgtaaaatacgtttactgacacatacacaaatgcacacatgcttttctccctaaaatatgttaaaataataatttaaataattttaaaagtggctaaaatgtattggtcctatcagtgatcattgctttaaaaacacattttttatcaagtgttgtcatcttgaaaattttgaaatttaattattaaacatacagatttccaccatcttgatgttttactcgaaatattgtgtacattgtcaaaatagagtatataacatgatatagttccactaaagatgcttctacctgtggactttcagaagaaacagtccccctggcaatattgataactgctcagtccttgggtgatattggccccatgaaaatttctagtgtcagaattttcttttttctaactctttagttgctttaggagcagtgatgtctggatttaatgaaaaagtcaaatttttatctcactacccttattaagaaatagtgttacaagaaataaacattctatcataatggttaggataagataagttatgatatacctacttgatagtgttaccttgtgcttatcaaaaattttgctaattatagtataactttttatttttgtttttgttgttgttactggtggtggtggtgggttttgttttttgtttttttgttgtttttttttttcaagacagtcttgctctgttgcccaagctggaatgcagtggctcaatcatggctcgctgcagcctagactttctgagctcaattgatcctcccacctaagcctcccaagcagctgggactacaggcacatgccatcacaccaggctaattttttgtattttttgttgagatgagatttggccttgttgcccatactggtctcaaactcatgggctcaagtgatctgcccaccttggtctcccaaagtgctgggattacaggcttgagtcattgtgcctggactatttttattttttaatttttttagagatagggtcttgctctgttgctctggctgaagtgcagtagcatgattgtagttcactgcagcctcaaactcctgggcacaagtggtcttcctgcatcagcctcccaagtagctgggactacaggtgcatgccagcatgcctggctaatttttaaattttttggagagatggggacttgctgtgttgcccacaatggtcttgaactcctgggctcaagtgatcctcctgcttcagcttcccaaagtgctgggattataagcatgagccattgcacccagccctcttataattcttaaatttcctggactacacaattcatcacaaacattttgtagagcccattattcactgggattttctttagtaaatgatgttctgttttaaatgtgagcaaaatagtttttttttgtttttttgttcttcttgagatggagtctcgctctgtcatccaggccggagtgcagtggcgtgatcttggctcactgtaacctccgcctcttgggttcaagtgattatcctgcttcagcctcctgagtagctgggattacaggcgcttgccaccagctgggattacaggtgcggtcctgagtagctgggattacaggtgcctgggtaatatttgtatttttagtagagaaggggtttcaccatgttggccaggctgatctcaaactcctgacctcgtgatccacccgcctcagcctcccaaagtgtggggattgcaggcatgagccaccgcgcccggccgagaaaagtagtttttaaaggtatgaaatgacatgagatgaaagggagttttagttatgctggaacaaattaggcatattcatataaaaatactaccatataaaatatgctatttatagatttaatgagctaatatctgatacagagcagttagctgtgtatctgacatatagttagcactcaataaatgttaggccttattagcacttattatttatatcataaatgaaaaatgtgatataccttacacccaaatagtttgcttttagtagaccttctgttcacattctggctctatcgcttgctaaatttctttttctgtaaaatgtgtacaatcatatctacttcatacagtaattgtaaaaattgagttaacacatatgtaatagtgtttgacactaggtaaatatcctatgttgacaactgatatccttgcctaactttttgaagtagacttactactgttccatctgtgcaagccctgttgatttttttttaattattagaagataaagaatatctttttatgtttttactagtgtaaatttgttttttgttgttgttgttgttgttgttttttgagacggaatttcacttttgttgcccaggctggagtgcagtggtgccatctcggctcaccgcaacctctgcttcccgggttcaagcgattctcctgcctcagtctctctagtagctgggattacaggcatgtgccaccacacccggctaattttgtatttttagtagagacagggtttctccatgttggtcaggctgttcttgaactcctgacctcaggtgatccgcccgcgtcagcctcccaaagtgctgggattacaggcctgagccaccgagcccggcttactagtgtaaatttgtaaatctactaacattcctctctccttggggatgttggcaggggaagagagggtgatagatctttccaaaactctcgtctgttccaaacccttatttataagctcagccatcttttcagagcaggcaaagctccacaagatataatattcaggaagagttgtttattactgctcatttatccatgttaaaaatgtgatttgtttattggccaggtgcataatatatgcttacttaggtagctcaatatttgtttttatcttaaaatagaaaatattcaaaagtattaatacttaagttactactcattatttgtaagactgaatacctatattattaattatagagaacatgtgtaaagactaacaaaatggtgtttgtttgtttgtatttttgtttttagttggtagataaacttaataccaacactgaaatggaagaagtaatgaatgattacaatatggtaagaaaatttataaaagcaaattgatctatgtaagtcatatcctacaaaacaaagcatttatatctagaaatagtttgataaaaccttaagtgctatagaggtgaatattactctgattgtaaataccactattaggtattccttgagctcccttagttgctcttttaaattttcttcctgttgattggctttcctaagtgggtgtttagtgactgtctactgtgtttgaactggtgtcacgtgcaacattagttagggagtgccatctccatttccttatatatattagtttacagtatttctggcttagtttaagcacaaatgttgatgaatactcaatgtgacaaatgataactttacatagtttttgtcaccagtggagaaaaatgaatagatatgactccagacataaaatattaatttttgattggtaaatgagaatctgtgtttaacatggacataacactggggactccaaaaagggggatggtaggagggcaataagggtggaaaaattacctagcaggtacagtgttcattatttgggtgatgggttcactagaagcccaaaccttaccgttatacaatatatccatgcaacaaacctgcacatgtacctctgattctaaaataaaaacaaatttgtattcaatgttcttagattaattgtttggtagaaaacaataaaatatgttaatagctagcttattttgattataagcatttggatgaaaataacatacaatttataatttatatagtttataatttatttacatgagtaaagactgttctatgaagacataggattgataaaatgactcttctaaatttggggttctcaaaccatgataatttagttacttttagctttagaacacaagagaattcactaattaagaatcttatttcaatgccagatataaaaagtaaaaaccttatgtgttttgtcagttgtttgggatggggggtctgttttctaggctgggtgtgcacaggtagagttaattaggtgtactcagataatatcctgaatggttcaggaataaaacttgtggtggttctaaatttaacatattactaatcaaatatttattgaacactcaatatattctttgaatgctgtttacataaattgaatttacattgaattatttgacagatcactgaagaacaatgaatatttttggtataagattacaatgcttcttaaaaagactttttaaaaatctgatattgtttgttaaatgaggcaattactttatttttcttcttaaactttgtatgtggcactaggataattatagtaatttctcatttagttcctagccaaaataacctacaaagaaaaaatttggtttaatatttatttcttactaacttatgtgttaactttattcagcttaaagctcaaaatgatcgagaaacacaaagtttggatgtcatatttactgaaagacaagcgtaagtatagctaatttaaaaattagattcataagtaagctttattaggtagtttaagttgtgatccagttatttccttgtaaattttcttaacaatttccccattgcctttttcatttaaaaatatttacaacacaaattttgttgcttatacttgttatcttcatttaccattaaatacctaaattctgtataaagactattgctacatagcttatataaataggatttatgctgctagcagctgaacacttatgatggataagaacatctttatatctactatttttggttttaacctgggcttttaactaatttgaattttggtgtttcatccccaatctagtgaaagacacattattcattaggaagctatttacattatttcattagcattgatatttaatagttatattagcaatctacgtcatatatagattgtatgtgtgtctttatatataacctatctaaagactaaataccaactaacgctggaaataacgtaattgtggcagtgggagtaatgcctacaaagataataatagatgtgatgtagttaacttatttgtgttttgtcagttgtttgggatgggtccatattctaggctgggtatgcacaggttgagttaactagggatactcagataaaatcctgaatgattcaagaataaaacttgtgttggttctaaggtcaaaaagttgatgaagaataattaatttagaaccaacacaaattttattcctgaattatttattctaaggcaacacaaacacaatgagctatgttgtgtaaacacacatacaagcacattctctcccagaaatttgttaatattagtctctttgagagcaaagacaataataaacccaaattaccatattcaattaccaaaattcagtaacagcaaatacactctcttgttacctctgcataaaacagtaaatatttgatgatggatagatgttaaaatatactgataaaacatttgaaagataaatgtaattcttctattgattaaaaacaagaatctcttttcccctgcctttaagtagagttttgctctgttgcccttgctgaattgaagtgacatgctcatggctcactgcagccttgaacacctgggttcaagcgatgttgcctcagccctccaagtagctgagactacaggtgcatgccactatgcccagctaattttttgtttcttggggagacagggtcttattacgttgctcaggctagtctcaaactcctggtctcaagcagtcctcctaccttggcctcctcaagtgttgggattacaggagtgaaccattatacccggccaccatctatcatttgctgctgctgtaaagtggtatcttataaactcaaaatactagcagtctttttccttttacaaggaaaattttgttcatggtaaccacgctcttacttgaaaacgttccttttttttttgttatcctggttttaatccatttagcaaatatttatcatttactatatataagatactctcttaggtacttcaaagaataagaaatatataagctataggccagtgtggtggttcacacatgtaatcccagcactttgggaggccgaggcgggtggatcatgaggtcaggagatcaagaccatcctggccaacacggtaaaaccatatctctactaaaaatacaaaaattagctgggcatggtggcacgggcttgtagtcccagctactcgggagactgaagcaggagaatcacttgaacctgggaggcagaggttgcagttagctgaggtcgcgccatcgtgccactgcactccagcctggtgacagagcgagactccgtctcaaaaaaaaaaaatagagaaatatataagctataatcccctgaaggccttaaagagtttagaacatttaagttctcatttatttcatcatttatctcaaagttatataatacctaggtcaggttttaaatattatatttacatattttacagatatttcatctgaaaacataatttcaagaataaaagttaaagaatgtcatagatttttacatctatttggttttttttatttaggaaaatcttcaaatatggtaatttgtcctgaagatacatccaaaccatttaaaaactctgtctgtaatttgtaattgaggctgagtgaaattggttctcttgtctgttttaggcagaaattgaaattaagaacaacaattggccaggtgcagtggctcatgcctgtaatcccagcacttttggaggctgaagtgggtggatcacctgaggtcaggagttcaagaccagcctgggcaatgtggcgaaactctgtctctactaaaaatataaaaattagctgggtgaggtggcaggtgcctgtaatcccagctactcaggaggctgaggcacgcgaatcacttgaacccaggaggcggagggttcagtaagccgagattgcgccactacactccagcctgggtgacagggcgagactttgtctcaaaaaaaaaaaaataacaaaaagtattgttacgaaggttacttttctatacagcagtagaatagatttatttcttgtgttaaccagatggccaacgtctcaataacacaaagatctatcttgactctacacagagtgaccaagaaatgccatacctcgagaaggcaggtgtaaaaagcttctgttttcattctcttctctttcaatacaaccatttagtgtggtctgaccatctggtttattatggaaaactcatctataaaaagttggttataataaacagcctcaatatattacaacaacaatatgtaagacacctggcattaattcagtttcacagtcttgcttgaactaatgattctcttctaatcctgcactttctagttaatattagtcaagatcagttgtcctgtaaaaatatatgtaattataattttatacccatttatttttctttgtgtagtcagatatttattgaataccccatattcaacagaggcccttgaatataaaagcttaagtgtagtctttgctcatttgcaattatatttcattttgctacatttctcaaatattaatatttgcatcttataattaggaaataatttagcagaatgatacattgtttagaaaaagatattttatgttcctataatcatctcattcttataattaaggtttaaaacaaagtataattgatatataaagaaacattagccataatatacttatatcctttgttgaaaacatgtgtctgtaaacacaagcaaatatgtattataaattagtaagttcttctattttacaggtatatcatcctagtttttattttctctcagtagacatttgtattgaatttactaattatgtaacttttaaaatgactattctatagattatgacatagatctattttattttagcctcttttttctaaggaattgtcaagtacatacaaatttttaaaactttattatatacataaacaatttgaacatacacagaaatagcatactataccatacacaacatacacagaagtagcatattatacccttatttagctcccagctccatcagctcatatttgaccttgctccatccatacctctagccactgttccattccacgtgttataatgaagaaaataccagaaatattatttcacccatcaatatatttcattatttcagagatatacatatttgtaaaagatgtaaattcttaatttctctgcatatgaaggtaaaaattatagattgtgctacagtttttaatgtactgtttgcattgataaattattaaattgtgattatagccaattgattatgaggactcagcaaataattttctttagacccttcctattacagccgataggccagtgttttccaaactacgttctttggaatgttattgaactacgagctcttagtagatgtaactgaaagaatgggttttgttgtcaagtaagtttgagaaatttttaatactttgctcttgaataatcagagagcagtttagcttagtaaagttttacataaatcctattgtaaagaatcttggccaggcacggtgctccatgcctgtaatcccagcactttgggaggccgaggcgggtagatcatgaggtcaggcgttcgagaccagcctggccaacatggtgaaaccctgtctctactaaaaatacagaaattagccaggcatggtggtgtgcacctgtactcccagctactcgggaggctgagtcagaagaattgcttgaacccaggaggcggaggttgcagtgatctgagactgcgctgctgcagtccagcctgggagacagtgcgagactttgtctcaaaaaaaaaaaaaaaaaaaagaaaaagaatcttgtttcaccttgtttaaactactagtttttcctgtagtaatttgaccatgtacctccttcttcttctgtaaatacttgtgaatgtctctctggaaattagtattctagaaaaacaatttgggaaacattgctctatctactgaatagatagaaatagctgtccatggaccacatgaagattccttagtgtcagcacagaccaatttgaataaaaatctcccagagagaggtggaaatatgtatttttaaaacaagatttatagataattgtgatgcccactttggaagccagtatgacattaaactgtagtgatcctgcattatggtgacagcctttctttataaccagaatcaatagtgacttattagggattatgcctgaacattgtgcttgtgctttaaattgctatgaaattttaaggaaatttattgtgctatttcaggaagcatttcaaaaaaatattttccaactctatgattttattctgggagcataaaatcaatcttagtgtattatttaagctatctctgttcctcactttgacttccatatattaataaatcctaaacttttatttctttactgattgaaacattagtataacttaatacatattatgtcaaatacctgtgttaatatgagaatccattcattttaattcatgaataatttagacctttttactagttcgtatggtcacccaagcactgctaagaatagtagtgctagtattgtagactatgtaactgtcaactaccgaggagtgtcagttactgtatttgaacctgcttgctcaatataatgcaaagaacataattttatgatattcatgtatgttgtcattaatatgaatgcctgccagctgtattttgttatgtcacatagcaaaatctccatatctaaactgagtgagctgataactttgctttaaaaagcaaactttgaaagaaattaattttcttcacataattcatggatatctatatatttgtcttcaataaatccatcatcatctaccacaaatgaatgtaattgttcaaatattactgtagtttcttcagagtttgtttctggtatctgtgaaagagagcttggatttccagtaaaaccatcttcataggtttctgcttcatgctcttccaggcgatgatgattataactaagcagaatattgtaccatattgggcatttgatagcaataaaaatgagaagtgaagtcgtcagtacagtgacaacaacaccaacaagaaaagcccaactttttccaagaggttcatgttctttaatggaataccaagagaggagagagaaagaaaatttgttaagttggcaaaataatcataattatatatcctaattctcctcaatattggtattaaaaataaacatacattgtagttttctttagattttgtttggtggatgaattctctttgttcaaaatagctgtgtttgcaattttgttacccttttacctaagaccattattgatttatactcgttaagatttgtgactagactagttaaaacaaaggctcagagaagttaaataatttgcacgatggcatttggcttgtaactagcagagcctagtttggaagagcaatattttgtaaatctttagttgagatgaggaatctttcttttacattttttatacaaatttaaaataaagataactacctcagtttatttagtatgatacattcagcagtgttaatatatagaaccagtatattacctgaatttcttgttaagttgttcgaagagctattaaatattgaattgctgatgggctgaaaatgaatataaagatcttcagttactgatgaaggaaattttgagtggcattcagccttatgaggtactgttttgatattgtagctctgcaggctgttggggtagctacacatggtgatgttctcattttctagtaaatcagaaagaataagatttagtatagagaaaaataatagttaacaacattttataattgttttatctagaatttttgacatatttgtcattcttaaaggcattataagaaattcctgttgtatttgtctagcaacataatgaaagaatgatgcacatttctgtttattattttataaatatggcttaaatgcagtatctttgttatttagtttatctgtattagtgtagattttattattaatattgtggttacatggttacaatctggatctcaggcacagtatggtttgcagttaaaatacgtcacttgttttcacttagtctaggaagcacttttaaaaaattagtctgacatattgactttgctaacaatacatgaaatgacattatcatctcacatgtatagaacatttacatttctggccgggcgcagaggctcatgcctgtaatcccagcactttgggaggccgaggcgggtggatcacctgaggtcgggagtttgagaccagcctgacaaacatggaggaagcccatctctactaaaaatacaaaaaattagccaggcgtggtggctcatgactgtaatcccagctactggggaggctgaggcaggagaatcacttgaacctgggaggcggaggttgtggtgagctgagatcacgccaatgcattccagcctgggtaataataacaaaactctgtctcaaaaaaaaaaaaaatttcttaatttttccccctggtaatggggaaggagagcatctatgcagctgttactttttagtgtttcttcctgttttgcttaaacagaaattgtttcctttcctttttttttttttttttttttgagacagagtctcactctgttgcccaggctggagtgcagtggcacgatctcggctcactgtaacatctgcctcccaggttcaagcaattctcccacctcagcctcctgagtacctggtactacaggcatgcgccaccatacccagctaatttttgtatttttagcagagatggggtttcaccatgttggccaggctggtctcaaactcctgacctcaggtgatccccctgccttggcctcccatagtgatgggattacaggcatgagccactgcgcctggctgcttccttttctttaaaacgtgatatgagagatttttctgtggtggaacattgagttaatcacattttggttttgcttaattatgatagcttacctaatgtcacatttgatgtgttcaaccagttctgcaaattaaatagactgcaagagcagttccataggtttccatataaagttattaattccagatgaaatagtggtggtacatccaaatagctaatcaaattgccttgcagattcagaagttttaggcttcttagaggcacaaatacatcagcattcagttgttctattttgttttggcagagatataactgttttagtttatttaagcctaaaaatgcaccctgttgaattacatagatggagtttctacagatatttaaaatttctagactggagaggttaccaaaaccgttattatgtaagatagtaaccttgttctcaatcaaatagagctctgtgagtaaaaagtatgtctgtagaactcttgtgtctgtaccattaagagtaatttggttataactgagatcaagtatagtaacatctttcttgatatctgctggaatcaaggtataatttttttcagtaaaattacattggacttcctagaaaaacaaaaaaaagaaaggcattaatcagaaaaaaaattaatagaatttcaccaaatttcatatttaagcacttagacattagaaggacgttattttgggaaaaaaacctactatctaatattttggtgttacagtagagcaaatctttttctttattgggatgaaatactaaaaattaaggatattctgatacatacaattgaacaaagagattccaatttgtcatacgggtattttccaactgttattacatgatcattacagaaagtaatgctactggaatattcccatttatatatgtggaaatgtatggtaaataataattctgttaacatttaatattccagtgtgcacaattgctttatagtgaggaaattattttaaactatatgtgtttttaaaatcagcagagctaacaacattatacctagggctgttcaataattaataaatgggctgggcatggtggctcacgcctgtaatcccagcactttgggaggctgaggcaggcgggttacctgaggtcaggagttcaagaccagcctgtccaacacagtgaaaccctgtctctactgaaaatacaaaaaaaaaaaaaagtcagccgggcatggtggcaagcacctgtaatcccagctacttgggaggctgaggcaggataatcgcttcaacccaggaggcggaggttgcagtgagctgagatcatgccattacactccagcctgggcgacagagcgagattccgtctcaaaagcaagcaatcaatcaatcagtctgaataaactctctggtttaactctcttaaactctctgggtttaacagctcaaagtttggtgttttaaaaggaaatatttatcttttatcagaaatggagccaggtattgaatttaaagagccacacaatctgaaattctttatgtggatatagatggaaagaaagaaatagttcttgtttttactgaacagtaaactaagaataaatagaactaagaatagttctggtttattactgtttttgcagttagattttttcaccaataataattcaatagcagtttctctcataaatatgtgctttttaaaaaaaagtttcctacattttaaacaagattttactcttaaaactaatttctgattttatagtgaaaattttcagatctctccctttaatcaacttttaaagaactcagtttttataaatgaaggctgcttttgtcaaattggaatttggatatacagagctaaataaactcttaattttagtaggtcagattttctttgctttcttattgcccttttatattttactaaatatacagaaaatgtacctttgaaaatatttttactattttgattgtaaaaacttactcttttagaagactggattttgtctgataataatatcatggagaggggccaaaagaggattgtgatgcctgtgactttcatgttgcagacctgatagaaaagagagtattttcattaaggacatttttatttttccctcttttgaatctgtttattctttttttttttttttttttttggctgagacagggtctcactctgtcacacagacctggtggcatggtcacagctcactgcagccttgatctcccaggcttaagcagtcctcccaactcagcttcctaagtagctgaaacacaagcatgcactaccatgcctggctaattttaaaaatttttgtagagatggggtcaccatgtgttactcagcctggtatcaaactcctgggtgcgagccatttccccccagccactggcgtggccttgaaaagtgctgggattatagatatgagccacttaccctggcctttcaaatctactttttcttgaaatacataaaatgtgaaacaagtgcatggccattcaccatccttgcactctgatcttaataaactagaaagcccctttgaagaatgagactgatttctattttttctttttagagaaaattaatatttttaagtgtgtctcattagtttctagatctcatgaaaggagctttaaagcaatttaagtggttgtaaattttaaaaatttaatatagaagtgcacaaaagaaattcaggaaaacgtatatttatgcatgtttaagtatatgcttatattgatggtcttgattttttcaattttaggcattatctattggcattatctatctattattcttgacttaaaactgtgggagatgagaatctttagcactctttttccccccatggtaacttttaaaaattttattgaggcgtggtagatatacatagttttggggtacatgtgataaagtagtgcattcatataatttttaaagatcaaattaatgtacttgggatatccaacacgttaaatatttgtcttttctttataatggaaacattcaaattctcttctagctgtttttaaatgtacagtaaattagacgagagggagagcatcagaaaatagctaatggatgctgggcttaatacctaggtgacgggttgatctgtgcagcaaaccaccgtggcacatgtttacctatgtaacaaacctgcataacctgcacatgtaccccggaacttaaaaataaaagttgaaggaaaaaaattactgtaaactataattaccctactgatctaacactaggccttctttttttaagcaaactgtatgtttgtatgcattaataaacttttctgcattcctccctccctaccaccctttccagcctctggtaaccactagtctactcttaatctatatgaggtccacttttttagctcccacatgccggtgagaatgtgtgatatttgtctttctgtgcttggcttatttcacttgacataatgacctccggttccgtttttgttgccgcaaatgacaggatttcatttgtttttatggctgaataatattccattgtatatatatgctacttttttttaatccattcatctgttgatgggcacttaggttgattccatagttttgctcttgtgaatagtcctccaatacacatgggagtgcagctatctctttaatatattcatctcttttttttaaatgtatacccagtggaattactggatcaaatgtaaatgtaagtgttatatttttagttttttaaggaaccttcatactgctctccagagtggctatactaatttacattcccaagagtgtatgagggttcccctttctccacatcgtcaccagcatccgttattgcctgtcatattgatagaagctactttaatgggggtgagattatatatcattgtagttttgatttgcatttccctgagtgattactgatgttgagcattttttccacatacttgtttgtcttttgtgtgttttttgagaaatatctattcagttcttttgccatgtttacttggattatttgttttttatcggtttgtttttggctagtgagctgtttgagctctttatatcttctgattattaacccctttttagatgggtagtttgcaaatattttctcattccgtgggttgtctcttcacttttttgatcattttctttgctgtgcacaagcttttttgcttggcgaaaccccatttgtacatttttgctttggtttcctgtgcttttgaggtcttagagacacaaaaaaatctttgtccaggccagtgttctagagcaattctccaacgttttctttttttctcttttttttttttaaataaagaaaagaggtttaattgactcagttccacaggctgtacaggatgcacgtctggggggtcctcaggaaacttacaatcatggtggaaggtgaaggggaagcaggcatgtcttacatggctagagaaggaggaagaaagagcagagggaggagctacacacttttaaacaaccagatctttttttcttttgagacagagtctggctctgttgcccaggctggagtgcagtgatgccattttggctcactgcaacctctgcctcctgggttcaagtgattctcatgcctcagcctcctgagtagctgggactacaggcatgtgccactttcatgcgggtccatgtgaagagaccaccaaacaggctttgtgtgagcaacatggctgtttatttcacctgggtgaaggtgggctgagtccgaaaagagagtcagccctccagtgttttcttgaaacagttttatagtttgaggtcttattaaagtctttaatccatttttattcctggatatggcaagagataggggtctggtttcatttttccatatatagttatgcagtttttctagcaccatttattgaaacaactattatttctccattttatgttcttggcacctttgttgaagatgagttgatgtaaatgtgtgtatttatatctgagttctctattccattccattggtctatggatctgtcttgatgccagtaccatgctgatttggttactatagctttgtagaaaattttgaagtcaggtagtgtgatgcctccagctttgttcctttttgctgagggttgttttagctatttgggatcttttatggttccatatgaattttaggatttttttttctacttctatgaagagcgtcactgtattttgataggaattgcattgaatcagtaaattgctttggttagtattgatattttagcaatgttcttccactccatgaacatggattatatttccatttttttttgtatcctcttcagtttctttcatcagtgttttacagtttttgttatatagatatttcacttcattggttaaattgattccaaggtattttatattctttgtagctatcgtaaacaggcttgctttcttgatttctttttcagattcttcactgttggcatatctaaattctaccaatttttatatgatgattttatatcttgcaactttactgaattcagttgtcagtttttacagattttttgtggagtatttagggtttgttttttttttaattttttaagtgtaagatcatgtctgccaggtgcagtggctcacgcctgtaatcccagcactttgggaggccgaggcgggcagatcacctgaggtcaggagtttgagaccagcctggccaacatggcgaaacctcatctctactacaattacaaaaattagccgggtgcagtggcaggcacctgtaatcccagctacttgggaggctgaggcagcagaattgtttgaacctgggaggcagaagttgcagtgagccgtgatcatgccactgtgctccagcctgggtgacagagtgagactctgtctcagaaaaaaaaaagaaaaactaatcagagtaggcaagaatccatgcagcatactaaagtctctcgcctcgttagcaataaggaatttactgctattttagtgctagtctgttctagtcaacttcctcattgcctttgatttgttgatccatttatgcacattccccttctaccttttctctttccatagttaaatgaaatttgttaggaaaagctactctgcctcctatattttataaaatttggatgtagatcataatagaatcccttttagagccagaagtgcatttaaactatcacttattcaagatgattgcccatagaagagggatgcctaaatcatttacaaaaggtagtttacctatgtttaatgatttataggaataggtgttcagctccttcaatggcttgtttcagtatttctcaatgatgtggtgaaattcttactgatgtctctagtaggctgcagaggtgactgaggagaggtgggtaagggaagtgctgttttttttccagaaacaaataggatggggatagtgaaagaaagcaaataggctacaaagaaaatgaactagatttaagttaaaagttgatatgaaatagaagcaggtgaaaaaagtaatggaggcaagacaggactgtgagcttatgtggaaatggagacggagtatggttttatatttattatctgtatctgctatttaatgctaataattgttttctcaagtgcgctaaaagaaaaaaatcataaggattagaaaaggattttttttcctttccattggatagatcttggaagcagtgtatactcagctcaaggtagattctgtacaagaaagcattcaacaaatctaaagcatcgttaggtctgaagctgtgaaatacattgattgatccatactatctgtgagagttttcacatatttgtgtgccttttcagaggagaaagattgaaagagggggtgatgtcgattatcatgacactgagtaagtccccagacaaagcatttgctagcattattgggtgtctttaaaaaaagaaaatcagatacgcagaatagctggccaagtagattatgcagaaattatccatcagtcagtttagcctgtttcaacagttggtttaaaaggaagtcagtcattgttgctttctttctccttttggaatattttctaatttggattttttttgaaatgatagttgagtttcatatagtgattacttaggagctaatataaaatagaaaactggaatagaagatggaatatcagtttcttttgttatttcacaaaattacgtgcatttttacctagcatatgatctacgttactgaaaaaaaaagagctttactcaaaggaaatggtagatactgaaaaagaagcattgttcttaataaagtttcaagtacatgtttcttaagttatttactttatatgattattatatgctatgaaataaagagatgctgtaattattttggttttgttaaaatctaaatgtagtttttccattaagtattttagatatttatgccagaattcaatgtatttagagaatgatgttaataatacacaattaactttgtttccttatttaactattgtgtagatttttttcagatttaaaacctttttgtaatggaaaatttcaaggaaaaaacctaagtaagaagaatagttatcagcctgcttcaataatcatcaactcatggccagtcttttttttatcttgccaattggcttttagattagtgtcacttcagaatgctctgtgattaacatattttaaaataaaaattcttataaatttgattggctagatgaaaccatttccccccccgccccccgcaaaacaattacttagtattgtattctaactttatttaggaaagaccctttggccatgtctcaggtatatagtatttttgaggtagaccatgtgaaaatataatcatattttcttatttttcatcacttcttaaaggcaaagatggttgtacagacttaacaaacttaaatatgattaaaaaaaatacaacaataaccaaagctataaatatacatatcttacctttttttcttttgtctctaagacttgtgtgctaaaggaaattaactctgtttcaacggcattaaaaaaagtacatcgtatgattacatttcactttgttttaacctttgtacccagtgaacaggtgatttaaaaaaaaaaactagacttccttagcaaaagattgactagaagaataatttcttaaagtcatcttttccttttttagtataacaagtaaggctgtttgcctaacctttgtgtttctttcttttttttctttttttgagatgaagtctcgctctgtcattcaggctggagtgcagtggcatgatctcggctcaatgcaacctccacctcctgggttcaagcagttctcctccctgcctcagcctcctgagtagctgggattacaggctcccggcactgcacctggctaatttttgtatttttagtagagatgcggtttcaccatgttggccaggctggtctcaaactcctgacctcaggtgatacccctgcctcagcctcccaaagtgctgggattacaagtgtgagccactgcacccagcctacctttgtgtttcttaattactctttgaaaattttattaaagtattaacaattttacttactgatttagagtttacaatattgaaaatgcatacttttgaaagatatactgttgctaaattaatttatgtttgtcctgatggtattttgtgcttagaagcattcaaactgaggtcaggtgcagagtctgacacctgtaatcccagcactttgagaagctaagatgagagaataatttgaactcaggaatttgagaccagcccggccaacttagcaagaccttgtctctactcaaaataaaaagtaaaaacattagcagggcatggtgttgtgtgcctttagtcccagttacctgggtggctgaggtggggggatggcttgagtttgagcatgcagtgagccatgattgtgctaccacagtctagtctgggtgacaagtggtacctgtcaagaaagaaagacagaaagagggagagggaaagagagagagagagagaagagaagagagaggagggggaggggaaggaggaggaggaggaagggaaggaggcagggagggaggaaaaggaaggaaggaaaggagagagagagaaaagaaaggaggtagggagggattcaaattgtaaagataccaccaagttttgtattctattgagtttcaacgtttttgtttacttattattgtgtgtttttttttttttttttttttttgagatggagtctcgctctgtcacccaggctggagtgtagtggcgcagtctcggctcactgcaagctctgcctcccgggttgacgccattctcctgcctcagcctcccaagtagctgggactacaggcgcccaccatcacgcccagctaatttttttgtatttttagtagagacggggtttcaccatgttagcaaggatggtctcgatctcctgacctcgtgatctgcccgcctcggcctcctaaagtgctgggattacaggcatgagccaccatgcccagcctgtttacttacttttatgacaccatcatcagtggttttactgccaagttataacaggagcaaagtactcaaagcatcaaaaagaccttacacctggacatcatatggcctttagaaagtcagttacttttcttatgctgtaatttctcctctgtaaaatggaatactttataacattagttctcatcttcctacattgaaagaagaaacactgttggtagtcagtaatcaaatttagaatgaattccttccaaaagattaattccactgggcttcagtatccttaatttatgaaaatagatactttcctttcaatttctttgagctcatatacctatacaaattgtagcagcaggaaacacatttgttttactgttgtaattgaagctccaagtgaagataccacttcttctccaacagtgaaacaaaaataaattgaaattccaggttgctttactatgttcatcttttatttggttattttgagattttttttggtagggaaatttctgagtttaggttgtttattctagtagtaggatatgaatgtgtagaaggtgtgtaggggatatgtggatccacaagcttagctggtgattgtgaaaactatagaagttggtatctatgagcgaaagagagtaaatagtgataggttaatcagattttgaaactcaaaatagaaattaatgatcttgggagtgaaaatgtgtgttcaatccagctttttataaaatgtaaatcttgaaagtatttagataagtggcatcttacctattcttttttcagagtttttctctaccctatcaataattgaccttgcctaggcaacaagtgacatgtcattggtatttcttttgattacgtgataaaaatggttattgcttctaattaatttcactattactacttttataggattatgtttgtaatgtttattgtgtttttagagaaatgagcttaatattttacaatgctaaaaaatagcaaaaatttgtgaaatagcaatgttaactaaagcagtaagtaaaagagaacttaagcaaagcatattattaatctaaagccataactaaaaaatcaaattgcactgcaggcctctctactccctagttctgtcagagccacactggatgatttacacgggaaacttctatacagtatttaatttagtcagaaaaacttatggctaaaggatgctttaaaaccacaattctaaaacttatttgtcttttttttttttgagatggagttttgctcttttgcccaggctagagtgaagtggcgcgatctcagcccactgcaacctcttccccactgggttcaagcgattctcctgcctcagcctcccaagtagctgggattacaggtgcccgccaccacgtgtggctaatttttgtacttttagtagagatgggtgttttgtcgtgttgcccaggctggtctcgacctccagacctcaggtgatccacctgcctcagccttccaaagtgctgggattacagacgtgagccaccgagcgcagcctcttatttgtcttttgaaggtataactttaaaaaagtataaatgcatcctcatatatataagtcattaaggattttttggtaatctttgtgatttcttagtaaaataaaatggagagtaaggaaatagaggaatttagggatggagaagagaaagatgtaaaaataagtttgtgctaatggggccaaattttatataggtcaaatagcattttttagtacaaatataaagacttttcagtcacacactgtggttgaatgtctttaagtatcctattaaattaggaccatgacttgtataaaataattggatattttttcctcaatatagtatcaggaatattacgtgcttctgattttaggaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggtaatacaaattactgctgtgtgccaagcatgtatcattcttgctactaaaagtatagtttgaatatcagcagcatcagcatcccctgagaacttgactatactttgagatcagttttcattttaacaaggtccccatctgattcatacgtatattcacatttcagaagaatttatttagaaaacttcattttcatctgctgtttgatgacctagcttttactcttattatttttggtttacttctatttattcattttgcatttcataaagacatgaaaatactcgcatttataaaaatacttgtctataaatatttgcatttataaaagtacttttctataaatgtttgcattgataaaaatacttgtctgtaaattaaaaagtctgtaaatacttgcagttacagacttttaatgcaaacattaaaaggcctcataggtggaggttgcagtagtgagctgagattgcaccactgcattccagcctgggcaacagagcgagactctgtctcaaaaaaaaaaaggcctcatagaccagatccatatatatatttactttccttttccttcctgcttaataaacagctaacctttttacctgttagcattatgatttgaatggctattgtcctgtaattatattgcctaaatttccatttttaaaaattaatttttttattgatacacaattgtacatatttatggggtacatgtgatatttccatgcacgtatgcaatgtataatgatcaaatcgggataattaggatattcatcacctcaaacatttggcattttttttgtgctggaaacatttttttttttttaatttaaaaaaaattttttttttgagacggagtctcgctctgtcgcccaggctggagtgcagtgcccatctcggctcactgcaagctacgcctcccgggttcatgccattctcctgcctcagcctcccaagtagttggcactacaggcgcccgccaccacgcccggctgattttttgtatttttttagtagggacggggtttcaccgtgttagtcaggatggtcttgatcgcctgacctcgtgatccgcctgcctcggcctcccaaagtgctggtattacaggcatgagccaccgcgcccggccttatgctagaaacattttgaatctccttttctggctattttgaaacatacaattaattactgataactatagccaccctagtgttctatcaaacatgagaatttattccttctctcccccacaccaccccatgcccccaactgggcaccaccttctcagcctctggtaaccatcattctactacccccttttttttgtttttttttttttgttttttttgagacggagtttcgctctgtcgcccgggctggagtgcagtggcgcgatctcggctcactggaagctccgcctcccaggttcatgccatgctcctgcctcagcctcctgagtagctgggaccacaggtgcccgccaccacgcctggccaattttttatgtgtttttagtagagacagtgtttcaccgtgttagccaggtgatccgcccccctcggcttcccaaagtgctggtattacaggcgtgagccactgtgcccggccgagatccacttttttaggctcctacagatgagtgagaacatgcaatattaaataagcaatttaagtccctgttgagggcatattgagaatcctctcaatactcagtcatggtggttccctttcatgcccagatggcccttaactaaagattaagcaaagaattaggccccataaatgccaataatgattatagttttagtttcttagacattcctttgctgacaatttagtaacctttttattttagagaagatttctaagatactgtgaagcgttgaagaaaaagtatggcctggccaagatggtgaaaccctgtctctactaaaaacacaaaaattagccaggcatggtagcaggcccctgtaatcccagctactcgggaggctgaggcaggtacttggttgatcccgggaggcggaggttgcagtgagccgagatcatgccactgcactccagcctgggcaacagagcgagactctgtctcaaaaagaaaaaagaaagagtatgatagaaatgccaaaatagtaccaaaatatagttaatcttgtatgggataatgaatgagtaaacagtttaaggatcttatcttaggagtgaaccatatttatatttacatatacgtgtatgtatgtgtacatgtgaaccatatttatatttacatatatgtgtatgtatgtgtgcatgtgttatatgtgtgtgtacacagtatagagaaattaggcaaaagatgtgaaaacacggttacaaatcaaaattttaaataataatcttaaacaatgacataatttgaaagcttctgatatttgatgtctcagaacatagtgatgattcagtgtgaaaaggtctaaggtctagctacttttgagaaactcatgaagttttttttttttttttttgaaggcacacagcaagtttttaagaataatgaaagaagttgggaaaaatagaaataatgaagtgttaataaattctagtcaaaatgtaagatgccagtgaagatatttagaaaatttacttagtcactttgaaatgttgagaaacagagaaataaattttttttcccagctccctccccccactacaacaaattattcttaatgtaatttggatttatgtttgcttttttttttccacttaggaattagatacacttcaacaacaattggattcacagaacatgaaaaaagagagcctggaagcagtaagtataaaatcaaataagggttctcatactactcagctaaaaaagttaattcagccaagtatattaatataactaattcaactacatattgatctggcagcttactaataggagtttaatactttttcttcctattctggacccacaaagatcctagtatggtaagaaattagattcagttattgagtacctactatgtataaaacaaatcattccgccctacctaggacatgcaaaatccaatagcaattaaaaaaattatttttttagagacagagtctttctttgtcactcaggctagagtgcggtgacatgatcgtagctcactgtaaattcaagctcctgggctcaagcgatcctccctcctcaggttcccaagtagctaggacttcaggcaggaaccaccacacctggctaattttttttttactttttgtaaagacagggtctcgttatggctgatgtacagctcctggcctcaagcaatgctcctgccttggcttcccaatgtgctgggattacaggcatgaggcattgtgctcagcctctaatggcaatttaaagacacatacacaagagattataaaaacaaagaaagagggagagacatgagttcatctctttaaggatgtaaaaacttactttttttattcatttatttaaaacgctttatttcacaaaacaaaatgtgcatatggtttaaaaatagttgaacaagaggaaagtaaaaatgtctgtttttttttttttttttttttttttttagacagagtatcgctctgttgcccaggctggagtgcagtggtgcgatctcggctcactgcaagctccgcctcccaggttcacgccattctcctgcctcagcctccagagtagctgggactacaggcacccgccaccacacccagctaatttttttgtatttttagtagagatgggatttcactgtattagccaggatggtctcgatctcctgaccttgtgatccgcccacctcggcctcccaaagtgctgggattataggcgtgagccactgcgcccagccaaaatgtctgttttgtgtccttctttccagatagaactactggaaagacatttatcaagtgcttactgtatgcttttttgagctgtaaacacatatcagcatcatcttcatgtaatccccacaagagtcctaaatcccatcttggttttacagttgtggaaaacctcaagtggggttcctacgtgctatgctagctgcagctttcttttttcaccctaacattgtatctacagtgtctatttatatcagttcctagagaacctcctcattattttaaattgctacaatgtattatgttgtataattataacacagccttgtaaatgaacaggttgtttatagttttccgggattataaacaatactcctgtgaaagcatacattttatgcgaagttatatcataagattgaattctcacaatgggtcaaaaggtatacagtttaaaaatgttgtcagattgccaaattgccttcaaaaaggttgttccaacttttacttctagatgtaatgtatgtgaatgcttatttcccctgcattcactgacagcaaatattatctgacttttccagttttagctattttgataggtaaaaattactaccttatttgaattttcatttatttatgaataaagttgagtatctatttatatcatttttggccaatgaatttctttttctttgaactcctttttcatatttttggcgtttcagtatactgtctgtatctcaaatcttgcctccctttcctgatttcctgtggattcaggtagacatcatgatgacagtattaggaactgttgtagactgatagattgctgacaccctagcttgcaaaagaaatgagtattttgtaattaattcttttgagaatttgctattgaaaaagttatttaattaaaaatagtaaggtagttggctgggcgtggtggctcacgcctgtaatcccagcactttgggaggccaaggcaggcagatcacaaggtcaggagatcgagaccatccttgctaacgtggtgaaaacccgtctttactaaaaatacaaaaaattagtcgggcatggtggcaagcacctgtagtcccagctgctcgggaggctgaggcagaagaatggcatgaacccaggaggcagagcttgcagtgagccaagatcacgccactgcactccagcctgggcgacggagcaagattctgtctaaaaaaagtaaaaaaaaagcaggtagttttctgtgtctggttgtccatctataaagacacttaatttttatttccttggatctctggtgatggaaatacgcttaaagaaagaaggaccacatttagtattaatacaaccagcttgcagaattcctcatggttcttttttggagtgggtttgagagagtcaagtcttacttcacttggtgaatttggtttccataggaaaaatcataagctataaccttagatttactttttgtactgatgccgttcttctctgatgtcagtacatttatgcctaaaataacaagagttttaaaaatacacaatatgtgcaaattaagataacatgtcactaattctatttaacttttgccagatttctttctttttaaaaaaaaaaatttttttgagacagagtcttgctctgttgcccaggctaaagtgcagtggcacagtcttggctcactgcaacctccgccttctgagttcaagcaattctcctgcctcagcctcccgagtagtgggattacaagcgtgcatcaccatgcccggctaatttttgtatttttagtagagacagggtttcactgtgttggccaggctggtcttgaactcctgaccttgtgatccacccgccttggcctcccaaagtgctgagattacaggcgtgagctatcacgcccagcccagatttcttttatttatttgtttaggacttgttcttcaagaaaatacctgtcagatagtggtcaatcaactagtattttttgaatactttatgttcactgctgtacaacgtattaggtcatgcttattcagttcacaagagtggaaaaaatcaggtgaaggattaacatgagcttaagtcttccagaacaattttatcaagatgaaattcaaacaaatctataggattgttaggcaaaaaggagacgatactatgaaaaaggatagcataaaatatctgcatttcttctatgtctttttagcatggctttttttaatcttatctgatgcctaatctgttacttgaactgtatatataatccattgcttatggactttgaaaaattatctcgtctactcgttccttttttggaggttccttctttcatacttttagaagagaagaggttggccaggcacagtggctcacacctgtaatcccagcactttgggaggctgagatgggcggatcacgaggtcaggagttttgagaccagcatggccaacatggtgaaaccccatctctactaaaaatacaaaaattagctgggcgtggtggcaggcgcctataatcccagctacttgggaggctgaggcaggagaatcgcttgaacctgggaggcggagtttgcagtgagccaagatcgcaccactgcactccagcctgggtgaaagagcgaaattccatctcaaaaaagaaaaaaaaatgaggtcttcccttctaagaattttattttgttcaagttgtaggtccggtttcaaatgtcactgttaactcttatgtctttgttaactttgaaaagttatttacatgtcagatccttagttttctcatctgtaaaatagagatgatagtactatcttgtagagtatcactttggatagtagagatagcatataaataacatgtagtatagtgcctggcacagaacagatgctcagtaaacaagagtctcaaatgtcattttaatcatcaccaacaccattcctaccttttttttggtgttgttagctaataacatttttgtcacatccttatttttttctttgtgaaaggtgggatagtggtgagtacacagtaactgttatttcatgtgttcatttcctagtgctgctataatagaatatcacaaactgggtggcttaaaagaaacacaaattttctcacagttccagagcctggaagtctgaaatcacggtgtcagcagagccatgcttcctctgagactctagacagaatcttgctctgcttcttcctagcttctagtggtatccattagctcttgatattgcttgacttgcagctgcatcactccagtctttgcctgagtcataacatggtattctccctgtgtgtctctgttgtgtctgtactcttcttataaagggcaccatcatattggattagggcccacccctaatgaccatatcttaacttgactaaatatgcaaagagcttatttccaaataaaggtcaaattgacaggtttatgatgttaagactccagcttacctttttgagcagacacaattcaacccacaaaattgtgggaaaatatatgttatgacctatttagggaaaaatatcttctctccaaagatcacttctatggactttgaatcagacattgtgtttaaagttgtacatatgttttgacattgtctttatcctcccattggtagagttgtcctatacttattcaggtcttatatgtagaaaataaaataaactaaggctatcaacttcttgtgaatcttagactgaaaatagcaggatttatttttattcttccaatttaggaatgtgctttgtagcattattgagtactaatgatatttgctgtctgtatttaaagatgctagtagtttaaatttacccccattcttataaactgaaacctattttagaataattattgataaaatactaattaaaactttcccttcttattttcctttaggaaatagctcactcccaggtgaaacaggaggcggtattgctgcatgaaaaactttatgagttggagtcccatcgagatcaaatgattgcagaagacaaaagcataggatctccaatggaagagagagagaaattacttaagcaggtgggcaaaacaaacatacttattttaagatgtctggttttggtacatgtattgatttgttttttttaaagggatattaatgcaagtagtaaagctagtaagtgtattgtctaaaaatagtttatgtgaagaaatgactttttaatctagattttcttcctcttttattattattattattattatttttgatgtaggatcttgctctgtaacccaggctggagcacagtggtgcaatcatagctcactgtagccctgagctgctggcctcaagtgatcctccacctcagcctcccgagtagctgggactgcaggcatgtgccaacacaccaattttttatttttattttttgtagagatagggttttactgtgttgcctgggctggtctccagctcctggcctcaagcagtcctcccatttcagcctctccaagtgttgggactataggcacccagcctagattttcttaatcaagtatttcatagtaacttaggtgaagctaacttttccttattaggaatacttgaaactcttctttattggtcattaaatatttagataatctttttgaagatatgtttcattattgttttgggccttgtatttagaaaatggagtatcccaaggctaatgactttttgtggttgttattatcagtgcctccatgaagagaatggaattaaaatgtcctgtgaaattatcgtatgtcctaaagtcatgacacatgtaacatgtatttagtagctttcttactaccccaggggtggatttagtttagctccaaattataattagcatgttgtttatcctgacacatcctaactataagggccttaggagaacttcatatgtatatgggcacagctccagtcagggactcctttgcccttagacttagatcaagcccagtgcatttagaagaaatgtaggtatcaattcagggactatttaattattagaatcatttcaaaaaggtattaaatctagaacctgtgtagttccttggagagaaatcattgaaagatggggaggagtgatcttgaggtacgcctaccacataaaatatagaatggctgcttaaatttgaatttcagataagcaataaataatctttcagatatatatatgtatatggaaaaattatttattgcttgtcaatgatatggatattccaaatattacatggtacatatatcctctcaaaggtattcactatttatctgaaattcagatttaactgggcttgctcaatctagcaaccctaccttgtgggaaactgaggggaatctcagaaatcctagatgtttatatcaacttatccaggcctgaagatgagctatcctcatggtgcctggagggtagctgtgagtatatcagttactacccttactttgaggaaaaaggatggaatctgtgaatggttccttggtgctgttccctttaacttcaaaggttgaaatctaaaaaatagatttcaagaaagagagtagatttgacactttagtacaattgtactctagaaggaaattatctttaagatagccttacaatgagttatttttttaaatactactttctttttatgcctttgtagattaaagatgataatcaggaaatagccagcatggaaagacagtaagtatctttatactaggacattttacatccatttctcactttaaaaattacattctaaaggtacaggagtggctttcattctttcaattttacttatagctttaaatatttctttgagtgtttaagagccattgcatagtataatttttttataagtatctttattaagatatactttataccatataatagacatatttaatgtaaacaatttaaaacattttagtatattcacagaagtgtgcagccatcacctagatcacctttatttttcaatttttatttatttttatctttttgagaccaggtctcattctgctgcccagactggagtgcaagtggcatgatatagctcactgtaacctcaaactcctgggctcaaacctcccaagtagccaggactacaggcacacaccaccatatctggctaatttatttttatttttagtagagtcgagatcttgctatgtggcccaggctagtctccagctcctagcctcaagtgatcctcccatctcagcttcccaaagagctgggattaaagatgtgagccagtatgccatgcccccagtcaattttagaactattcagtcagcccaataaaaccctgcaccctttaaccatcacctcccttatccctctcccagctctagccatgcccattctggacatttcatatatatggaatcattcaatatgtgcttctgtgtgtcaggatgctttcacttagcacagtgagccttgctttctcgaagatcagctgactattggtatttggctttatttctgggttctctgttctgttccaaggctcataggtgagccttgaaaactaagacaaatggaatattatttggaaataaaaattaataaaatactaagcatgtattagtttttattaatactaatacatgcttagtattttattaatttttatttccaaatagtattccattgtatggatataccatattttatttatttatcaattaatggatgtatgggctgttaccatttttttattatcatgagtcatgctcctataaacatccatgtacaagtttttgtgtgggcatatgttttcacttctcttgtatatatacctaggagtggaattgctgactcatgactatgtttaactttttgaagaactaccagactgttttccaaaacagctttaccattttacatttcatttatttgtatttgaatacatttatttgaaatttgtaaaacaatcattttactaccagtcaccagaaagcataccaattgttttaatttaatttttttttttttttctgatacagagtcccagtttgtcgcccaggctggaatgcagtggtgcaatcttggctcactgcaacctccacatcctgggttcaagggattctcatgcctcagcctcccgagtagctgggactacaggcacacagcaccatacccggctaagattgttttaattttaatcaactaagttgtaaattaataagtagtcaacaatgacgaaattgccttttaatgtctctcatattctattgtaatgtttttgttgctgattacaacttatgaaattaaattttggaatcacagtctctagtatcagctgaattgcagcccgtgtcaagtgttttgcaatactggctaaggtactaagaaactaattttttttttctgttttttgtaactgtaagcaaatttctatattcttatggctaagagaatatttttttcttttaggaacatttaaagcagctttattttatcttttttatttcttttttttttttttctttttttttgagacagagtctccctctgttgcccaggctggggtgcagcagcccaatctcggctcactgcaagctcctcctcccaggttcatgccattctcctgcctcagcctccccagtagctgggactacaggcgcccgccactgcgcctggctaattttttgtatttttagtagagacggggtttcactgtgttagccaggatggtctcgatctcctgacctcgtgatctgcccgcctcggcctcccaaagtgctgggtttacaggcgtgacctaccgcgcctggcctatcttttttacttcagtagtttttggggaacaggtggtatttggttacatggataatttcttgagtggtgatttctgagattttgatgcatccatcaaccaagcagtgtccactctacccactgtgtagtgttttatccctcacccacctctcactcttcccaccaagtccccggagtccattgtatcattcttatgcctttacgtcctcatagcttagctcccacttataaatgagaacatacaatgtttggttttccattcctgagtttcttcacttagaataactgtctccaactctgtctaggttgctgtgaatgccattattttgttcctttttatggctgagtagaataaacatatatatatgtatgtatatgtataaatatatatgtatgtatatgtataaatatatacgcacacacacatacataccacattttctttattcacttgttgattgttggctttttggctgtttccatatttttccagttgcaaattgtactgctgtcaacatgcgtgtgcaagtgtcttttcatataatgacttctatttcctctggatagatacctcgtagtgggatcgctagatcaaatggtagacctacttttagttctttaaggaatctccatactgttttccatagtggttgtactactttatatttccacaagcagtgtaaaagtgttcccttttcaccacatccacaccaacatctatttttaaaaattttttaattatggccattcttgcaggagtaaggtggtattgcattgtggttttgatttgcatttccctgataatgatgttgagcatcatttcctatgattgttgaccatttgtatatcttcttttgagagtcatctattcatgtccttagcccacttttcacttttttatgggatttttttttcttgctgatttgtttgaacttgttgtagattctagatattagccctttgtcagatgcacagtttaggaaagttttctccaactctgtgggttgtctattaactctgctgattcttttgtggtgcagaagttttttagtttaattaagtcccatctatttatctttgtttttgttgcatttgcttttaggttctttcagttcatgaagtctttgcttatgccgatgtctagaagagtttttctgatgttatcttctagaatttgtatgggtttaggtcttagatttaagtctctgattcaccttgaattgatttttgtataagatgagagatgaggatccagtttcattctcctacttgtggcttgccaattatcccagcaccatttgttgaatagggtgtcctttccccaccttatgttttttttgctttttcgaagatcagctgactgtcagtatttggttttatttctgggttctctattctgtgccattggtccatgtacatgtttttatgccaatacaatactgttttggtgacctcatagtccttatagtgtagtttgaagttggttaatgtgatgtctccagctttgttctttttgcttagtcttgctttggctatgcaggctcgctttgggttccatatgaattttggatttttttttctagttctgtgaagaatgatgatggtgaaatgggaattgcattgaacttgtagattgcttttggcagtatggtcattttcacaatattgattctagccatccatgagcatggaatatgtttccatttgtttttgtcatctatgatttctttcggcagtgttttgtagttttccttgtagaggtctttcaccttttgggttaggcatattcccaagtattgtattgtattatattttgttttattttattttattttcacagctgttgtgaaaggagttgagttcttgatttcttttttttttttttgagacagcgtcttgctctgtcgcccaggctggtgtgtagtggcgcaatcttggctcactgcaacctccgcctcccgggttcaagcaattcttctgcctcagcctcccgagtagctgggactaaaggcacgtgccaccacaccggctacttttttgtatttttagtagagacggggtttcactgtgttagccaggatggtcttgacctgaccttgtgatctgcctacctcggcctcccaaagtgctgggattacaggcatgagccaccgcgcccgaccgagttcttgatttcttttcagcttggttgctgttggtatatagcggtgctactgatttgtgtacattgattttgtgtcctgaaactactgaatttatttataagatctaggagttttctggttgagtcttcagggtttcctagttatatgatcatatcaagagcagacagtgacagtttgacttcctctttactgatgtagatgccctttattcatttcttttttctgattgctctagctaggacttctagtgctgtgttgaatagaagtggtgagagtgggcatccttgtcttgttccagttcttagggggaatgctttcaactttcccctgttcagtataatgttggctgtgggtttgtcatagatagcttttattaccttaagatatgtctcttctgtgctgattttgctgagggttttaatcataaaaggatgctggattttgtcaaatgctttttctgcatctattgagatgatcatatgagttttgtttttaattccgtttatgtggtgtatcacgtttattgacttgtgtatgttcactcatccctgcatctctgctataaaacccacttgatcatggaggatctttttgatatgctgctggatttggttggctaatttttttttgaggatttttgcctctaagttcattagggatgttggtccatagttttcttttttttgttatgttcattcctggttttggtattagggtgatactggcttcatagaatgatttaaggaagattccctctttctctatcttttggaatagtttcagtaagatcagcagcagaggctgccatctcccccattgaacataacttctttggcctgaaaccaccccttccatcacccacattggccatagccagccccatacaagaggagtctgagctgagacacgcctaaccctgccccgacctgatggtctttctctacccgcctcgtagccaaagacaaaagacataaacttgtggcaggcctatggcctcaccaatcacctgagaaacccaaatatttattcaggtgaccttagggcaagcttgtatccccccatactactgcagctgatgccctcttgaaagtgccacctcctagctggaggccaaccaacacaaaccattacagcaattcataacagaacaatcctgctccaagggaaggagaaaacaacagctaattccactgcctgtaacatccacactaaccagaggccctgactctgttcacatgacagcttcactgccagcataaccagcattcaagaaaaccagtgcacgaaacaaaactacaaccaagaactctcacagaatccacttcactcttcagctacctccaccagagcaggtgctggtatccacagctgagaccctaaagacagatcacttcgcaggactcttcgcagaccctcccaagtacaagcccagagcccggtagctctggtgggtggctagacccagaacagcaataacaatcactgcagtctggctctcaggaagccccatctctagggaaagggagagagcaccacatcaagggatcacctcatgggacaaacgaatctgaacagcagtccttgagtctcagatctttcttctgtcatagtctacccaaatgagaaggaaccagtaaaacaattctggtaatatgagaagacaaggttctgtaacatccccagaagatcacactagtaccagcagtggatccaaaccaagaagaaatctctgaattgacagaaaaagaattcagaaggtcagttattaagttactgaaggagccagcagagaaaggtgaaaaccaacttaaagaaatttaaaatacaggatatggatgaaaaaaatctccagagaaatatgtagcataaataaaaaaacagtcacaacttctggaaatgaaagacacactttgagaaatgcaaaatacattggaaagtttcaacgatagaatcaaacaagcagaagaaagaacttcagagctctaagacaaggctttcagaataacccaatccaacaaagaccaaaaaagaattaaaaaaaaaaaaaagcacaaaggctccaaacagtttgagattctgttaaatggccaaacctaagaataatgggtgttcctgaggaagaagacaaacctgtaagtttggaaaatgtatttgagggaataatcaaggaaaacttccctggccttgctagagatgtagacatccaaatataagaatgtcatggctgagcacggtggctcacacctgtaatcccagcactttgggaggccgaggtgggcggaacatgaggtcaggagttcaagagcagcctggccaataaggtaaaaccttgtctctactaaaaatacaaaaatccgctgggcatggtggcacgcacctgtagtcccagcaacttgggaggctaaggcagaaaaatcacttgaacctgggaggtggaggttgcagtgagctaagatcatgccactgcattccatcctgggtgacagagtgagactccatctccaaaaaaaaaaaaaaaaaaaagaaaagaaaagaaagaatgtcaaagattacaactgggaaatgcatcacaaaaagatcatcacttaggcatagtcataagattatctaaagtcaagacagaggaaagaatcttaagagctatgaggcaaaagcatcaggtaacctataaaggaaaacctatcagatcaatagcagatttcttagcagaaaccctacaagctagaaggaattggagtcctacctttagactccttaaaataattatcagccaagaattttgtatccattgaaactaagcttcataaatgaagcaaagataaagtcattttcagagaaatgctgagagaattcaccactaccaaggcagcactacaagagcagttaaagggagttctaaatcttgaaacaaaacctcaaaatacaccaaagtagaaactccttaaatcataaatctcacagggcctataaaacaacacaatggaaatgaaaaactaaggtattcaggcaataactagcacaatgaatagaacaataccacatatctcaatactaacattgaatataaacagcccaaatgctccacttaaatatacagaataacggaatggataagaattcaccaaccaagtatctcccatcttcaagtgactcacctaatgcataaggtctcacataaacttaaggtaaaagggtggaaaaagttattccatgcaaatggtcccaaaagcaagtaggagtagctattcttatattagacaaaacagactttaacaacaattgaaaaagacaaagaaggacattatgtaatgataaaaggactaatcaaacaggaaaatatcacagtactaaatctatatgcacctaacactagagctcccaaatgtaaaaaacaattaccactagacctaacaaatgagatagacagcaatacaattaatagtgggggacttcaatactccattgacagcactagacgggtcagaaagtcaacaaagaaacaatggatttaaattataccctagaacaaatggactcaacagatatttatagaacattctacccaacaactgcagaatatacattctgttcatcagcacatgggacgtcctgcaagacagaccatatgataggccacaaaacaagtctcaataaatttaagaaaatcaaaattatatcaagtattctcagaccacagtggaataaaactggaaatcaactccaaaaggaaccttaaaaaccatgcagatacatggaaattaaataatttgctcctgaatgatctttaggtcaacaatgaaatcaagatggaaatttaaaaattctttgaactgaacaataataatgacacaacctattaaaacctctgggatacagcaaaagcagtgcctagaggaacattcagagcattaagtgcctacatcaaaaagtctgaaagaacacaaatagacaatctaacgttacacctcaaggaactagagcaacaagcacaaacaaaacccaaacccaccaaaagaaaaggaaattacaaacatcagagcagaactaaattaaattgaaacaaaaaattgaaagataaatgaagcaaaaagctggttctttgaaaagataaacaaaattgatagaccaatagcaagattaatcaagaaaagaagagaaaagatccaaataagctcaattagaaacaaaatgggagatactacaaccaataccacagaaatacaaaagaccaagcttacagtgagcacctttacacgcacaaactagaaaacttagaggagacggatagattcctggaaatatacaatcctagattaaagtaggaagaaatagaaactctgaacagaccattaacgagcagtgagattgaaatggttaaaaaaaaaaaattgccaacaaaaagtccaggaccagatggagccacagctgaattctatcagactttcaaagaattggtactgttttacatttctatgtaatataataagagcagcatatgagcagcatgtgagggttccagtttttcacatcctcacttgttattatctctttttctattatagccattcctaatgggtatgaagcggtgtctcactatggttttgatttgtatttgtttgatggctaatgatgttgaggttcctttcatatgcttattggccatattctttgggggaaatgtttacttagttcatttgctcattttttaaactagattgtttttgattactgagttgtaacatttccttatatatgctagatagaggtgtcatcagatacatgatttgtaaaaattttcccttgttctatgaattctatgaattatcttttcattttcttggtgtctttggaagcataaaagtttccaattttgattttgtccagtttttctatttttcttttgttgctcttgcttttagtgtcatatctaagaaaccaatgcctaatccaaggtcataaagactatgtctatgttttcttctaagagtttggtaatttagttcttacattgagatctttgatccatttcaagttaattctgtgtatgatgtgaggtaggagtcccttagcttctgcatatgcacttttcccagcaccatttattgaaaatactcttctttccccatttaattaccttagcacccttatcaaaaatcggttagctatagatatatggtcatatttctggactcacaattttagtccattgatatatatgtctatccctatgcctatactacattgttttgttatggtagctttagagtaagtataactgctttatgttaaaatattaacctatataatcttctgccagtggtaggttttcccttattttctcatttttgagactaattttccaacttaatttggcttatagaaacctacaaaaagtattgttaaatatttttcattttcttaatactgcaaatcaaactcaaaggaaagttgggagggggtgtgctgtttaactcaggcaactagtgttctcagaatatacctgggctccaaatatgaatcagtaaaaaagatctatgcttggcgcagtggctcgcgcctgtaatcccagcactttgggaggctgaggcaggtggatctcgaggtcaagagatcgagaccatcatggccaacatggtgaaaccccgtctctactaaaaatacaaaaattagctgggcatggaggcgcgtgcctctagtcccagctattcgggaggctgaggcaggagaatcgctttttcccgggaggcagagattgcagtgagccgagatcgcaccactgaacttcagcctggtggcagagcgagaccccgtctcaaagaaaaaaaaaaaaagatctagacaagattcttcctctctaaatttatagtattgtcctcataataggatatgctatttttcgatatttatgcaatttgtaaaagatatcctaatgtcatcgtcagttatagtattgtccttagaataagacatattatttttagatattgtttatgcaacttggaaaagatatctaacctccccatcaattgtttttattgaatgtctatatttccttcataaattcattaaaaatattttcaacaggttaacagatacaaaagaaaagataaatcagtttattgaagaaattagacaacttgacatggatttagaggaacaccaaggtatgcttctggtatttttataatgtagattaacagatgtttagcagtattaatatagtgttaactggtgtctcagagactgttcaactacctgggatttattatttaattctctatgatattactaactttactaaaatatatactgtatgagtaatattaaagcaatgatttaaactgaccacttatgagttaaaatgattgcataaaatttatttagctttgccaagcagtttgtttttttttttacaaaaacagaagtaaaatgtttaaagttgttagagattcctaagttatacttcctcctaagttacacttccttcctagtaatagtcaatagtttactataaacaatatagtcggccgggtgtggtggctcacgcctgtaatcccagcattttgggaagctgaggcgggcagatcatcggaggtcgggagttcgagaccagcctgaccaacatggagaaaccacatctctactaaaaatacaaaaattagccgggcgtggtggcacaggcctgtaatcccagctattcggaaaggctgaggcaggagaatcacttgaactcggaggcagaggttgcggtgagtcaagatcgcaccactgcactccatcctgggccacaagagtgaaactcggtctcaataaataaataaattaattaaataataataatatagtcaactactaatggcagtaactggtagcgttagaggggatgaaaatcaaatcacaaataccacacaaataatccagacagaattaattccccacccaggtctagtaatgaagtagcaaagactgattaaccttatcctccccaactttccccaggagtggaatttgaagaactaatgcaggtaccagaacacctgagggagcttggggtttgactatgtagaaatactgtggtgggggtttgggtgtgggggctacattgttatttatggttaaaggaggaggttgagcatcagtttcctaacaagcttctccctaataagaaagataaaagtagattctccatagcattttaatcatagtttaactgcaaaccagttactatgctcttggattatcaagaattgattgtatattcttatgagttaggtatggtataaacagtgtgcacatgtacatgtattcttgttatggctaaggaaacattcatagcggtgcagtggctcaatcacagctcactgcaacctcagactcttgggttcaagtgatcctcctgtctcagcctcctgagtagctgggaatatataacgtctgccactacatccagctaagttttaaatttttagtagtggcgcatgcctgtaatctcagctacttgggaggctgaggcaggagaatggcttgaacccaggaggcggaggttgcagtgagccaagatcacaccactgcactccagcctgggtgacagagcaagactccgtctcaaaaaaaaaaaaaaaaaagggtacactgttctatattttagcagggaaggaatttgtgtatgtgtgtgctaactagaaacaatgagaaatagctctaatgaaagttatatggtcagaatttggctacaagctctgcatcattagtaaagcggagtattattggcagatgtcatgctactttccaaaaagcctgaacccatcctgatttctcctttcttagttgaaatgccaacaattgcatatttgcttaattattgctttttaaaatattggctctgtataagcaagggaaagtaatagaaaaagtattgttcttccaagtaaagcagaacacaccaagtggacaatagcagcttatattttcactcaacatgggatactatttttaataaggatgtttttatcctcaaggcttacttctaacatatagccaagtgacttttttgtttttaaatggagatgaatcttgctgtgttggccaggctagagtgcagtgactatttacaggcatgatcatagcttactgtggccttgaactcctgggctcaagcagtcctactgcctcagccttccaagtagccgggactacaggtccatgttactgtgcccagcttgtttttgttaaggaatctgttaagaaattcttttaggtcgtgtgcggtggctcacgcctgtagtcccagcactttgggatgccgaggtgggcggatcaccaggtcaggagatcgagaccacggtgaaaccctgtctctactaaaaaatacaaaaaattagccgggcctggtggtgggcgcctgtagtcccagctactcaggaggctgaggcaggagaatggtgtgaacccaggaggcggaacttgcagtgagccaagatcgcgcctctatgctccagcctgggtgacagagcgagactccgtcttaaaaaaaaaaaagaaattcttttattcttactacagattaatacttgagagtttatatcttatattgaagtccttcagagtaaatagtttcttcgaccacttagctgaaatcaggcccttaactttactcatttttttttttttttttaatgagatagggtctttctgtcacccaggctggagtacagtggtgtgacaacatagctcactgcagcctcaaactcctgggctcaagtgatcctcttgccttagctaaataaaataataaataaaataaaataaaataaaataaaataaaataaaataaaataaaataaataaaataaaatgtaaaataaaataaaataaaatgtaaaataaactcctgagtagctaggactacaggtgcacaccaccatgcccagctaattgttgaaaactttttttgtagggacagggttttgctctgttgcccaggctgatctcaacgtgcttggctctagcagtctttctgccttggcctcctaaagtgtggggattacaggtgtgagccactgtgcctggtgttttactctttactagtgtattcccttacattgaataaattctataaagaacagcattactattataagacatgtcaaagccttacacaaatcacaaaaaaagtgatcagttttctatgcaaaaatactgagccttttgaaatcagggtagttctcagcttcacccaatgctggcttagatttcaactttctcaagtctgctaggtcagttaccagttctccatctcctttcagcttccaaaatgttattgctgttgtctcctatttctatatgctgggggtttctacctttaaaaattctttttgctatagttttagtggggtttgcgggaggatcaaaattagatgtgcatgttcaacgtgccattcataccaggaaatgacaattataagccttaattacctagaatttctgaaactttaagcaccttgaaggtagatcattttacttatttttaaaaagattttttttgtgtgttttgccttaaatgaccatcctcatgctttcattaactgggcaattagcctcagcttataggaggtcatccttttcagcttaaaaaaaaagtgtcctggccgggtgcagtggctcacgcctgtaatcccagcactttgggaggctgaggcaggcggatcatgaggtcaggagttcgagaccagcctgaccaacatggtgaaaccccatctctattaaaaatacaaaaattagctaggcatggtggtgtgtacctgtaatcccagctactcaggaggctgaagtaggagaatcgcttgaactcgggaggcagaggttgcagtaagccaagatcgcgccactgcactccagccttgggcgacagagcaagactccatctcaagaaaaaaaagaaaaaaaaaagtcttttaaactacttaaaattattttaaagattcagattaattttttaaaattgtaattttaaatatgaatctggcatgtatttaacatgaaaaatgcaagcagaaaagtatataaagtaaaatgtcatctcctttctcctcatccaagtcttcagaggtaatcatggtttacagtttaatgtttaggcttttagacttttaatacattgataaacatatttttaaatggagtaatactaatatacagttcttctgagcttgagtcttttcatttaactgtataatatacattcttccctatgaggatgtatacttcattctgagaaatggtatagcatagtggtcaatgttagggctctaaagtcagacttaagaatggtgcctggtacaggtgtggtggctcatgcctataatcctagcactttgggaggctgaggggggtggattgcttgagctcagaagttcgagaccagcctgggcaacagggcgaaaacctgtctctacaaaaaaatacaaaaattagccaggcatggtgatgtgtgtttgacttgtagtcccagctatttgctaaggtaggatgattacttgaacctcggaagtcgaggctgcagtaagccgaaatcactccaaccaaaatcatgccactgcacttcagcctggataacaaagtgagaccctgtctcaaaaaaaaaaaaaaaaaaaaatggtgcctggtgcacattaagcgcttctgacaaccattagctacccctatgattgttgttacataggattcattgtatccacattgatatttaggctgtttctaattttttactcccaagaacagtgctgcactagtacattcatgtttataacttgtctgtttatttccacagaataaatttctagaagtgaaattttgaatggaatattatttatatttacaactggtttgcaaatttcttcccagaaaaggttgtattatgttatacaaccaaaagcagtatgtgaaggtggttccttaccaatgctagccataagttttttagtttttgtcagtcaagataaggtacacatcactgacagttccgaagttttgactgttaggcctgaatttgtagtaccaccgcgatccacaagatggggctaattttctgagcatctattaatatatacacagtaggattgacaaatagagttaacaaatgttgtacggtcactgtcatatgtctctccaggagggattattgggcattattactcaccaaaaatgattactttccagattcaagtattttcccaaatgtggagttgattgtaaaaccaaatatatgattattaaaataccataatacatataaataactagttgctacaatgtggtaaatatgtcataatagaaatatatgcaaagtgctataggaatattgaattactgtcttaaattctgaatgaattcattgtaactttctgcataatatatatgtgtcattcaaagtagtaaaataacaaaatataatactttggtttgtctatagtatactttttcatactcagagttctaaagccttggttaggaccattgtttctttaattatggagggtaaaataaacaatgttaaagacagaatacttttatttattatttatttgtttatttatttatgtattttgagacggagtttttctcttgtggcccaggctggagtaaaatggtgtgatcttgacttaccgcaacctccacctctcaggttcaaacaattctcctacctcagcctcccaagtagctgggattacaggcatgcgccaccacacctggctaattttttgtatttttagtagagatggggtttctccatgttggtcaggctggtctcaaactcctgacctcaggtgatctgcctgccttggcctcccaaagtgttgggattacaggcgtgagccaccacgcctggccagaatcattttattttaagcacatgtcctgttactagaatgcctggattcaaatccaggctgtgctgtttgatcttggacatgctatttatgctatttaatcttactttatcttagttttttttctttaaaatggaggtaattacagtacctacctcttagggttattgtgagaattagattagataattaaataaacttaattattaatagtctaatgttggctggaagccttaccaataacataaatggtaaacatatataaacacaaaacacattcataatagcagtcaatttaaaatatgctcataaatattaattagtgacttattgttaatgctgttactttataaaagcaaaattgaataactttactgcagttattttcccaaagcatacattagaaagtattttcccgtcagtatttccttcaggatgtacaaaataacctatttagtttcaaagtggtttatcttctggtatctgagatttcaaatggcatctatccattactattctgtggttttccaacatatatctgctgaagaagaatgaattattattgttcaatctagaaattgtttaaactatacattgaatctttcattaaaatggtggtattacatctacaccaggatcatcaccaccatctgaaacttgttagaaatgcaaattcttgggctctaccccagacctattgaatttgaaaccctaaggagagggctcagcaatttgtgtttcagtaagtcctcctggtgattctgattcatgttaaagttttataaccactactttcgaaaatgattaaggaccatatgtttagtatatgctgcttactaccaattatactgtatgattttatatacagtactctgttggaacaaacttctacatagtccttttgttttacataattagataataaaaattatacaatttatacaatatgtaaaaattataattacagtttttaaagtgcctcctgtctttagaaatagaattatctgatcttgtttgcatacctgtaatttaaaatttaaaatgtagttgacccttcaagacagcattgggattaggggcactgagtgtgccatgcagtcaaaaatccatgtataacttttgactccataaaaacttaattatcaaaggtctactgttggctggaagccttaccaataacataaacagttaacactattttgtatgtattatatactgtattcttacaataaagtaagctagagaaaagaaaatgttattaagagaactataaagatttttattattttccacttactaatgaaatggaagtaggtcattataaaggtcttcatcctcattgtcttcacattgagtagactgaggaagaggaggaagagtttggtcttgctatctcaggggtagcagaggcagaagaaaatctgcatgtaagtagacccaccaagttcaaacctctgtttttcaagggtcaactgtatttcccagagaatgtatatttagaaaattgggtgaaacctaatgccaaagttagtttaaaacattaagcttatatgtactctttttaccacagcaattttgtaatatagtcaattctttgtacccacgggttcttcatctgcagatcctaccaactatggatggaaaatacttgaaaaaaatacaggaagtttcaaaaagcaagtttgaacctgccatgtgctaagcactatgctgaatccatttgaactgaagaataccctgctatagcctcccattgtttcacagatcttcagtctctctctagcacccactgtttgagcagtgttcatctggcattttattcattggctacttgtgttcactctttgcttctgtgaaaaaaaaaagactcctaaaaatcaattatatggtgaaagaaatcccttacagactaagagagagcgtaaagtgctgtctctcaacaagaaaataaaattcttagatcttttgaaaagtggcgtgtgatttaccaaagtgacacaataaaacagaaggaagctgaagctgacatttgtggaagttttagtgctgcccctacaatggcaaaaaaaattattgctgtgattcatgataaaatgcttgcagagactggtcgggcacagtggctcacgcctgtaatcccagcactttgggaggctgaggcgggtgaattacctgaggtcaggattcaggaccagcctggcccaaatggtgaaaccccgtctctactaaaaaatacaaaaacttagccggtagtggtggtgggcacctgtaatcccagctactagggaggctgagacaggagaattgattgaacctgggaggcagaggttgcagtgagccaagatcgtgccattgcactccagcctgggcagcaagagtgaaatcccatctcaaaaaaaaaaaaaaaaaaagcttgcagagactaagaaaacatcaaatgtatgagtagacaaaatatcacagaagcatgtccctgttgatggcaaaattatgtatgaaaaagcatttagcctttgtgagcattcctatgaggaagttgaagagagtgagaggaaggaatttaaggatagtaagggatgactagctagctgtggaaagtagtacagccacacgaacttaaagatcacaggagaatcagcattagctgatgaccaggcagtatcagcattcccagaagagctcaagaaactcagaagacaaaggatacctttcatagcaagtcttcagttgtgttgaaagaaacttgttatagaagaagaggcctaatacctacatccgtaagagtgtcaagcaggctttggggttcaaagcctggaaagatcgttttactctggtgctatgtggcaacacagcaggttacatggtcaagccaggtcttgtgtaccaagcaaacagtccctgggtccttaagaacaaaatcaaaaattgcctacctgtgttctggcaacacaataggaaggcttgggtgatggccatcttgttcctggaattcagttttattcctaaaatgaagaaatacctggaagagaacagggtgccattcaaggtcatcctcataattgacattactcacagccatccctgatctctctacttcactaatgacaatgttgcagtgatgttcttgcctaaggcaagtactacctcactgttttagccatttgatcgaggcatcagcaagtgcattaaatgacttacacccacctcacctttgggaggatttgtgctgtccttgatgctaaccttgactacagtgtcatggatttatggaagagctttacaattgcaaatgtagttgtgctttttacagaggctgtagatgccccaaagcccaagacagtcagtgcatgttggaagccattatggaatgaggtagtcagtgatttcaggagcttccccattattggtgcagaagtcaggaatatggttttgtttttgtttttgttttttttgagttagagtctcactctgtcacccaggctggagtgcaatggcgcgattttagctcactgcaacctctgcctcctgggttcaagcagttctcacgcctcagcctcctgagtagctggaattacaggcacatgccaccacgcctggctaatttttgtatttttagtagagatgggtttcaccatattgcccaggctgctctcttggccaggctggtctcaaactcctgacctcgtggtccgcctgtcttggcctcccaaagtgctgggattacaggcgtgagcccaccgcgcccggcccaggaatatcttgaatgttgcaaaggaagttgatgaggaatgcttctctgacatgatcaagggtgacttcgaggaacacatagaagagcatagagaaacccttaccaacaaggaactcaaggttctgctgaaattctctacaggagatgatgacagtgataacagatttagcagaaacagagtcctcaatttggatacttgaaaaatttgcagcagtttttcaacaggtgcaagtgttaaagggtatgatccttcagtggaacaaagcctccgtgtcacctgagggatagcaacatgcctacaagcactgcaagagttgtttgatgcttcaagaaaaaaggagaaacagcttcctagaacaatgttcccaactaaagccgtctgtattatgaagcctcgaccttaaacgcttgaagattcttccagcataaatgatctttccgatgtcctgttagaaggttcaagttagccttgtgtttcaccacttacctacagtgctgcgcatctcaccacctcaccatatgggcaccatgggcaccaaatagaaattataatcgtcatcatcgtcaaatgagggttatcaagagagaaaagcgacagtttatgcttctttttttttaatttttaaattttttgtaaagacaggattcactattttgcccaggctcgtctcgaactcgcagcctcaagcagtcctcttatcttggcctcccaaagtattgggatcataggtgtgagccactgtgctcagccagaagagccagagttttgatgcgtcttaatgtactctttcaggtcattaaatgaaagtcatctgcaagtgttgatagaaaatgtggctgggcgtggtggctcatgcctgtaattccaacactgtgggaggctgaggcaggaggatttcttgaggtcaggagcttgaaatcagcctggacaacatagaccccatttctatttttaaaataaaaataaaacaaaaagtgttacattgttgctgatgtatactgtgtagtttgccctacagtggttgcatctgtactgaacatgtacagtcttattttccttgtcattattccctagacaacacagtgtaacaaccatttacaatatattaggtatcataagtaatctagggatgatttaaagtatgtagcaggagggtatatgtaggttatatgcaaatactgtgccattttatgtaaaagacttgaacatcctcaggttttgttatctacagaggggtgggggtactgaaaccagtccccatcagataccaaggaatgactattttatatactaacttgctgcttactgtaataatggtatgtgaaaagtagatgggagagatagactgaatgcaaaaagatggaattttataggcccccacaactaattaaaattgaaataggagtcagggaggagaaagtgttctggctcactaaaatatgtgaaaatgttagaaggggtttagataactcaatatgaattaatgtgatacagccttgaaaacggctgaaatcctagattgcataacaaaaaatggttatgtagactatggagagtgacatcttcttggaatcttaagtttcttggcataatatgttaaaagggttagagaaaaactagagctcgttcatagcagagtgaccagaatggtaatagggatagaaaccatgccatatagaagatattgaggccaggtgcagtggctcacgcctgtaatcccagcactctgggaggctgaagtggggggatcacttgaggtcagaagttcaagaccatcctggccaacatagtgaaaccctgtctctgctaaaaacaaaaattagctgggcatggtggcgtgtgcctgtagcctcagctagctgggaggctgaggtaggagaatcgcttgaacctgggaggcggaggttgcagctgagattgcaccattgcactccagcctgggcaacagaacgagacactgtctcaaaaaaaaaaaaaaaaaaaaaaagaaggaaaggtactgggagactttgcgtgcttcagaagtattccaagtgctaagaaacagtctggctgtgcaaaagtcctgtggagttttttcttgccccgtctccctgattttgttttctgttgacctttcaactccaaaatcagtaggctttgctgagttggggaccttgagttcaggagagttactagtacatgccttgttgtgtattgatcaggagagaagattgggatagccacctatttggaaaatggtaatcagaccttcttaggggcagaactacttctcagagtataaaagcctataaagcctgagtcaggagaacgtcatttgatgccagagaagtaaaagtatggggtgaacttcccttgcagtgaggacagaggtagttttggtggtgctcagactattggcagtgcaagaagagcatatctcccttactgcactgctggctatagcagagactataaaaaagcaatggtgtcctttctacagtagccccagtcttttgttaacagcacatacgcatttcttctttcctacttgagggatgaaaaagcctgaatttatagtatacatttttgtatacttgtcttattagagtataaattcttcagaggaaaatattttacttttttctttaatccccatgttacccgataaagtaccttgctggtataattcctgtgtaaaatcctcctgaagtcttttcacgcatctggttaccacagcacttcatacattcctgtcagagcacttatgttgcattataaatttttggttttgtacacctaatggagtgtaagccctttgagaatagggtggaaactgtcttactcagtttgatatcccaaaacctattacagtatctggcacttagtatctgataatcagtaaatttatcggaaataaataaatgagtatagaagtatgcgcacatcaaatgctccgaattaaaggatatctccaaaattaccttccttttaccgttgtgtccctttccctctcccttggtctcctcattgttgattctactacattagacccttctgcttacttgctggtacctccattgtgatacactgatttgcttccgtctatctacaatctcatcctgtcctgtgatattgaatctaaggatatatttgctaaaaaccattatgttttaccctaccttaggactgcctacatttacactgcctttatgagcaactcagatactaatcctccactgagaaatcaccaaatagagaagttcactaatgctctgaccactctccttcttagcaatagtgatattggaggaagttttatgaagcttgggaatctgctgagatgtgtaggagctctgtcccatctaatccagctggccagctgtacagctgtaaatgttaaccagttacatcttccagctcaatctgttggcaactaggaggatgacttttaggagagaaggagggaggagtctcctctcaggtttctgacttgaatgatgaatggatggtaaggacagccaaatgtaatagggaataaagagagggaagactatgagtttaattatgagtatactgagttaggatgtcctgaaagggcttccaaatcaatatatatagtaagcatttagattaaagaatctaaaactcagagaatatattaaatttgacagttcttaaaccacaagaatgtatgaaattgccatggatatagcgttagaagttcattaagaacagaactctagaatataaatgaagaaggaagcagacccatgaagagaagacagaaaaataatgatctgagagtaagaaacgccagagaagccctcccatccccgcaaaaagcaaaaataaaacatagaggaaaacaaagaaaattgaaaagttgtaccaatagtgtcaaatattacagagtaagataactgactgccgtttgaatttgatcattaagcagttgtataatctcactgagaacaatttcattggaacaggaggaggaaaagcctcattgcagtgtcttggggtttaaaagcaagatgagaaactggaaacatcatgtgtaggaattctcttaagattaaaagaaaaaagataagatgatagttaaatccttgtaaagtctaggatccaggcctccctcctaatcccttaatgcctgaccagtctcccaagagtggaacttaaatagccagaacaagaaactaggactttcttggaaacatgggccatggcaggttcaggagatagtagcttttctgccacttcacatgggcaatgatatttatatgcacatcttcctcctataagggtatcccagatcatgtgtgctgcaaactccaactctttctgtttcccactcaaaaacctgtctgtagtatattttacaaatgtgtgtatatatataaacacacacacatatacagacaaagtttgtttaataacagagtacctctggcctcctcttcacagttaatcagggggcgtcagtgtattttgagaccatggttgatcatttgaactgagtagtagttgagtaaagttgctaatccatctagagccttatctgagtggatccagggtttcctattggtgctgggtgtagcctggctaggaatttgtgaccattaggtatttactgtccttaaacattagctttcacttgcagctttttactaccagtaatattttggaagccttaacataagattttctcagcatcagggttgtcgtcaatgaatttcagaaaactcttcagaccagaaggcagaaaagctgtttgctaatccacgtctctgactttgccatcacccttgtgttctcataattcacttaatgccaagcaagtatatgcacagatggaggttcatgtctctgtctgctttctctacagaaggcagctgccatgttccttcaaagctcagtttttcttacagtgaaatcctattgtcataaaataatcatgatccactcctactaatgggtccctctgtgaggcctaaatggcagaattcattcatttttctaggccttggatttttgtctctttagacatgcttttcatgtttgttaaactcaacatatccaaaactgctgtaagcaactctttctcacctttttccccatttaggttagttgtactaccatcttctcagatgcccaagccagaagcctgggaatcatacttgattcctccctgtttaaccctcaccaagccaatcactctggctcttaaatgtcacaaataataattcactactttccatcccaattaccaccgctctactcaaggcagctttcatctttcacccagattatcctgacaactttctaactggttttattgcctccaatcttacttctcttttattctccagactggaaatatttttcaaaattgcaaacggattatttcatctccctggttaaaattctttagtaattgtccttaggagaaagtccaaactctttaacatggatcttataaggtgcttcgtaagctgcctcatctttgtgctactttttcacttcattctctgcctcggccataccactccctcagttctttatgctaccatattcatcctcagtttgaaactttttactggtaatgctttgacatttgcagtttctgtattttgaccaggtaactcctactattctttataatacaacttaaatattacttgtttagggaaactttctctgtaaccctaacctagattagttgcccttgctgtgtgctcctatagcatcttttatttttcctatgatagcagttagtaccttttaattttaattaattgttcaatctttagagtataaactctgtgagtgaagttactctgctgtcttgctggtgatctttcaaagatggaatggactttcttgggaacttatgtttctcagcacccatagtgttcatgtataggttgaatagccccaggttgggaatggaaagcctttaagtcctttccaatcatattgtttgttccacatattcaagttacatgcatatgtctacttgaaaagtctctataagtcattgtaaaagaatttcacctaatcgaacacgtcgaatagtcaatgactaatggcatagagagaaccaaagagagatttttaatttagagccctgtatgtgcaatttttgaaattcatgttgtattttatatctctcataggtgaaatgaaccagaaatacaaggagctaaagaaaagggaggaacatatggacagtaagtgatattcttgtagatataaaaatataatattttcagattgctgttcatttataccaaatcagagacctcattttgggcagatataatggctaataaatgcagaagtgtggacattcaaagcattttgccttgaagaatagtttctagcataatttagagatgggtagaaaattctaaaaagatatgtgatgagtgtctatacgttggggctagattctaaagctagtacttacattcgtagtctgtacagaggaaacctatagaccaggggtccccaatccccaggctgcagaccggtaggaaccaggccgcacaccaggaggtgagccactggcaagcgagcattaccgtctgagctctgcctcctgttagatcagcagcagcattagattctcatatgagtgtgaaccctatcgcgtatgagggatctaggttgtactcttgttatgagaatctaacccctgatgatctcaggtagaacagtttcatcccaaaaccatcacccgcatctgcccccagccctggtccatagaaaaattgtcttccatggtccctggtgccaaaatggttggggactgctgctatagatcatttattgattgaatgttctcttttacatgcttcactatattcacctttagtatctttcacttttatatttagctttccataatacttatctcattgtttattagccctcacatcagatattgtcacttttttctatcaccagctataattttagttgccttttgttagttttgattcacttaaaaaaaatctcagcctgattttataaattggttttcacttaaacctatacatttataatttttttaaaaaattggcatgtattctcaattactggtttccttttaagttatcattttgctggaatctgaattctagcgaagtgctagaatttcatctaggtctgatgtcaatagttaccttcatggaggcatgcaataaaagagtaattgtcacctcttattttacaatgtaccaagttttctttaaaatgtcagtaaataccaaaaattatctcaaaaatatttttttaagtcttttggtaaaggagaaaggtgtaaaatcaaggaacaatgtgtcatgacaccacagtattggaaattactagatactacctagtgtggtatctggcacttaggtgtcaataagtgttcatttaatgaatgtttactgaatgaatggaaagaattcctatactacagaatcttaaaatagaaggtcacctagctcagatttctttccacatattaattatggtttgttttccttaaaaaataacccctgaaagacaatgttcatttatgcctttgtatatgtaaaaatctcatatgtccacttaatgtgtgatcaacagattatagaagcaggatattcacacataagacctgtgtgaatgctgaagcaggacattaaagaaaattcagttttataaaaaatgttgattgtggtcctctaccaccatattcaaataaaaaatgttttgttgaagactgttttactttaaaaaatatgctaaatataagaaaaaagtataatgggaatccattacagaaggcaagctattgatgttattcatgctaacagtaaaattatttttgactgaaagtttctattttttagatgctccatagaaatactcgaaaatgtaaataagagctgtttctatattaaacaagtaaaaagataatttcctagaatatttatttacaatctgaatacattattaaattcatttagttgaaatgaatccagcattgtaaataaaatacttattttcagataaaatgggtattcagcattggaaattatagaaataaagttagtagtcagggtgttaataattattgatgtatcaaaggagatctttataaaagcaaatttcttctgattgtcattttatcagctatttcttttgagcttatatttataactttctgatttacttatatcaaggtcacaggatttaggcagtttgaaagtatataaagttcttattgaataataattacctttgggttaataacaaattaaacagtggcagcttaaaatttctaaaaattgggccaggtgccgtggctcaagcttataatcccagcactttgggaggccgaggcgggtggatcacgtggttaagagatcgagaccatcctggccaacatggtgaaaccctgtctctggtaaaaatacaaaaattagctgggcgtgatggtgcatgcctgtagtcccagctactcaggaggctgaggcaggagaatcccttgaacccagaggtggaggttgcagtgagccgagatcgtgccactgcactccagcctggcaacagagtgagactctgtctcaaaaaaagaaaattctaaaaagcactcttaagaactgcaaatcagagtttatatagtgttaactctatcagcagtaatctctcttatgttttccaattgtcagcttttattgagacttttgaggaaacaaagaatcaggaactgaaacgaaaggcacagatagaagccaacattgttgcactcttggagcactgcagtcgagtgagtaccatgtgcctgtcttggtgtcctctttatttttgccgtgattaactttccaaatacaactcaaaaaatagaacggctcactattgtatcttctcatttaactgcttcctttcaattcccttacttgttactatttatttcagctattaacttttttatcactctagcaaaatgtcaggtaattagggcaatagagaaaaaggatgacatgtataatatcaatattcagcagtaaatgaagcactaattcagagtaattattatgatcttcttccattgttaatctatctgaacttttgaaagtaacatttgcacagataatttcaaaatctagacatgttagaaaatgttaatgtatttttatactgtaaatttattgtaaataaaaagattcttgtatgtatatgtaatgagtatctcaaattatcaaaaaatgtttattgggcatctattatgaaatgcatgcccccctttcaatattctagtgttttaagactccaaccagtttctaaaatagtgtagttgaattttttctgcagtgaaataaaggaaatgaaaaaaaacccacaattttgaatttatagtctgtctttattgagaaaacccaatttggaatctcattttctatacaatatataacttgaatggtgtatttcaaaaaaaatacctgatccaaacatctcatcctttgacagtgttttccaagagttttattgagaactaactaaatcagtggatttttttctatttttatttctctgcaaatgcagaatataaatcgtatagaacagatatcctctatcaccaatcaagagctaaagatgatgcaggatgacctcaattttaaatctactgaagtgcagaaatcacaaagtacagctcagaatttgacttcaggtgagaaaacaacctagattttaatattctttttttttaaaatatatcaatgttattctctgattattttaaagcctcattgacagaggctataatttatgattgcctattgccccagaattatgtgtggcttttttcatcagctggctagtattatgttgtatattgtcactgatttaacaacatttattgaatacttatttcaagcctgtgctatataattctggatattgttaaagataaacaaagctggatgcatgttaaagtgctaaggatagattttagtcagtaatacagcgtggcagtaaggcaggagggtccagcatgaattgaaatcaactttgatttgtacagaggtgattgagtgttttaaagggagaatgagggagtagtaagggaaatgaaaaattacagggttcatcaatgtacatgctggttaggccagctgtgtctgttagctggcaattatcaagttaggagtctatgtttatacacagactagcagacagaggccctaactttcctgataatcacgttttaatggaatggcttttaggtccttgaggaaaatactcctgagttgtgggaggtacatacagatatggtttggattttttgtcccctccaaattttatgttgaaatgtgacctctagtgtgggaggtgggcctagtgggaaatgtttgggtcatgggggcggatctctcgtgaatggctcagtgtcatccttgcagtaattagtatgttctctgtgagttcacgcaagatctggttgtttaaaagagcctggtacctcctccttctctctcttgccttgtaacatgcaggctcccctttgccttctgtcatgattgtaagcttcctgaggccctcaccagaagcagttgctggcaccatgtttcatgtacagcctgtagaaccattagccaaataaacttattttttaaaaataaattacccagtctcaggtatgcctttatagcaatgcaaatagactagtacacatatacatcttaaaggtacagaggaaagattcacaactggataccctaagaaagggtagtcaggggcctgttgaccagtacgggctagaataaatagtacattctttcggcggccttgagctttgtctggcaggcactttaagtggggatagggtcatcccagggatgcagacttgagctgttagaaactgtttgtttaaatcttctaatgtgggtagaaggtggtgcatgaaatcatttgtgctgagagtggaatttttataggcagaggttgaggcctagttgagaagagagctcagaggagcctagctagtttggtcaaggattgaatctttgtcagtataagaggcttaaaaaaatctaatctgtttcctcaagaaactttcaacttggtggagtgacagttatgatacaatgaaataatgctatgatagaagtaagcataaggagcaacggaagtacatagggcacatatccagcctagtcttggatagttaagaagagatgatgtttcactttaattagtttcagtcatgcttgctatcatgagactagagcagcactgtccaagagaaatttaatgacagtatatattatatttatataaagttttcgagtagccatgttgacaaagtaaaaagagacagattaattttaataatatattgtatttaaactgatatagccaagttattatttcaacatgtaagctatataaaaatgatcaaagagatattttatcttcacgacatttcaattaggactagccttatttatttatttatttatttatttatgagacagggtctcactctcattgcccaggctggagtgcagtggcgtgatcacagctcactgcagcatttacttcctgggctcaggtgattctctcacctcagcctcccaactagctgggactacaggcacacaccagcacgcctagctaatatttcgtatttttaatagagatggggtttcaccatgttttccaggcttgtctcaaactcctgggctaaagccatctgcccacctcggcctcccaaagtgttgggaatacaggcgtaagccactgcacctggcctggactagacatacttaaaagggctcaaaaatcacatgtggctaatggctgccattgggatggtgcaggtggagattagatacaaataaacaaagttgaggttaaagagactaggataaggtcatgtaaaaatttgtatgggatctttggtttatgaactaatggcttctgtgggtgttctttatgctggtgtgttgcagctttgaattagctatgtttttgtctacctggaattactacagttagtgagatagtgagaaatgaagacctaattaatatttgctaacttaagaatgttgaaagatttttgggtgggaattgaacaatgagaacacttggacacaggaagggggacatcacacaccggggcctgttttggggtggggggagggaggagggatagcattaggaggtatacctaatgtaaatgacgagttaatgggtgcagcacaccagcatggcacatgtatacatatgtaacaaacctgcacgttgtgcacatgtaccctagaacttaaagtataataatatatatatataaaagatttttgaaatgaaataatgatccataatacctttatctggattcccaaaatctaaaaagatattggcagcaaaacctgacctgacctgaactgacgtgaggctatttatagtttttaattatcctacctagtgtgactatttatgctttttgctatagaaatattcgtgtacttgatgacaaggtattccctcagactttgccatgggagttatgtaatcataagtatatgtgctgtattacttttctaaaatccaaagaattctgcattctgaaatagaactgcccaagggttttagataagggattatggacctataaatgcatactgaatgctattaattgcattagtagtggtgatataggtatataattgctatatttaagcctattttatatccagatttgttgagagtttgtttgccgtagtttttttttgtatgtctatatgccaagtaactggaggagttacattcttgatatataactactgttggtttgactgtgagtatatttttattgtggtaaaaaaacacataacaaaatttatcatcttaaccattttgaagtatacagtacagtagtgttaactatatgcacattgttgtgccacgaatctctagaactttttcatcttgcagaacaaaaacactttacctcctgaataacaactccatatttccctatcccctgacccctggagaccaccgttctacttctgtttctatgagtctgactactttaaattacctcatataaatgaagtcatacagtatttgtccttttgggactgacttagttcacttagcgtaatgtccttaaggttcatccatgttgtagcaaagaaggattttcttttttaaggttgaaacattctattgcatgtatatatcatattttaaagtctatctgtagacagacagattgcttccaccttttagctattgtgaataatgctgcagtgaacatgggtgtgtaagtatttcttcaggatcctattttcatttcttttggacatatatgaatatttaagaatattttctcttttctataaactaaataattttatagttttatttcatttagaaaacctctgtttcgtattttagaccttcatgcctaagtttttcatttatctaaagtcaatgtaaattcaacaagtttttccccctttaagctatctttctgtaacagctgtcaagaaatgtacattttttaaaaggcaaaaatcaataccaggaaacaaattcaataatcaagactttgtattcattccgtactttatactttgtgtttataattccttttaacaactagtcattatgggccaggggaggtggctcacgcctgtaatcccaccactttgggaggccaaggcgggcggatcatctgaggtcacgagttcaagagctgcctgaccaacatggtaaaaccccatctctactaaaaatacaaaattagcctgtgtggtggtgcaagcctgtaatcctagctactcaggaggctgaggccgaagaatcacttggacccgggaggtggaggttgcagtgagccgagatcgcgccattgcactccagcctgggcaacagagtgaaaatctatctcaaaaaaaaaaaaaaaaaaaaaaagtagtcattatgtgttctcctgagatgtacagtttgaaaaaaaattgaaaactggcttcaatggagataaaaatccagtttaatagtatgataaggattttgctggaaatttttctttgtaagggttaaattctttgatgcttataattaatttcatttactacattgttttcattttaacttcaaccaaccatataatttattctttctttccttccctaacaccatcccccacctcaagaaatttttttgtatcttcaaaacaccatgagaggtttataatattcttgttcgcctttcagatagaatggatttagtgtactccatgttgttgttgttgttgttgttgtttgagacggagtctcactgtcgcccaggctggagtgcagtggcgcgattttggctcactgcaggctccgcccccaggggttcacgccattctcctgcctcagcctcccgagtagctgggactacaggcacccaccacctcgcccggctaattttttgtatttttagtagagacggggtttcaccgtgttagccaggatggcctcgatctcctgacctcgtgatccgcccgcctcggcctcccaaaatgctgggattacaggcgtgagcaccgcgcctggccttttttttttttttttttttttttttaatggagcaatcacttcttgggggaagggtgaagaaaacttagatattataatggccctccagaggtcaccatacctaaatggctacacaccacatgggtgatgtaaaaatttcaggggagggaggtgattggggaaaaagagtctgtaatcgacttcttagggaatcaataatgtaagaaaaaggttgagaaacactggtgtactgcatgggcaaagaggcaagggatttatgagcaatattttttatttatatttttggaaaggaaactccagagagtaaacaaatgtgctgatgacagactatcttagaaacacttccccgggtcaaagtggttccttctgagattttgctcctatgtacacactgcttggtaaactttgcaacttcacggcatatcagaaggaactagactgcatcctcttcctgtctcttcccttggagtagcatttagcttttcattgcggacctgttgttaaaggaagataaactttaccctataccagccattttctccttttatcaagaaaaatcaatttgtatggttcttaaatgtatttccctagtatatattcaaattaaacttgcagttagatttatatcagtgtttactccaaatagtcaaaatatctacaggctaaaaacagttcctatttcgagcattaaaatagcataagccttagtcacttgttcagctctttgattctcataactatttctaaccgtggtagagataagaatccaacaaaacaaaactctttgcaacaacatttaagttttgctatatacatatttgtatttacgtgtacatacacatatatatttttaaatagtgtatgtcgctgtggttgacttttaaaactcttaaagggataaaaggaaacattcaagaaatactggcttaattatactaactttaaaaattttggttggataacagcctgttttctcaaatcagtgactttcgaagcattgttttttactcttcaaattcattcatattcatttactattcagtatgctgaacttgttactggctcaaaggtactagactttcttacctctagactttgcacatgctgattgtttttgctggaacacttttaccttcctctttgtgtgatattcataaaccttaagcctttaattgaaaggcatatctttagagagctctcttcatccctgctacatgcttttatggcaccctgtgctactcttttcatatttatccagtttattgtaaatacttatttaattgcctgcttctacctctaaaatacagctccctgagtgaaaaccatgtctctgttgattgctattatatcctcagcacctggcacatagtagatgcttgatatttttgaatggaagaatgagacacacacaggtatcctcattattcatatatttcatattgtgaatttgccctctcactaaagttactttgtaccccccaaatcaatccttgcagcattttcatgatcatttgtgggcatgtgcagactcgtgaaaaatttcaacagcctgacatgcacattgccaacagaagttgaaaaaggcaacactctgccttcttatgtcagttctcatactataaagaggtttcctttttgcagtatatttagtggcatgttttttgcatttttgtgctttctgttggtgatcatgccatttaaaatggccccaagcaaagtgctgatgtgctaagtgttcctaaggcacatcatagccttatggagaaaatgtgtgataggtaaacttaattcaggcataagttacagtgctgttggctgtgagttcaatgttagtgaatctacaacctatagtaaataaaatgtctttaaacaaacataaagcaagattatgtattggctaattgactaaaatgtgactaaaggctcacaggaacttaactctgtatttcctttgggagcaatagttcaatatttgctaactcattgttcacaataacttcataggacataactaccacagatagtaagagttgattatgtgtgcaattataaaattgtgctcaaatatatatataatgttttataacttggttttttccctacataactgtgtcatgcttctgttaaaaataatgtgtctttatctcataatatagattatattactaagcaagaaaaaaacttaaatgtttgttagcatggagacagctgtggctaatagacatcaggttaccttgattccctaatatattggttacctgaaattggttattgaggggatgagtatttttttttcttagtttatattatctcactggttacagtgaacatatatttcttttacagatattcttaaaaaacatgatttttaatagttgcattacatttccttatgtgaaaggaataaaattttgattaattatcaccttaaattcttatgtttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaaggtaaatgttaaccaagtcttacagaattacaattcagattgtttttttcttgatcaaatgtaatatatttgtggtttataggatttattattttaagttgattattttatatatataagtgagaaaaaataaaaatgtttacatatgtagttggaatttagagtgacttaaagttttaaagaaaagcaaaaattgaaaagcaaggtataagctgctacttaatacagagcatttcagcagatgtgagctttgttaaatgcagtttagattatgactctatcctacctgaaacttgtcagtggctttccattgccatttacattaatttagacttaatttggtagggtcgggagagatatggcagcattaatagagttattaatacagataatgttaacatagcttatagttcaaaggatatttttacaaacgggttttagagtagttatagccttgatataattttaccagaatatagttattgaaattaagttaaatatgatttatattggcttactacatattttctataacctgtcacttctatttggatctttctagaaattacatcaggagagaatgatattatcaacccacagaaatgcctttaagaaaataatggagaagcaaaacatagagtatgaggcactaaaaacacaattgcaagaaaatgagacacattctcaggtaaaaaatgttttaaatgactttgaaattgtcttagtctatattttcaccccaaaacaatcaattttttattttaaaatttgctttatataccttctagattttctgacttttaagacagccagattctgtacagtcttcattcagaatgaatggactcctgctttcttaccttccataaacctatattgaaagccaactctgttagatactgtcttgggcacaactgttaagatatatggggtagtatattttaaaaattttggaagtgaaacattactaatacagaaactaaaaatccataaaatcacaaataaaataaattctaatgattagtaccccaccacccagaagagagaatgcttattgttgctttagtgtgggttcttttagtcaatggatagatagatagatagatagatagatagatagatagatagatagatatgtgtatacacatatttatgcatatacttaggtacacatttatttctatgcatttatagaaattgtgccatattgtacatatcatttaggagcttgtttttcatgattaactatacatcataagtactttcccttgtcaatatatatattgacttttaaaaaatattaatagcttaatgatattctagtgcatggatgtcgcataatatattgaaccaattccctttcgttggatatttaggtaatttctagttttaaaaccattgaaataatgctataaagagcaatccaggtatccttgaacttcttaattcatatctccaattatttacataggatgcgtagatatatatacctgcagcccccttttcatatcactcatcttgctgataattacttgaacagtgtgtgaggtctagattgagagctctgacgggacagagacaatgtctgtctcgtttactttattccttgccctgtggtattggttggcacatagtaggtactcagcaattatttgttgaatgattgaatgaagcattatgtgtcatgtacaaagtcaataactacggtctgaaaaaaattgatcattcttatatctaattagtctatattagaaatttgcacacatggtttaaaaccctaaatgcattaaaaattccctcttttggccaggcacggtggttcacgcctgtaatcccagcactttgggaggctgaggtgggcggatcacgaggtcaggagatcaagaccatcctggctaacaacggtgaaaccccgtctctactaaaaatacaaaaaattagccaggagtggtggcgggtgcctgtagtcccagctactcgggaggctgaggcaggagaatggcttgaacctgagaggcggagcttgcagtaagctgagatcgcgccactgcactccagcctgggtgacagagcgagactctgtctcaaaaaaaaaacaaaactctctttttcttcatatggttatgtgatcatgatagagcaaaataaaaatgatgtcatttgattttccactacataggtacaaccgttgttaacattttggtgccatatccttgtagtattttcatcctttgcaatcatacatccatattgtttttacaaaaaataaaaccatgctattcatacagtctttcaacattttcttaacttttttcagccttctttttttttttttcaaacagagtctcactgtgttgcccagggtagagtgtagtgacataattgtagctcactgcaacctggagctcctggactcaaccgatcctcctgcctcagccactgagtagctaggactacaggcacagaccaccatgctcagccaatttttattattttttatagagacagggtcttgctgtattgccctggctagtcttgaactcctggcctcaaactgtcctcctgcctcagcctcccaaagtgctgggatcacaggcatgagccactgtgcttagccttttttttctttttgagacgaagttttgctcttgtcacccaggctggagtgcagtggtgtgatcttggcttactgcaacctccacctcctgggttcaagcaattctcctgcctcagcctcccaagtagctgggattgtaggcgccagccaccacgcctgtctaatttttttgtgtttttagtagagacagggtttcaccttgttggccaggctggtctcgaactcctgaccttaggtcatccacctgcctcggcctcccaaagtgctgggattgcaggtgtgagccaccacactcggcctttggtgacatttctatagcattagctatttcattgtatggatgtaccatttgaaaacaacatacaccttacattctttttgaaaagggtagaatctcatgaaagcttgctacaactactaaaagcttagaaatcactaatttacataattcaaatttaccagttattctgttctacttcatatggaaacctagatatagacttataattgacacaattttcttaggttgtttagagtgaggatgagtgctggggaagaaacaagacaaagtttgggaggtcattgtcttcagcaattcttggaaaaaaatactgatacttcttatggaatattagccctcctcattcactgaatagatgatttaaggtggaaagcacttgaaaaacaccatttcttagagccagtgagtggttaacttgtttatccccacattaattgctaattttaactccatgtattgataactggaaatcataacataagccacaatttcgaatccttctctgtgttatttgtcatcttttgtgaatcccaactgattaagtcaaatcctggtcttcctatctttcacaattatcttcttgaaaactggcttttggcatctctaaagaattttatgtaacagattatttaaactagttagggaaaaacagattttcaaaatgaatttttgcttcatgatgtccttggaggtttaaaggagtcaataatatagaggtataatgtaaaaggaatttgaccatctgacacagcattgcttttataccattcctgtagcacttaacaggtctgatgcattataagaaggccacctgtttgtatgaaacaatgacaaaaaagtctggtacttgactttgctgaaggttattagaaatttactgccagaaactgctgactgcttccttaagtccatcttaacttcaaggtcctgtctgggggagattgatgtgattagtaataccagctcacagcacatacagttcacataattaattagctatgattcattctaatatctagatttatctctttggaggaaacaatgagatggatctacatcaagcctgaatttacgccctgaaaattattttaacatgaggatagaaacatttccactgttgcttcaattattgtatttttaaaaataatcattacttctttgaaatgtccaggtggaacataattttagcatttcaattttcaaatggtcctttgctttggaaaaaactatgtgcatcttaaaaaagaaagaccataaccagagttacaaggttaattaaatcagaaaaacaatataattctataacagtaaaattgtcttctgaggaagcaaccatcaatataatatccacattagcttcctgttgatgcagaaattattgtaacagtgccagctttttaccagctctcttataatcttcacactgcagctctgctcttatcacagcttgtggaattacacaggaaatttagccctggaaataaggaagtttctcctatatggctgaacctttgacagtgtttgaatatgtattatatttgtggcattagacttccagattttaagaagagattcccatcatgtcccatttttcttttaaaagtttttttagggaaaggaaaatcataaattgtctttcagttggcatgttcattggtataataaacatttaaaatataattaaaataaatatatagagtaaaacatgttataggattcatcactgtattaatatatttactattatttaatctttttttttctaccgtggctttatctcaataaaatgtaagttgataagatttaaagttggagagattttttttgtcttatcctcttagaaaggcatttaattgttttaaatatgggtcctaattaatatttttcttttatgtttttagcttacaaatttggagagaaagtggcaacaccttgagcaaaataattttgcgatgaaagaatgtatcctttaaaaagctgaaaatggggccgggtgcggtggctcatgcctatagtcccaacactttgggaggccgaggcaggtgggccacaaggtcaggagattgagaccaccctggctaacacggtgaaaccccatctctactaaaaaatacaaaaaaaacatagccgggcgtggtggcgggtgcctgcaatcccacctacttgggaggctgaggcaggagaatggcgtgaaaccgggaggtggagctctcagtgagccgagatggcaccactgcactccagcctgggcgacagagcaagactccatctcaaaaaaaaaaaaaaaaaaaaaaaaaaaaaagctgaaaatgaaattgactgagttatttttttctaggaatttttttaaagactcaaatttagttcaacacctacttattaaataccagatatgtacaaaaccctgggccaaattaaatgaatatgactgtttcaattctacagtagttaagaggtgtgtgtgtgtgtgtgtgtgtgtgcgcacgcacgtgccctcaagtaactaatagaaagcagattttgggagttgccaaaaaaggagtacaaagacttaatgtggcatagtgattaagtgcccagattttggagttgggcgatccaattttaaatgtcaactctactgcttgtaagttacaaactggacaatttaatctgttcaagctagaactgtatcatctcttaagattcagttttccgggatcacagggcttgggtaaagttaaacattatcagtaaatcttctgataaacatggcaagaatttctcttttgtttagagacaggggtctcgccaacttagccaggctggtctcaaactcctaggctcaatcccacctcggcctgctcaagtgctgggattagagacatgagccactgctctcggccccagaattgtatcatctctaaaatctctaaaatatagttaatattaccttctcatagtgttgggagaattatatataaccatatagttatatatatccacaagtatatatatatatatatatgtacataatatataatatatagttgtttgttgtttatatggttctaccttgaatatctgggcagcaaagggaggtaaactaagtaagatcctgagaagtttgacttccaagctcatccatgttttagccatttcaactccattatatgtctacaaagatgatacttatgtctcatcttattgtttacttttagtttgattacaggaggcagcaagcagctgttgagaacatgtgttgtgaagttgtaacagatatttccttaaaagttgtttcctattcccttctttgacccattcaaggatgtctctgcctggagaactagatcctgactcagtggcagcataggttctcccccagggtggtgctgaacttcagctcagaagcagcctggaccccatcttacctccagataaggtgttttaggtactctgttgccagtgttagtgcaacttagtttaaaaatagaggacttgttcacagtatgctctaagtctcacactggagttttgtgcaacataaagtaggtgattttggagcagagcgaagtctagaaatttgccttaaattatttgtggtactctagagaacgtggtatgtgtatgtgtgtatgtgtgtttgaatataggaactagttcattgaacgttagattgttctaagaccagaattagattaaaaatgcataacatattaagtattaaaaagtgtttatattgtatatgaattttttgcggtaagtttagcttggcattttaggttttaattgatgcttaatctgttaaaatgatgtactgtattttaaagtattctaattgtgcttttttgtaccatcttcagtatgaaaaatgtcagtatttagttcctttctcaggcacaattagatttttattgacattgttttcccccttaactcatgtaattagtcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaagta

SEQ ID NO: 1874 - DNA, 80427 bp, Homo sapiens
tatcccgcccccgttgccgggatacgccgcggcgcacggcagttagtgggtaggcctgagagccgaggaaaactgagcgtgggcctcagaaagaagttaaggcacccgcgagccgggcaactgccctccttccgcgccggcggaggtgagaatccccgggtcccatctcttcctccctccctcccacgtctgttctcttgccttggagatgctgatccgctccaaacaaaacaaattcaaactcggtcttagctaactgttaccgtcgggcctgtagccaggccaggcatgtaccaattctagtcgagcgaaggttgcgaacagacctcctccaacagcccgacccctccccgaccccccgcaggagacccgccaagcacagagcagagggaaggaccgcgatgggctgaaggattttagtcaaagcaatacatttctgcctcttacagtggaagggacttatttctgtctgttgatcacagtgcgggcagttagcaactttccacttattcacctgtgtgagaatggttggcttagggaggataacgatagtaataataattagaagcagatgttttaaatgtaatacttatcgtcttcacaacagccctgcaaggtagatgtcacccttctgttttacagaagatgaaatcctgaggggttaattaaggtggcaagattatgcagccgctaactttgtcagcactagtttgtatcgctaatcattctggatccaaaggccaggctgcctctctgtgtgaataattggaaattgtgtgactctttgattgaataaccccgaagttagtggtatatttgttgctaatgcccgcctcttaatcccactggtaataatataatggtaagctttttttcaccacagtaaaacggtggcaaagaaaattgggtgaaattttttatgttgtacattttctcaaagttagcaggaaacctagagtaatatcttttccactggaaagagatgtttattgtactcgttttcttctggaaaaaccattttgatcatacaccgtcttccttttcaaagagtcatttcatgaaattcctttttccatttgaaattcttttgctttgtacatagagttcaaaatggcaaggaattagaatcagggagctagtggggtcaggaagattgatgtgaacatattcaaatgagatatctgaatggaaatttcagataaacaattgaaaactcaaaattggtgcccagttgaaagggcagaactgtagacattgattagtgagccgtacacatagttggagttataaagatgcatgactgtagaaaggatagaagcagtccaaggactgattacgagtaatgctaagaaaagtcagaaaagtagtactggacatagagtgtagaaacagagaaatcattttagtccaacacacgctttgtttgccttttttttttttgagacggagtcttgctcagtcgcccaggctggagtgcagtggcgcgatctcggctcactgcaagctccgcctcctgggactacgcccgccaccacgcccggataattttttttttgtatttttagtagagatagggtttcactatgttagccaggatggtctccatctcctgatctcgtgatccacccgcctcggcctcccaaagttctgggattacaggcgtgagccaccgctcccggtcgctttgtttgctttttaacaatttagtaaatttttgtaattggcaatacctttatgtacgaggaaatttaaaagatacaagagagaacaaagtttttgcttatcactgagacagattttggggatataaagatgattaagattcagctcttgccataaagggtgagaaatacttaagcagatcatttcaagtggtgtgataggttctggaataaagtaatacacaggatgcatggtagcatgtagaacaggcctatacactgaaattgaagaagacgaagattccaagaccagttatggactggtcatggaaggattcccagagaaagtaataggcaaaatgtgtgttaggcaaggggaccacttaagaggctggtataatagtccacctgagtcagtgatgccctgaattggccagtgctgtaggaatagagagtaaagtacctgttaaacacttaggaacaaaatcagtagaactaaacaaaacaaactcagtagaactatgtgaccagccatgggagtaagggagaggaagatgtcaaggactaaatttcttacttgtgtgactaggaggtgacaccaagaggaaggacaaattttgagcagatgataatgagtttggattacatatgtttattttgaaatatttagacatctaagtggagatgttattatttggatataaacaccgcaagctgagtgctaaaataaggaagttgtgtggaatcagtttattaattgttaaaaccctgagtgtggataagggggcccaaggggagtttagagagagaaaagaaaaagatggtggatggtatcttagaaaatgctctatataaggacagatcaaggagacagaaaaaagaaccagaagagagggaagtgtcatggagatgtttcatataaatgtggacaccagtaaagtaggatgacatttacagcactggcaatattggcaggggtcatttgaatcaaacggtagcaatccaggagatactgggaaatgaagcagtagaaaatagtggatataagctattctttttgttgttgttgttgttgttgttgttgttgttgttttgagacggagtctcgctctgtcgcccaggctggagtgcagtggcacgatctcagctcactgcaagctctgccttccgggttcacgccattctcctgcctcagcctcccgattggctgggactacagacactcgccaccacacccggctaattttttgtattttttagtagagacagggtttcaccgtgttagccaggatggtctcgatctcctgacttcgtgatccgcccgcctcggcctcccaaagtgctgggattgcaggcatgagccaccgcgcccggctggatataagctattcttaggaatttggctgcataagggaaggatgtatgggacagttagatagaggtggttgcaggatcaagaaataagtttttgaaggtaggaaagaattgaacatggtaacagactgaaggaaaggagaaagtttaaagataattggtagcagtgaggttaatgccacaaaaaagatgggatcaagggtaaatcagagtaagattgatcttgaatgagagaaggaatggctgttgagactggagggcaggatggatgtagagaagtttatgtgccccaaaggtgatggagttcaagttgtaatttttttaaatgagtcatctgctgagagtggcaggaacagaggttaaatagaaaagtagttaagggtgagaatcatcaagtagagaagtatcttaacaaggataaatcatttctgaaatgagggtccagctaagatttgtgactatcactttgcagtaccccagtctgtacagttgtatgatttccatcagcaatgttcagcacttcagattggatgtagagaagggtttctgattttgccagatgggctggagaatagttcaaggatacaaattagttgatagtgctcatgagacactaatttcttgagagaaggaggagagttcttaaacacccttgtcaaggtatcactagtgacttcttgaatggggactccattggacatttcagttttcatcttacttgaatttccaacgtaaatggcatggctcagattcctgccttctcttggcgtctctgacacacactcctggtttttttctttgctttctgggccttaattttcagtctctcatactagattttcctcttgtgtgtaatctgtatgtattgatgttcctcaggacagaatcttgggcactattctctttttctccatattctttgtctagataagtatcttcataactattttatatgacctacaataggacatacatttttatattgtagcccagtaaacacatatgtgtaaatttatgtaaatatagctgaaacaaaaatttactgaaacaatgtttacccttcatattttcagtgagctctttttgtttaaattttatttcacgtttaagtatcttggtcataacctacaaaattgttttcagaacttactaacggatgtgaccaacaatttgaaaactactactctaaattatgagacagaattttaaataatgttatattctgatgaataaaggagagggctgataaactgggagagaatgagtgaattaaggaaatggtttaaaggcaggtgtagcagaatgaagatgagaaaagggtaggagaggagaagaccagagaatagagtatttcaattaagatgtttgaggtgaagcaattccagatgatgacaagctccatgtctcgccatggctataaattactgaaatggagttaagatcattgctaaagttgaggtcagggaactgtgaagctggagtgttaggtattggatctagtatctagatggaagtcatccagggtgatggtgagattggaatagagaagctgtgaactaggtacaaaagactttagtaaagatagaggagagattaggaagtcactaattaccagcaaccaggaaagatcaaggcaatattgttgcattcccagatcctcagaagaagtgaatcttgttttttttttttttttttgggtggggggatggagtctcgctgtgtcgcccaggctggagtgcagtagcgcaatctcggctcactgcaaactctgcttcccaggttcatgccgttctcctgcctcggcctcctgagtagctggtactacaggcacccgccaccacgcccagctaattttttgtatttttagtagagacggggtttccctgtgttagccaggatggtctccatctgctgacctcatgatccacctgccttggcctcccaaagtgctggggttacacgcgtttgccactgcgcctggcctcttgttaatttttttaaaggtgtggaagaatgttttgaaagtgaccctgaggagcaagaaaagtgccacctccttttctttaaaattgtgggacaggaagctaaaacacttggactaccgaaagtgttactctcaggggaaatcaagattctgttaaagttaagaaaatagaaagtatttgtaacaagattcagaatataagagttaatcatggaccagaaagtgcagagaaaggattaggggcaaagaaagatgttggctatgatgggagagaaaatttaccagagtatgggatgagaatactaaagaaatagataatagaggggcttgcattttggtaagataatagaaagatgaggaaggaatgttgcaagaaacaatctcatagttgtaaatggagcacgatgtcatatttgaacaaaattagccttgtagtggtacacagaacggcagtttgcaagaacaattgttgtgaattaaatgtaagggtatgatgggtcattattgtcttgctagagaagacatcaaaggattgaactatttattgtttccaaacagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcagtaagtttgaaacaaatctatttactttgggaggccaaggtgggaggaccacttgagtccaggagactggggcttcagtgaactctgatcatgccactgcaccccagtttttgagtttttgagactgtctcaaaaatctgttgaatgcttgtgcatatattgtggtagaagttggaaatcccctctgtaataagagattctactttgttgtttctttatttcataagcatattattaaacatgtttgttttgttttttggaaagcatctggaaatgtaaatgtggaagagtgtttgaaagacactctgggaagaagatgcctgctcctgcagatactcaatttaaagctgcaataattttagttgaatagtgtattggggccagaataaaatgaaatggaatagacctcaaatagaatcaagcatataagaatttagttaatgattaatgtgtgtttcaaattagttggcaaaacatggagcattcaatagaacattccaataattgttaaaccatttgtttaaaagtatttttaatcctctcttataccttttatcagaattctacatagcttagaaacttggtatttcaaaaatgaaaccataaatgtagtagaggaaaatgttggcaagtattctgtataaacttgatatgggctaggctttctaaacatgacagaaataacaagtactgaaaaggaaaatatttttattatatatctgaatttacaaaaaataaaacaccataaaaaattagaaatgacaactggtaaaaacatttataatatatataccatatataggatcagaatcttaaaattaaaaggtaaactttactaatttttttttttttctttttttcttttttttatttttatttttttgttatactttaagttttagggtacatgtgcacattgtgcaggttagttacatatgtatacatgtgccatgctggtgtgctgcacccactaactcgtcatctagcattaggtgtatctcccgatgctatccctcctctctccccgcaccccacaacagtccccagagtgtgatattccccttcctgtgtccatgtgatctcattgttcaattcccacctatgagtgagaatatgcggtgtttggttttttgttcttgcggtagtttactgagaatgatgatttccaatttcatccatgtccctacaaaggacatgaactcatcattttttatgattgcatggtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgacttgcatttctctgatggccagtgatgatgagcattgtttcatgtgttttttggctgcataaatgtcttcttttgggaagtgtcggttgatgtctttcgcccactttttgatggggttgtttgtttttttcttgtaaatttgttggagttcattgtagatagattctggatattagccctttgtcagatgagtaggttgcgaaaatgttctcccattttgtaggttgcgtgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtaccagtaccatgctgttttggttactgtagccttgtagtatagtttgaagtcaggtagtgtgatgcctccagctttgttcttttggcttagtattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccgtgagcatggaatgttcttccatttgttgtaaactttactaatttttaagtgctctttctgtattaagaccacaagccttatgtccaatcaaaatttcatgacatttcttttgatgctaggggtaatattataaaactattctaaaactcatctagaacaataccacaaaaataagaaaaagtacagtactctaatgtaaaatatgttatagacaatgagtgaaacaatattctgattgccacggcacctggaggtaaactctagtaaatgttaaagagcttaatataagagagtgtgtcataaatagtgaataagagaaacacatcatatgaggaaaagttagatgaagtttatgagttgatattctaagcagaaggatatcctgtaaagataattattacattttcgttatcattataatgtaaaaattgggaaacaacctagaagacttacaacaggtgaatcttaaataatgatatgtatatccctataaaggctgttagatagtcattacaaactactttcaagatatttcagaaaataatatactttaacaaaagtttaaaagtgatatcaatttaacatagaaaacataaatttataaatacatagaattgaaatggaaataaatgaatagacaaaaatgtccataaatttatctgattttcacacaggtgatttcaactgagaaggtgcagagggccaatactcaacctcctacagtaggctaagtgcaaactacagataatgttgggtcctatggttaactcataagaagagcagcattttttggagggaataattttgttaaagtcagattttcctaaagttttcagattttttttctagagtttcaggtaataatattaggacatcgtcatcaacttagactgaaataatttttctgaagtcttcatacataggatagtaagggtatctttttcttttattccagtaaaaattgataattaaatatttataaaaagaatctgacatttattggccacctactatttgccaggcacgttatctgtttatttgtaaaattttaaaatttgtatgtattcatggggtaggtcagttgtcttacatgcatatattatgtaatgatgaagtgtgggcttttagtgtacccatcacctgaatagtgaacactgtacccaatatgtaatttagcaaccctcaccttcctcccactcatcttttgtaatctttagtgtctgttatctcactctgtatgtccgtatgtacccattgtttagctcccacttataagtgagaacatgcggtatttgactttctctttctgaattgtttcacttaggatcatggcctctggttccaaccatattgctgcaaaagacatgatttctttattatggcagagtagtgtttcatagtatgtgtatatatatatatgtgtatatgtgtgtgtgtatatatatgtatatacatgtataccacattttctttacgtagccctccatctccattgatggacagtcaggtttttttttcatatattcgctattgtggcaagtagtgtgataaacataggaatgcaggtatctttttgaaataatgatttctttccttttgcagtgggattgctggatcatatgatagttctatttttagttttttgaggaacttccatactgttctccatagtagttatactaacttacattccccccaacactgtacaaaggttcccttttctttatatatttgtcagcatttgctattgcctttcttttggataaaagtcgttttaactggagtgagatgatatctcactgtagttttgatttgcatttctctgatgatcagtgatgttgagcaccttttcgtatacctgtttgacgtttgtatatcttcttttgagaagttgtctattcagaccttttgcccgttttttattgtattattagatttttttgctagtgagttgttggagcaccttatatattctgtttattaatttcttgtcagatgaatagttttcatatattttctcctattatgttggttgtcccttcactttgttgattgtttgctgtgcaggtgctttttaacttgatgtgattctatttgttcatttttgctttggtttcctttgcttgtgggatattactcaagaaatctttgcttagaccaatgttctggataatttcccctgtgttttcttttagtagtttcatagtttgaggtcttaagtctttaatccattttgatttgattcttgtatatggtgagagatatgggtctagtttcattcttttgtctatggatatccagttctcccagtaccatttattgaagaaactggcatttcctcagtgtatgttccttgcatctttgtcaaaaatgtgttcactctagatatatggatttatttctgggttctctattctgtttttatgccagtatgcttttctttttcttttccttttttttttaattcaggatgggtttggctatcctagatcttttatggttctatataaattttaggatttttttttctatttttgagaagaatgtcattgatattttgacaaggattgcattgaatttgtagattaatttggatattctggatattttgacaatgttgattcttccaatccatgaacatggaatatctttctattttttgttgttctcttcagttcattgcatcagtgttttatagttttcattgtagagatctttcacttcttgggttaattcctaggtattttattttatttgtagctattgtaaatgggataactttcttgatttttttcatgttgttccctgttagcatatagaaatgctattgatttttgtatcctgcaatttttctgagttttactgaatttactatttatcagttcagatagtttttttggtggagtctttaggtttttccaaatataagatcatatcatctgcaaacagagttaatttgacttcttcctttccagtttggatgccctttatttctttttgttgtctgattgctctagccaggaattccagtactgtgttgaataacagtggtgaaagtgggcatccttgttgtgttctagatcttagaggaaaggctttcagtttttcctcattccataggatactagctgtggatctgtcatatatagcttttattgtatttagatatgttccttctatacctggttttttgaggattttgatcatcaggagatgttaaatgtcatcaaatgcttttacaatatcaacggaaggcttttgtccttcagtctgatggtatgatttatcacattgattgatttgcacatgttgaactatctttagttacctggggtaaataccagtgagtcatgacaaatgatctttttaatgtgttgtttaattcagtttgctggtactttgttgaggatttttgcaccaatgttcatcagggatattggcctatagttttctgttttcttcatatgtcttgtctttttttttttttttttaatcaggataatactggtcttgtagaatgagtttgaaagcattttctcctcttctatttctcagaatagttttagtaggatcagtattagttcttttttaaatgtttggtggaactcagcagtgaagtcatcaggtcctgagcttttctttgctgggagacgttttttaaattaaaaaaaaattttttttttttttgagatgtaatctcgctctgttgcccaggctggagtgcagtgacgcaatctctgctcactacaacctctgcctcccgggttcaagcgattctcctttctcagcctcccaagtagctgggattataggcatgtgctaccacgtctggctaatttttatatttttagtagagactgggtttcaccatgttggtcaggctagtcttgaactcctgacctcgtgatccgcccacctcagcctcccaaagtgttgggattacaggcgtgagccacctcgcccagccgggacactttttattatggcttggatctcgttattgttattggtctgttcaggttttggatttctttatggttcagtctccgttggttgtatgtgtttagtcatttgttcatttcttccagattttccaacttattggcatagagttgctcatagtggcctctaatgatcctttgagtttctgttatcagttgtagtatcttctttttttcatttctgattatatttatttgagtcttccctctttttttcattagttagtctggctaaaagtttgttgattttgtttatcttttcaaaacaccaactttgtgtttcattaatcttttatattttttttgtttcagtttcatttatttctactgtgatctttatgaatttctaatatgaattttgtgtttggtttgctcatgcttatctgattctttcatatgcattattaggttgtttattttgtttttctacttttttaatgtaggcacttacaggtataaactttcctcttagtgctccttttgctgtatcacataggttttggatatgttgtgtttccattgtaatttgtttcaagagttttaaaaaatttcctttttaatctcttcttagacccactggtcattcaggaacatatttctatttgttggtatagtttccaaaattcctcttgttatcaatttgtggttttattccattatggtcagagaagatacatatatatttaggattgttgtatctcttgcttaattgattcctttattattatgtaattatcttcttgtctttttttttaaactgtttttgatttgaagatgtatgtatagctactcctgcttgcttttggtagtgtggaataccttttcccactcttttgtttttagcctatgtgtgtcttttagggcttgatacgtttctcatagtcaggatatagttggattatgttgttgttgtttttttaaaatcttctgctaatatgtatcttttaagtgaatatttcaattcatttacattacattcacagttaataatgatatgtgaagctttgttcctgtcattttgttagttgtttttaagttgtataaattatgtttctttctttttctctgtctttttatctttatgttttgatgaaattctttcatgttggtatttgattattttgtcctcttcctttgtgattgttctataagaactgtgagtttaatatttttatgcgtttttgtgatactgtatatccacctttaatttctatgttgaagacccctttgaacatttactttaggaatggcctagtggtgacacattccctcagcatttgcttgtcctggaaatactttatttctccttcatttatgaatcttatcctgtcagggtataaaattcgtggctgacaatttttttgttttgttttgttttttggttttttccttagcacttcgaaaatgacttcctattctcttttttatttgttgttgttttttttaatttccactgaaaggtctgcttttattctgataggattgtctttgtaggtgactagatacttttctcttattaattttaaaattctttccttcgcattgacttcagacattctgataatatgctgtggtgagggcattgcaaaaatgactttttctttgcagtgacttcacctatttaatatttgcatttttgaaaatagtagtgcttgtagtaaaacatacaaacaatggagaagtatcagagttccttcctattgtaggtataaccactatcaactgtatcttctagactttttaatgtatttataaacacacacacatacatacacagtttgtatgactttggactgttccaaaatcaagatagtactgtatacattgttatttttctcatctatttctttcagcaatatattatgaatatgtggccaagtgaatacatatacatccacttcattatttttaatgtgtacagttttaatttatatgttcttctctatactttgacctggtgaatggaaaacaaaaagtagcataattagttgagtaggtctcacagttatgcttgcataaagccaaagaagaaattattcagaacatttaccaggaagagatataacattgtcttctaaagatcactcgggttaacccttaactcattttatttgaatttgtagttgacagtcttcctgtgtccaacacattctctagaattagtactattcctggcccctatgctcaaaataattcccaagtaattcattaggggataaactgacatcttttcaaggggtggttgtgattcttaacaaggcaatggggagacatttaatccagggtaaccgggtttctaggactgatttggtcagttgactttttagggtttggttcattctttctactcttcctgaagagggtggatgccaagggatatggtattcccattttatgtctagcacctgtgctaactctctaatgacatgtgccatgaaatgggtttcattgtctgaatcaatgttttctattagtctaaacctgggtatgatgttttcaattaatgcctttataactgcattactagcagttgcgcttgagaaggagatagtctctacacagtgagtaaagtgattcactattatcaataaatacttcaggcaaccgatggggggcattttagtgtagttaattttaacactttggaatggtcttagccctggatctcttcccctgaggagtgattttcttagagcttgcttattagttttttttatatattaagcaactctctgtgacctgtttggctagggtgtaaattctgatacacccataaactctgaaaaccacatcgcacatagcttggggtctccagtgggctccttgatgtacttgagacaagacctccctcatgagaggtttggataacatctctctttgatctggtaatatccattttccttctgtgttttctttagctcctatttttattaatttttctttttcagtggaagagaaaatggggactgtggtaggggaaggaaggcaaggagttaagtgaaagacaggtgtttcagaagaaatggcggcttgtttggctatttgatctgcaaggttatttccttgacttgggaaggaaaagtcattttgatgccctgggacatgtacaatagctatctcttctggcagctggagattgtttaagacatggacaattagttctttttggaccaagtcttggcctttactattatgaccattctccgtccagttttttttcaatgtatgagccactccaaaggtgtacttagaatcagtatagatagttccttcttggttctgcaaatgtttcaaagcttggctgagtgcaaacagtttacaagtttgggcagaccaattattgggcaatctttctgactctacttcttcaagagtttttccatcagttactgaatacccattatgtcttttctcttcaattacccaggaggacccatctataaataagtgtcaccctgtcttgaagggagtttctcttaagtctggccagacctttgtatggtaatcaattagatctaaacatgtgtgctccctttttaggtttagatcccctgttaagaaactagctagtttgagtgaattatcagtagttaatgttaaatcatctttttttttaacagaatggtcttatactttaaaattcttgagtcagtgattcacctctctattttttggtttaagatagttctaacttggtggggcgtgcttactgtctattttcctccgaagtttaactttttactttcttcaaccaacactgctctagctgcaatggactggatgcattgaggccatccacaggtgactgggtctaaaacttttgacaggaaggccacgggctgccggttgcctccatgcttttgggtaagcactcctaaagctaccctgtcattcacattaacaaaaacgtgaaatggcttttctagggaagatagggctagaacaggggcagttatgaacatctgtttcagctcttcaatctgatgaattttatcgaagtccacaagagacggtcaggcttccactgggtaagtttttcatacaaaaatttactttttagtgagtatgagtcaatccatacacagcaatatccaattaatcctaaaaatttttttggttcttgcttagtttgaggcaggggtaaggacacaattcactcaatccattcgggccttattctttgcttgcctgcacttattaggtggcttaaatatttaacttcgggctctgtatattgaagctttccttttgagacccataacccctcaaactgttggtggttaagaatatgtatagagaagtcacccactttttttatatcttcaccagatatgagaatatcatccacatactgaagcaggcatatttgctttgggacaagaactttttctgatactcgttctagaatttgaccaaagacgttaggggagtctgtaaacccttggggtaagactgtccatcaatattgttgtttttgcccagaatggggatcttctcactcaaagacaaatatgtctcggctatcctcagccaaggggcatgcgcagaaagcatccttcaaatctattactgtgaaccactgatgatcataaggaatttggctgagaatggtgtaacggttggggacaacaggttgagtggtctggactatctggttaatagctctgaagtcttgtactaatcagtatgacccatctgatttcttgacaggcaggattggggtattatagggagacatacagggtttaaggagtccatctttaatgagactctcaattacaggctttaaccctatcctgccttcgaagggaatggggtattgctttctccttactatgtccccaggagtttttagtttgatgtctattgggggaacttgaagtttttctcgattcccttctcttgaccagacatcaggatgaatgtatttttcgtccacagtggtgagtagatttaatgaggtgaggaatcccttagggccagcttgaaggcctattcctaattttagcattaagtctttttctaatagattagttcccacctcagggatcaacaaaaattgaatgtgagttaatagatcttgatgtttgacttttgtattttccaagatttttgccttaaatccttctccttctccttttaccccagttcttctgaagagccagcaagattagatggagtgagacaaacagaggagtgagacactcctgaatcaattaaaaaggtgataagttcacatttaggtcccacctccaaatttatcaagagctcctggtgggactcaaattaaaagagacagagaccctgactcccctattcttccttgaaagtcatgagtggaaggacttctttttccctttttaatttgggacattgtctcttgaagtggcctgttccacatttgtaacatttatcttgtccttcctccctttcaattctgggattctttgactttgctcccccacactctttagagggcctaggaaatgaaggcccagatcctctaattggaggcttggttcctttgaacgggggttttttggatcctttatagttcttggctccctggaagtcttgttgagaagcatatgggtttggagccacctgttgaaaggtggatagcataagttttgctctttgtttttgcttttctgcgtctctccttacatacactttttgagctttcctgagaagtttacttagcggtcggtcttcccaattttccaatttttgtaacttttttgaaatatctagtcaattcttagtgacaaaatggagcttaaacatacccggcccaaggggatcttccaaatttaggcctgcatactgtttcatttgctcctttagcctgtctaagaattttataggcccctcatctttttttgttgttgtatatcaaatgctttagagaggttttgagtttggggtattgattccttaattccttttattatcatttcccttagatcttccatgttttcctggtgagctgcattattattgtcccacctgaggtcttaagcgggaaatttttggtccgcggtagggacattctgaccaggagagtattcacgtttccaaattgccatagcagccctacggttatgctttttttctcctccgaaaagaggatgcctgggatggatattaactcgacccaggtatataattgaggtcctaagaattgatcaacttaatcagccaccccataagggtcatccaacaggagctgaagctcttttttcaaactttgcacctctgaactggtcaagggaatatttacaaagccaatggctccccctccttgtggaacctcttttaaggggaagagagtcggggctgactccttaggtgtggagggaaatgggaaattttggatatcctttttacattgttctatctcacgttgaagtcctttcagggaggggtacttaataggctgggaggggacaggctcatgggatgataattcccaaagtcagggttataaggaggaggaataacgtgagcagggaaaggatctggaatgagacctgaggcggcagcagctgcctgagggggagggtcaggggcactgagcagaggaagatgatccagaggatcccatgtgttggtgggtgtgggttgtttaggaacagggactctttctcttttagaggagttggtttctggcttgttccctctggtttttaaagggtaaaggaggacaggttcttgcctccaaaaaagagcatagtctgtttccttttgggagacagggcttttgtcattaacatgttcgattaagagctgacaaatccactcttcattggaaccaaattttggccggaaaactgagggtttgaggatgggccttcagtccaaataaaacaacaatattgtatcatttgctcttttcttttatgtttagttctttcattatctttccaatattttaacataagtcccaagggactatcaggaggaatttcatcacgcgcttggctgtttatttttcctgtcttacgtgaaacatttcccatcttggaggtttgggatggtgtctaactgaaataggcctttccctggagcttctcaacctctcctactagagatttctcgccctccgtcctttcagaagctcactgaggctctgaggctcaatccctcatattagagatttcttgcctatcgatttccataggcattgttaaggctcagtccctcgtattagagatttcttgcctatcctttagccccacctgttggaggctccttgcatccttctttcgctttttccactctggctgcttcccttgtgggaaatggcaggatctgccacatgaggtgaccacgggaccgtgcagataggacccactcaatccacacagcagtagtgttaacatcatctacatacacttttatcctccaagataccctgaccacctaggaaatactttgttgttcttgtaccgtttttcaccttggtctgtgcacagagttacttggtcgccgcggtgttgtaagcctctcctttccccattgctgagagcttggatttgtttgtcacaatgggtgggtctcagtctcccatccctgaggccactgcaatgcgacagtgggacacgtctccccctgggtggggtgactgaagacctcttcttgaaggagaatgggaatccccgacaagcccccagaattgttagaaagaaagcttgaagtcgtaaagaaagacgagtactcaaacaaaggatttctcagcaaagcaaatttacttttgcgcagtagggtgcttcttacagggctgcttgtcatgagagcacactgaagaaagtagagtagaagcttttattcctaatgtgactcctgccctcgtgccctttccccattggctggggtcggactgcacaatctaaactagacccaattggctaaacatttaaactttcttagataaggtgggcgcatgatgggagagaggggagaggaggaaggggtcatctacagaggactagagagccagtcttttcctaaataaggaaaggaatgtgagctggggctgtggcatgcctgggcatgtagtaaaatcagaaagaagaaaaaaggagaagaaaggcagggggtacctggaattagagaataagtagctgagcaggctatttgaagagaaaccttgccatatctcacatcttttatatcttctcatgcctgtatgtattatatgaactgacataaagggagtcttttggcctttcctgaggtcgtatagtgttatgttggattttgcatacctgaagtagagaatcttgttgagtaataatatgaatgcttgtttaacaatgtaagccctttagtacttacatggtcatcttaggatggatttatatccatttgtttttacaagattaaagttttcttattttttcctgatttttaagggtaatagatactcattgcaataaggcggaaaataccaaattgtataaaggagaaaataaaaatcaactataatatcattatcgatcatcattactattttttcacatagtttttaaaatttttatttttgtctatattttttgtttttttaaaagacggtctctctatgttctccaggctggcctcgaactcctgggttttaaataatcttctcatctcagactgccaagtagctgggcctgttggtgcatgccaccatgcccaaacttccagcctttttttgttttaaaaaagtagagttttgaaccaggcacagtgattctcacctgtaatcccagctacttggatagctgaggcagaaggatctcttcaggccagtagttcaagaccagcctgaataacatagtgagcccttgtctctaaaacaaacaaaaacggaattataaataccatcttgtaaactgccttttaatttttattttatttacttattttgagactgagtctcactctatcgcccaagctagagtgcagtggcatgatctcggctcactgcggccttgacctcccagattcaagcgactctcatggcttagcctctcaagtagccgggattacagacgtgtgccaccacgcctggataacttttgtatttttagtagtgatggggttttgccatgttgtccaggctggttttgaactcctgacctcacatgatccacctgccttggcctcacaaagtgctgggattacaggcgtgagccaccacacccaacttaaactgccctttttatatactgcagcttatttaaccattttctgctgtggacatttaactcctttccagttttgaggtattataaataatgtctacatatagaatttaaaattttcctgaaatgtatttttaaatagtcatagaacattaaatgttaaagaaatatgttaataaattgaacaacagtatttaataattcagacatttaaaaaataaggaaatttttacaaatcaagtagaattttgtttttttaaaaaattgtctttgcagttttacaataaaagatgtacagtgttttttctggtttactaaaaatgaaatcttgtttgtcatttagatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtacctattttaagataagtatgacacttgggcctgtgttttgtaagaaataaataactgtgaacaatttaaaaaagtaaaagttgagtatattttgaacaataagtattacagtaccatttttttaaatcaggattatagcatgtaagaattattacatgtaattatggcatgtaatcagaattatggcatctaatcgttattctttgattcacaaaattattgtgatggttaaacaacagagtgaatatgaaaatacagtttgaattagaaagctatatacagatatgagctatttcagtcttcatttttctgacatggagctgtagtacaacttgaagaactttgaaatagtcttggagaaaagttcaagattgaaaattagatttttggtactatatagaaatactctgaaatagtttagatagttcctatattaaaatgacacttaaaatacttgtgtatttatgagaagtgagtcaagaaatgttactttttttctgataattagcatctgttctaatacttatgtaaggaaatgaggctaatttcctcatttatattaatctaatttcctagatttatattaaatctctcattatgcttctgcatatgtatttagagaagcataagaatatactatatattagagtttaaaatttagatctgtggtatatataaaccaaactatggtaaactcctttttcttttctttttatcataggcagtggtcagtagcctgtggtgagctgtttcagagtttttcgttttctgtatttttgacagatgatctatcaggaatgaagatatactgctagtacaaaattaattatatcatacatgctactttctataatacagtatatcatccctttcaagagacttaaattttttttttttgagacttaaattttttcatctacattctaataacatctaaatcactaaatattaaaaatgaattgattatttagaaatgtttgcttaatgattatcagtaccatgaaaaaatatttcaaaattacatagtcatttaactagccttttgaaagtggatgcacagaaatatttatatgtttaatagtattttaaaacatcgagggtaaaaacatattaaaattctatagtaaatttatcaaatgtttatttctgtattaatttatccttcaaaacagaaccaatataatttaagattgttagtctctacaagtatacttcaaagccttttaagagagaattcggaacattaccactacacagaactgtctactgtgactttcattcttaccttctctagtgccccatttcccagtataataagatactacctctacttctcagcatagaccttatagttaatacacctagttttacctctcatactttgcagggcacttcatctcttacaaggtttgagacatttaacctaggaacactttctttttttttttttttttttttttttttgagatggggtctttctctgtcgcccaggctggagtgcagtgatgtgatcttggctcactgcaacctccgcatcccagattcaagcaattctcctgcctcagcctcctgagtagctgggcttacaggcacatgccacaatgcccagctaatttttttgtatttttagtagagatggggtttcaccatattggccaggctggtcttgaacttctgacctcaagggatcctcccacctcagcctcccaaagtgctgggattacaggtgtgagccaccgtgcccggccaggaatactttcttagttctactgaaatgtaagaccatttcttaaaaagtctctgagacaaatgataaaaaatcatagtcactttctcacattgagtaatgtctgcagtgtccagtatgacagccagtagtcagaaatttaaattagttccccagtagcaccagccaaattttaagtgcttctgtagtccctctgtccactttattggacagtgttaatttagaatatttctgtcactgcagaaagttactctggacagctctgttccagattcccttagactcaattttcattccatcgtcctgttctgtagagtctactgtcttttaacagccccacctctagtcccatcttcgtagttttaattgaagcttcccttatgttgtgattctaaggtattagttctcttttcagtttcagtgattcttcttgattcattggggcattcatgaagactgtcttgagaattgtggagtgtaattctgattgtgctttggatttgctattctggtggcatttcgaactgaacactaacacttaaaacatttttttttaggtccccagaggcaaattttagacaaatcttactatcttgggcttcttaggtatgttaaacatatcttttcatccgtatgttttactcgaaatattgtgtaccttctgtcaaaatagagtatataactttaatatgaagttttagctaggcacttattaggataattaggtatctattgatttctaaaaattattttgtattctaacaatttctggttaatttggctatgctgtaaaataaatgtgatagtataattagtctgagatttatagttttatgaatttgcatgtacatgagctatattttccctcagtttgtttgtgctgctataataaaatacctgagattgggtaacttataggaatttatttcttactgttccggagacgcagaagtccaagatcaaggtgccagcagcttcagtgtctggtgggcacctgtttctcacagatagtgccgtcaaggtgtcctcatggcagaagagtggaagggcaaaaggtgctgagctagtttccttcaacccttttctaaggcactaatcccatccatgagggcagagtcgtcatgtcctgattacttcttaaagtccctacctcttaatactattgcattagagattaagttttgatatgaatttcagagggactcaaacattcaaaccatagcaaacttattttattttatttatattttagagacagagtctcactctgttgcccaggctggagtgcagtggcatgatcacagctcactgcaaccttgaactcctgggttgaagtgatcctcctgcctcagcttcccaaagtgctgggattataggcataagctaccaccacacctggcctcatagcattttttttttgagacagagtcttgttctgtggctcaggctggagtgcagtggcatgatctcggttgactgcaacctctgtctcccaggtttaagcaattctcctgcatcagcttcccaagtagctgggattacaggcgtttgccaccacacccacctaattttgtgtgtgtgtttttagtagaggtggcatttcaccatgtcagccaggcttgtctcgaactcctgacctcaaatgatctgcccatctcggccttccaaagtgctgggattacaggcatgagccaccgcgcccaaccccttgtagcattttaaaagttcacttttttcatctaatgataagaataatttttttttttttttttgagatagagtctcactctgtcgcccaggctggagtgcagtggtgtgatctcagctcactgcaacccctgccttccgggtttaagctattctcctgcctcagcctcgtgagtagctgggactgcaggtatgcgccaccatgcctggctaatttttgtattttttagtagaggtgggctttcaccatattggccaggctggtcttaaactcctgacctcaggtgatgcacctgcctcagcctcccaaagtgctgaaattataggctgagccaccgcacctggccaagaataatcttctatgttttttttcagtaattaatctgaaacgtgttactcatatcattaaaatgttaccagctacatctaataagaaagggaaaatatgtatacttatttatgttatattaatcagtaagttttacataagtatgtatttggtcagttgctaccaatgtggcctaattttaattaattcataagctttttttcttttttttttgagacggagttttgcttgtcacccaagctggagtgcaatgatgggatctcacgtcactgcaacttccaccgcctggattcaagtgattctcttgcctcagcctcgtgcctgtaatctgcaagtagctgggattacgggtgcctgccaccacacttggctaatttttgtattttttttttttttttttttttgagacagagttttgctcttgttgcccaggctggagtgcaatggcctgatctctggcaccgcaacctccgcctcccgggttcaagtgattctcctgcctcagcctcccgagtagctgggattacaggtgtgcaccaccatgcccagctaattttgtatttttagttcagacgaggtttctcaatgttggtcaggctggtctcgaactcccaacctcaggtgatctgcccaccttggcctcttagagtgctgggattacaggtgtgagccactgcacctggcctaatttttgtatttttagtagagatgggggtttcaccattttggccaggctagtcttgaactcctgacctcaggtaatgcacctgcctatgcctttcaaagtgctgggattacaggcgtgagctgccgcactcggcctcataaacttttgttatatgtctctggggatgcatctctaaatcaatgactttttcttattcttactattttcccacttacttgttctactgtcctatctccatcttcccattttacttcattttctttttggcacattatttgtatcttctttctcttttatttcgcttttgtttaatccaccctcccatcatgccctgaaagccctgttttcttttatttctcagttacctggatcctattgagtctcaaactcctagaaggcaataaagaaaagtatggtttccccccatctgttctcaaagctaagagtagtaagaaagatagtaaggccatcagttgtttagtatctctgacattcagccactttttaatcaaaagaaggaaaggaaatatagttattcctaatgattgcattgcctttctcccccaggatttgtgcttccacatcaaagaatagttctagctatttgtgtaattgtctggctctagagcagtggttctcaactggtggtgattttgcccccagggaacatttggcaatttctatacatgtttctggttgtcacaagtgaggttggaggaagtgctactgatactcagatccaggatgctggtaaacatcctgcagtgtacaagatagtgctcaacacgaggtgctaatcactgacccaaaatgtcattagtgctactgttgagaaactgtgctctagagggtagtagcagctgtgatgatgacagttaagcacctacatctgcctgtggcttgtactagtttgaccaggctttcattctggttctatttcatctttcttcatgaatctatgtcagtttctcctcagtttctcatcagttgagtagaataggatgggatatacctcattctttttttttttttttttttttttctgagatggtgtctccctctgtctcccaggctggagtgtagtggcacgatcttggctcactacagtctccacctcccagatttaagctattctcctgcctcagcctccctagtagctgggactacaggcgtgtgccaccatgcccagctaatttttgtattttgaatagagatggggtttcaccatgttggccaggcttgtcttgagctcctgacctcacgtgatgcgcctgcctcggcctcccaaagtgttgggattacaggcttgacccaccgcacccagccagaatatacctcattcttaatgaaataagccacctaaactttctgcattcttttagtgaatttcacaaaactatttatattattattacgtattaatggaaagtttaaattttgcttaactagagttttctggattaaaagtattgctgacattcttatttcttttctaatagaagtaaaataagtgaacttacaactgaagttaataaacttcagaagggaatagaaatgtacaatcaagagaattcagtatatttgtcatatgaaaagaggtgagtaataagtattcagtattcattcagtattttgtgcttataatactaactttgtagctatccatattgtttgtaatgttcattttcttatgtatatttttatgtacatatttatgaatgtatttattttatgctttcagggctgagactttagctgttgagataaaagagcttcaaggacaactagcagactacaacatggtattttatcttttctaagagaatttactgttaatattttcattagtttttactactgctttaaaaatacattagtaggcaaaggacatgcacagatacttttcaaaagaagacaaacatgcagccaacaagcatatgaaaagaagctcatcatcactgatgatgattagggaaatgcaaatcaaaagaataatgagataccatctcacaccagttagaatggctgttactaagaagtcaaaaataacagatgctggtgaaattgcagagaaaagggaatgcttatacactgttggtgagagtgtaaattagttcaaccactgtgaaagcagtgtggcgattcctcaaaaagctgaaaacagaactaccattcagcccgtcaatcccattactggatgtatacccaaaggaatataaatcattttaccataaagacacatgcacatgtgtgttcattggagcacggtttacagtagcaaagacatggaatcaacctaaatgcccatcagtggcagattggttaaagaaaatgtggtacctataccatgaaatactatgcagtcataaaaaagaaaaagatcatgtcccttgcaggaacatggatggagctggaggtcattatccttagcaaactaacacaggaaaagaaaaccaaatactgcatgttctctcttaccagtgggagctaaatgataacacatagatgggaacaacagataatgggatctacttgagtttggaggctggaaggagggaaaggatcagaaaaaataactaatgggtattagcttagttacctaggtgattaaataatctgcacaacaaacccccatgacagtttatctgtaaaacaaacctgcacatgtacccctgaacctaaaataaaaatttcaaaaatttcaaaaacaataaaacatttgatgaaaaaatatatttattaatttattatttaaaataccaaatagtacatgaatacatacttattgggaaagatgaaaccataaaaattacaacaaataaagtatccctttactttctgcttcatttccctccccagaaataacttggcttaacagattaatatatattcttccattgttttttgtaaaatacgtttactgacacatacacaaatgcacacatgcttttctccctaaaatatgttaaaataataatttaaataattttaaaagtggctaaaatgtattggtcctatcagtgatcattgctttaaaaacacattttttatcaagtgttgtcatcttgaaaattttgaaatttaattattaaacatacagatttccaccatcttgatgttttactcgaaatattgtgtacattgtcaaaatagagtatataacatgatatagttccactaaagatgcttctacctgtggactttcagaagaaacagtccccctggcaatattgataactgctcagtccttgggtgatattggccccatgaaaatttctagtgtcagaattttcttttttctaactctttagttgctttaggagcagtgatgtctggatttaatgaaaaagtcaaatttttatctcactacccttattaagaaatagtgttacaagaaataaacattctatcataatggttaggataagataagttatgatatacctacttgatagtgttaccttgtgcttatcaaaaattttgctaattatagtataactttttatttttgtttttgttgttgttactggtggtggtggtgggttttgttttttgtttttttgttgtttttttttttcaagacagtcttgctctgttgcccaagctggaatgcagtggctcaatcatggctcgctgcagcctagactttctgagctcaattgatcctcccacctaagcctcccaagcagctgggactacaggcacatgccatcacaccaggctaattttttgtattttttgttgagatgagatttggccttgttgcccatactggtctcaaactcatgggctcaagtgatctgcccaccttggtctcccaaagtgctgggattacaggcttgagtcattgtgcctggactatttttattttttaatttttttagagatagggtcttgctctgttgctctggctgaagtgcagtagcatgattgtagttcactgcagcctcaaactcctgggcacaagtggtcttcctgcatcagcctcccaagtagctgggactacaggtgcatgccagcatgcctggctaatttttaaattttttggagagatggggacttgctgtgttgcccacaatggtcttgaactcctgggctcaagtgatcctcctgcttcagcttcccaaagtgctgggattataagcatgagccattgcacccagccctcttataattcttaaatttcctggactacacaattcatcacaaacattttgtagagcccattattcactgggattttctttagtaaatgatgttctgttttaaatgtgagcaaaatagtttttttttgtttttttgttcttcttgagatggagtctcgctctgtcatccaggccggagtgcagtggcgtgatcttggctcactgtaacctccgcctcttgggttcaagtgattatcctgcttcagcctcctgagtagctgggattacaggcgcttgccaccagctgggattacaggtgcggtcctgagtagctgggattacaggtgcctgggtaatatttgtatttttagtagagaaggggtttcaccatgttggccaggctgatctcaaactcctgacctcgtgatccacccgcctcagcctcccaaagtgtggggattgcaggcatgagccaccgcgcccggccgagaaaagtagtttttaaaggtatgaaatgacatgagatgaaagggagttttagttatgctggaacaaattaggcatattcatataaaaatactaccatataaaatatgctatttatagatttaatgagctaatatctgatacagagcagttagctgtgtatctgacatatagttagcactcaataaatgttaggccttattagcacttattatttatatcataaatgaaaaatgtgatataccttacacccaaatagtttgcttttagtagaccttctgttcacattctggctctatcgcttgctaaatttctttttctgtaaaatgtgtacaatcatatctacttcatacagtaattgtaaaaattgagttaacacatatgtaatagtgtttgacactaggtaaatatcctatgttgacaactgatatccttgcctaactttttgaagtagacttactactgttccatctgtgcaagccctgttgatttttttttaattattagaagataaagaatatctttttatgtttttactagtgtaaatttgttttttgttgttgttgttgttgttgttttttgagacggaatttcacttttgttgcccaggctggagtgcagtggtgccatctcggctcaccgcaacctctgcttcccgggttcaagcgattctcctgcctcagtctctctagtagctgggattacaggcatgtgccaccacacccggctaattttgtatttttagtagagacagggtttctccatgttggtcaggctgttcttgaactcctgacctcaggtgatccgcccgcgtcagcctcccaaagtgctgggattacaggcctgagccaccgagcccggcttactagtgtaaatttgtaaatctactaacattcctctctccttggggatgttggcaggggaagagagggtgatagatctttccaaaactctcgtctgttccaaacccttatttataagctcagccatcttttcagagcaggcaaagctccacaagatataatattcaggaagagttgtttattactgctcatttatccatgttaaaaatgtgatttgtttattggccaggtgcataatatatgcttacttaggtagctcaatatttgtttttatcttaaaatagaaaatattcaaaagtattaatacttaagttactactcattatttgtaagactgaatacctatattattaattatagagaacatgtgtaaagactaacaaaatggtgtttgtttgtttgtatttttgtttttagttggtagataaacttaataccaacactgaaatggaagaagtaatgaatgattacaatatggtaagaaaatttataaaagcaaattgatctatgtaagtcatatcctacaaaacaaagcatttatatctagaaatagtttgataaaaccttaagtgctatagaggtgaatattactctgattgtaaataccactattaggtattccttgagctcccttagttgctcttttaaattttcttcctgttgattggctttcctaagtgggtgtttagtgactgtctactgtgtttgaactggtgtcacgtgcaacattagttagggagtgccatctccatttccttatatatattagtttacagtatttctggcttagtttaagcacaaatgttgatgaatactcaatgtgacaaatgataactttacatagtttttgtcaccagtggagaaaaatgaatagatatgactccagacataaaatattaatttttgattggtaaatgagaatctgtgtttaacatggacataacactggggactccaaaaagggggatggtaggagggcaataagggtggaaaaattacctagcaggtacagtgttcattatttgggtgatgggttcactagaagcccaaaccttaccgttatacaatatatccatgcaacaaacctgcacatgtacctctgattctaaaataaaaacaaatttgtattcaatgttcttagattaattgtttggtagaaaacaataaaatatgttaatagctagcttattttgattataagcatttggatgaaaataacatacaatttataatttatatagtttataatttatttacatgagtaaagactgttctatgaagacataggattgataaaatgactcttctaaatttggggttctcaaaccatgataatttagttacttttagctttagaacacaagagaattcactaattaagaatcttatttcaatgccagatataaaaagtaaaaaccttatgtgttttgtcagttgtttgggatggggggtctgttttctaggctgggtgtgcacaggtagagttaattaggtgtactcagataatatcctgaatggttcaggaataaaacttgtggtggttctaaatttaacatattactaatcaaatatttattgaacactcaatatattctttgaatgctgtttacataaattgaatttacattgaattatttgacagatcactgaagaacaatgaatatttttggtataagattacaatgcttcttaaaaagactttttaaaaatctgatattgtttgttaaatgaggcaattactttatttttcttcttaaactttgtatgtggcactaggataattatagtaatttctcatttagttcctagccaaaataacctacaaagaaaaaatttggtttaatatttatttcttactaacttatgtgttaactttattcagcttaaagctcaaaatgatcgagaaacacaaagtttggatgtcatatttactgaaagacaagcgtaagtatagctaatttaaaaattagattcataagtaagctttattaggtagtttaagttgtgatccagttatttccttgtaaattttcttaacaatttccccattgcctttttcatttaaaaatatttacaacacaaattttgttgcttatacttgttatcttcatttaccattaaatacctaaattctgtataaagactattgctacatagcttatataaataggatttatgctgctagcagctgaacacttatgatggataagaacatctttatatctactatttttggttttaacctgggcttttaactaatttgaattttggtgtttcatccccaatctagtgaaagacacattattcattaggaagctatttacattatttcattagcattgatatttaatagttatattagcaatctacgtcatatatagattgtatgtgtgtctttatatataacctatctaaagactaaataccaactaacgctggaaataacgtaattgtggcagtgggagtaatgcctacaaagataataatagatgtgatgtagttaacttatttgtgttttgtcagttgtttgggatgggtccatattctaggctgggtatgcacaggttgagttaactagggatactcagataaaatcctgaatgattcaagaataaaacttgtgttggttctaaggtcaaaaagttgatgaagaataattaatttagaaccaacacaaattttattcctgaattatttattctaaggcaacacaaacacaatgagctatgttgtgtaaacacacatacaagcacattctctcccagaaatttgttaatattagtctctttgagagcaaagacaataataaacccaaattaccatattcaattaccaaaattcagtaacagcaaatacactctcttgttacctctgcataaaacagtaaatatttgatgatggatagatgttaaaatatactgataaaacatttgaaagataaatgtaattcttctattgattaaaaacaagaatctcttttcccctgcctttaagtagagttttgctctgttgcccttgctgaattgaagtgacatgctcatggctcactgcagccttgaacacctgggttcaagcgatgttgcctcagccctccaagtagctgagactacaggtgcatgccactatgcccagctaattttttgtttcttggggagacagggtcttattacgttgctcaggctagtctcaaactcctggtctcaagcagtcctcctaccttggcctcctcaagtgttgggattacaggagtgaaccattatacccggccaccatctatcatttgctgctgctgtaaagtggtatcttataaactcaaaatactagcagtctttttccttttacaaggaaaattttgttcatggtaaccacgctcttacttgaaaacgttccttttttttttgttatcctggttttaatccatttagcaaatatttatcatttactatatataagatactctcttaggtacttcaaagaataagaaatatataagctataggccagtgtggtggttcacacatgtaatcccagcactttgggaggccgaggcgggtggatcatgaggtcaggagatcaagaccatcctggccaacacggtaaaaccatatctctactaaaaatacaaaaattagctgggcatggtggcacgggcttgtagtcccagctactcgggagactgaagcaggagaatcacttgaacctgggaggcagaggttgcagttagctgaggtcgcgccatcgtgccactgcactccagcctggtgacagagcgagactccgtctcaaaaaaaaaaaatagagaaatatataagctataatcccctgaaggccttaaagagtttagaacatttaagttctcatttatttcatcatttatctcaaagttatataatacctaggtcaggttttaaatattatatttacatattttacagatatttcatctgaaaacataatttcaagaataaaagttaaagaatgtcatagatttttacatctatttggttttttttatttaggaaaatcttcaaatatggtaatttgtcctgaagatacatccaaaccatttaaaaactctgtctgtaatttgtaattgaggctgagtgaaattggttctcttgtctgttttaggcagaaattgaaattaagaacaacaattggccaggtgcagtggctcatgcctgtaatcccagcacttttggaggctgaagtgggtggatcacctgaggtcaggagttcaagaccagcctgggcaatgtggcgaaactctgtctctactaaaaatataaaaattagctgggtgaggtggcaggtgcctgtaatcccagctactcaggaggctgaggcacgcgaatcacttgaacccaggaggcggagggttcagtaagccgagattgcgccactacactccagcctgggtgacagggcgagactttgtctcaaaaaaaaaaaaataacaaaaagtattgttacgaaggttacttttctatacagcagtagaatagatttatttcttgtgttaaccagatggccaacgtctcaataacacaaagatctatcttgactctacacagagtgaccaagaaatgccatacctcgagaaggcaggtgtaaaaagcttctgttttcattctcttctctttcaatacaaccatttagtgtggtctgaccatctggtttattatggaaaactcatctataaaaagttggttataataaacagcctcaatatattacaacaacaatatgtaagacacctggcattaattcagtttcacagtcttgcttgaactaatgattctcttctaatcctgcactttctagttaatattagtcaagatcagttgtcctgtaaaaatatatgtaattataattttatacccatttatttttctttgtgtagtcagatatttattgaataccccatattcaacagaggcccttgaatataaaagcttaagtgtagtctttgctcatttgcaattatatttcattttgctacatttctcaaatattaatatttgcatcttataattaggaaataatttagcagaatgatacattgtttagaaaaagatattttatgttcctataatcatctcattcttataattaaggtttaaaacaaagtataattgatatataaagaaacattagccataatatacttatatcctttgttgaaaacatgtgtctgtaaacacaagcaaatatgtattataaattagtaagttcttctattttacaggtatatcatcctagtttttattttctctcagtagacatttgtattgaatttactaattatgtaacttttaaaatgactattctatagattatgacatagatctattttattttagcctcttttttctaaggaattgtcaagtacatacaaatttttaaaactttattatatacataaacaatttgaacatacacagaaatagcatactataccatacacaacatacacagaagtagcatattatacccttatttagctcccagctccatcagctcatatttgaccttgctccatccatacctctagccactgttccattccacgtgttataatgaagaaaataccagaaatattatttcacccatcaatatatttcattatttcagagatatacatatttgtaaaagatgtaaattcttaatttctctgcatatgaaggtaaaaattatagattgtgctacagtttttaatgtactgtttgcattgataaattattaaattgtgattatagccaattgattatgaggactcagcaaataattttctttagacccttcctattacagccgataggccagtgttttccaaactacgttctttggaatgttattgaactacgagctcttagtagatgtaactgaaagaatgggttttgttgtcaagtaagtttgagaaatttttaatactttgctcttgaataatcagagagcagtttagcttagtaaagttttacataaatcctattgtaaagaatcttggccaggcacggtgctccatgcctgtaatcccagcactttgggaggccgaggcgggtagatcatgaggtcaggcgttcgagaccagcctggccaacatggtgaaaccctgtctctactaaaaatacagaaattagccaggcatggtggtgtgcacctgtactcccagctactcgggaggctgagtcagaagaattgcttgaacccaggaggcggaggttgcagtgatctgagactgcgctgctgcagtccagcctgggagacagtgcgagactttgtctcaaaaaaaaaaaaaaaaaaaagaaaaagaatcttgtttcaccttgtttaaactactagtttttcctgtagtaatttgaccatgtacctccttcttcttctgtaaatacttgtgaatgtctctctggaaattagtattctagaaaaacaatttgggaaacattgctctatctactgaatagatagaaatagctgtccatggaccacatgaagattccttagtgtcagcacagaccaatttgaataaaaatctcccagagagaggtggaaatatgtatttttaaaacaagatttatagataattgtgatgcccactttggaagccagtatgacattaaactgtagtgatcctgcattatggtgacagcctttctttataaccagaatcaatagtgacttattagggattatgcctgaacattgtgcttgtgctttaaattgctatgaaattttaaggaaatttattgtgctatttcaggaagcatttcaaaaaaatattttccaactctatgattttattctgggagcataaaatcaatcttagtgtattatttaagctatctctgttcctcactttgacttccatatattaataaatcctaaacttttatttctttactgattgaaacattagtataacttaatacatattatgtcaaatacctgtgttaatatgagaatccattcattttaattcatgaataatttagacctttttactagttcgtatggtcacccaagcactgctaagaatagtagtgctagtattgtagactatgtaactgtcaactaccgaggagtgtcagttactgtatttgaacctgcttgctcaatataatgcaaagaacataattttatgatattcatgtatgttgtcattaatatgaatgcctgccagctgtattttgttatgtcacatagcaaaatctccatatctaaactgagtgagctgataactttgctttaaaaagcaaactttgaaagaaattaattttcttcacataattcatggatatctatatatttgtcttcaataaatccatcatcatctaccacaaatgaatgtaattgttcaaatattactgtagtttcttcagagtttgtttctggtatctgtgaaagagagcttggatttccagtaaaaccatcttcataggtttctgcttcatgctcttccaggcgatgatgattataactaagcagaatattgtaccatattgggcatttgatagcaataaaaatgagaagtgaagtcgtcagtacagtgacaacaacaccaacaagaaaagcccaactttttccaagaggttcatgttctttaatggaataccaagagaggagagagaaagaaaatttgttaagttggcaaaataatcataattatatatcctaattctcctcaatattggtattaaaaataaacatacattgtagttttctttagattttgtttggtggatgaattctctttgttcaaaatagctgtgtttgcaattttgttacccttttacctaagaccattattgatttatactcgttaagatttgtgactagactagttaaaacaaaggctcagagaagttaaataatttgcacgatggcatttggcttgtaactagcagagcctagtttggaagagcaatattttgtaaatctttagttgagatgaggaatctttcttttacattttttatacaaatttaaaataaagataactacctcagtttatttagtatgatacattcagcagtgttaatatatagaaccagtatattacctgaatttcttgttaagttgttcgaagagctattaaatattgaattgctgatgggctgaaaatgaatataaagatcttcagttactgatgaaggaaattttgagtggcattcagccttatgaggtactgttttgatattgtagctctgcaggctgttggggtagctacacatggtgatgttctcattttctagtaaatcagaaagaataagatttagtatagagaaaaataatagttaacaacattttataattgttttatctagaatttttgacatatttgtcattcttaaaggcattataagaaattcctgttgtatttgtctagcaacataatgaaagaatgatgcacatttctgtttattattttataaatatggcttaaatgcagtatctttgttatttagtttatctgtattagtgtagattttattattaatattgtggttacatggttacaatctggatctcaggcacagtatggtttgcagttaaaatacgtcacttgttttcacttagtctaggaagcacttttaaaaaattagtctgacatattgactttgctaacaatacatgaaatgacattatcatctcacatgtatagaacatttacatttctggccgggcgcagaggctcatgcctgtaatcccagcactttgggaggccgaggcgggtggatcacctgaggtcgggagtttgagaccagcctgacaaacatggaggaagcccatctctactaaaaatacaaaaaattagccaggcgtggtggctcatgactgtaatcccagctactggggaggctgaggcaggagaatcacttgaacctgggaggcggaggttgtggtgagctgagatcacgccaatgcattccagcctgggtaataataacaaaactctgtctcaaaaaaaaaaaaaatttcttaatttttccccctggtaatggggaaggagagcatctatgcagctgttactttttagtgtttcttcctgttttgcttaaacagaaattgtttcctttcctttttttttttttttttttttgagacagagtctcactctgttgcccaggctggagtgcagtggcacgatctcggctcactgtaacatctgcctcccaggttcaagcaattctcccacctcagcctcctgagtacctggtactacaggcatgcgccaccatacccagctaatttttgtatttttagcagagatggggtttcaccatgttggccaggctggtctcaaactcctgacctcaggtgatccccctgccttggcctcccatagtgatgggattacaggcatgagccactgcgcctggctgcttccttttctttaaaacgtgatatgagagatttttctgtggtggaacattgagttaatcacattttggttttgcttaattatgatagcttacctaatgtcacatttgatgtgttcaaccagttctgcaaattaaatagactgcaagagcagttccataggtttccatataaagttattaattccagatgaaatagtggtggtacatccaaatagctaatcaaattgccttgcagattcagaagttttaggcttcttagaggcacaaatacatcagcattcagttgttctattttgttttggcagagatataactgttttagtttatttaagcctaaaaatgcaccctgttgaattacatagatggagtttctacagatatttaaaatttctagactggagaggttaccaaaaccgttattatgtaagatagtaaccttgttctcaatcaaatagagctctgtgagtaaaaagtatgtctgtagaactcttgtgtctgtaccattaagagtaatttggttataactgagatcaagtatagtaacatctttcttgatatctgctggaatcaaggtataatttttttcagtaaaattacattggacttcctagaaaaacaaaaaaaagaaaggcattaatcagaaaaaaaattaatagaatttcaccaaatttcatatttaagcacttagacattagaaggacgttattttgggaaaaaaacctactatctaatattttggtgttacagtagagcaaatctttttctttattgggatgaaatactaaaaattaaggatattctgatacatacaattgaacaaagagattccaatttgtcatacgggtattttccaactgttattacatgatcattacagaaagtaatgctactggaatattcccatttatatatgtggaaatgtatggtaaataataattctgttaacatttaatattccagtgtgcacaattgctttatagtgaggaaattattttaaactatatgtgtttttaaaatcagcagagctaacaacattatacctagggctgttcaataattaataaatgggctgggcatggtggctcacgcctgtaatcccagcactttgggaggctgaggcaggcgggttacctgaggtcaggagttcaagaccagcctgtccaacacagtgaaaccctgtctctactgaaaatacaaaaaaaaaaaaaagtcagccgggcatggtggcaagcacctgtaatcccagctacttgggaggctgaggcaggataatcgcttcaacccaggaggcggaggttgcagtgagctgagatcatgccattacactccagcctgggcgacagagcgagattccgtctcaaaagcaagcaatcaatcaatcagtctgaataaactctctggtttaactctcttaaactctctgggtttaacagctcaaagtttggtgttttaaaaggaaatatttatcttttatcagaaatggagccaggtattgaatttaaagagccacacaatctgaaattctttatgtggatatagatggaaagaaagaaatagttcttgtttttactgaacagtaaactaagaataaatagaactaagaatagttctggtttattactgtttttgcagttagattttttcaccaataataattcaatagcagtttctctcataaatatgtgctttttaaaaaaaagtttcctacattttaaacaagattttactcttaaaactaatttctgattttatagtgaaaattttcagatctctccctttaatcaacttttaaagaactcagtttttataaatgaaggctgcttttgtcaaattggaatttggatatacagagctaaataaactcttaattttagtaggtcagattttctttgctttcttattgcccttttatattttactaaatatacagaaaatgtacctttgaaaatatttttactattttgattgtaaaaacttactcttttagaagactggattttgtctgataataatatcatggagaggggccaaaagaggattgtgatgcctgtgactttcatgttgcagacctgatagaaaagagagtattttcattaaggacatttttatttttccctcttttgaatctgtttattctttttttttttttttttttttggctgagacagggtctcactctgtcacacagacctggtggcatggtcacagctcactgcagccttgatctcccaggcttaagcagtcctcccaactcagcttcctaagtagctgaaacacaagcatgcactaccatgcctggctaattttaaaaatttttgtagagatggggtcaccatgtgttactcagcctggtatcaaactcctgggtgcgagccatttccccccagccactggcgtggccttgaaaagtgctgggattatagatatgagccacttaccctggcctttcaaatctactttttcttgaaatacataaaatgtgaaacaagtgcatggccattcaccatccttgcactctgatcttaataaactagaaagcccctttgaagaatgagactgatttctattttttctttttagagaaaattaatatttttaagtgtgtctcattagtttctagatctcatgaaaggagctttaaagcaatttaagtggttgtaaattttaaaaatttaatatagaagtgcacaaaagaaattcaggaaaacgtatatttatgcatgtttaagtatatgcttatattgatggtcttgattttttcaattttaggcattatctattggcattatctatctattattcttgacttaaaactgtgggagatgagaatctttagcactctttttccccccatggtaacttttaaaaattttattgaggcgtggtagatatacatagttttggggtacatgtgataaagtagtgcattcatataatttttaaagatcaaattaatgtacttgggatatccaacacgttaaatatttgtcttttctttataatggaaacattcaaattctcttctagctgtttttaaatgtacagtaaattagacgagagggagagcatcagaaaatagctaatggatgctgggcttaatacctaggtgacgggttgatctgtgcagcaaaccaccgtggcacatgtttacctatgtaacaaacctgcataacctgcacatgtaccccggaacttaaaaataaaagttgaaggaaaaaaattactgtaaactataattaccctactgatctaacactaggccttctttttttaagcaaactgtatgtttgtatgcattaataaacttttctgcattcctccctccctaccaccctttccagcctctggtaaccactagtctactcttaatctatatgaggtccacttttttagctcccacatgccggtgagaatgtgtgatatttgtctttctgtgcttggcttatttcacttgacataatgacctccggttccgtttttgttgccgcaaatgacaggatttcatttgtttttatggctgaataatattccattgtatatatatgctacttttttttaatccattcatctgttgatgggcacttaggttgattccatagttttgctcttgtgaatagtcctccaatacacatgggagtgcagctatctctttaatatattcatctcttttttttaaatgtatacccagtggaattactggatcaaatgtaaatgtaagtgttatatttttagttttttaaggaaccttcatactgctctccagagtggctatactaatttacattcccaagagtgtatgagggttcccctttctccacatcgtcaccagcatccgttattgcctgtcatattgatagaagctactttaatgggggtgagattatatatcattgtagttttgatttgcatttccctgagtgattactgatgttgagcattttttccacatacttgtttgtcttttgtgtgttttttgagaaatatctattcagttcttttgccatgtttacttggattatttgttttttatcggtttgtttttggctagtgagctgtttgagctctttatatcttctgattattaacccctttttagatgggtagtttgcaaatattttctcattccgtgggttgtctcttcacttttttgatcattttctttgctgtgcacaagcttttttgcttggcgaaaccccatttgtacatttttgctttggtttcctgtgcttttgaggtcttagagacacaaaaaaatctttgtccaggccagtgttctagagcaattctccaacgttttctttttttctcttttttttttttaaataaagaaaagaggtttaattgactcagttccacaggctgtacaggatgcacgtctggggggtcctcaggaaacttacaatcatggtggaaggtgaaggggaagcaggcatgtcttacatggctagagaaggaggaagaaagagcagagggaggagctacacacttttaaacaaccagatctttttttcttttgagacagagtctggctctgttgcccaggctggagtgcagtgatgccattttggctcactgcaacctctgcctcctgggttcaagtgattctcatgcctcagcctcctgagtagctgggactacaggcatgtgccactttcatgcgggtccatgtgaagagaccaccaaacaggctttgtgtgagcaacatggctgtttatttcacctgggtgaaggtgggctgagtccgaaaagagagtcagccctccagtgttttcttgaaacagttttatagtttgaggtcttattaaagtctttaatccatttttattcctggatatggcaagagataggggtctggtttcatttttccatatatagttatgcagtttttctagcaccatttattgaaacaactattatttctccattttatgttcttggcacctttgttgaagatgagttgatgtaaatgtgtgtatttatatctgagttctctattccattccattggtctatggatctgtcttgatgccagtaccatgctgatttggttactatagctttgtagaaaattttgaagtcaggtagtgtgatgcctccagctttgttcctttttgctgagggttgttttagctatttgggatcttttatggttccatatgaattttaggatttttttttctacttctatgaagagcgtcactgtattttgataggaattgcattgaatcagtaaattgctttggttagtattgatattttagcaatgttcttccactccatgaacatggattatatttccatttttttttgtatcctcttcagtttctttcatcagtgttttacagtttttgttatatagatatttcacttcattggttaaattgattccaaggtattttatattctttgtagctatcgtaaacaggcttgctttcttgatttctttttcagattcttcactgttggcatatctaaattctaccaatttttatatgatgattttatatcttgcaactttactgaattcagttgtcagtttttacagattttttgtggagtatttagggtttgttttttttttaattttttaagtgtaagatcatgtctgccaggtgcagtggctcacgcctgtaatcccagcactttgggaggccgaggcgggcagatcacctgaggtcaggagtttgagaccagcctggccaacatggcgaaacctcatctctactacaattacaaaaattagccgggtgcagtggcaggcacctgtaatcccagctacttgggaggctgaggcagcagaattgtttgaacctgggaggcagaagttgcagtgagccgtgatcatgccactgtgctccagcctgggtgacagagtgagactctgtctcagaaaaaaaaaagaaaaactaatcagagtaggcaagaatccatgcagcatactaaagtctctcgcctcgttagcaataaggaatttactgctattttagtgctagtctgttctagtcaacttcctcattgcctttgatttgttgatccatttatgcacattccccttctaccttttctctttccatagttaaatgaaatttgttaggaaaagctactctgcctcctatattttataaaatttggatgtagatcataatagaatcccttttagagccagaagtgcatttaaactatcacttattcaagatgattgcccatagaagagggatgcctaaatcatttacaaaaggtagtttacctatgtttaatgatttataggaataggtgttcagctccttcaatggcttgtttcagtatttctcaatgatgtggtgaaattcttactgatgtctctagtaggctgcagaggtgactgaggagaggtgggtaagggaagtgctgttttttttccagaaacaaataggatggggatagtgaaagaaagcaaataggctacaaagaaaatgaactagatttaagttaaaagttgatatgaaatagaagcaggtgaaaaaagtaatggaggcaagacaggactgtgagcttatgtggaaatggagacggagtatggttttatatttattatctgtatctgctatttaatgctaataattgttttctcaagtgcgctaaaagaaaaaaatcataaggattagaaaaggattttttttcctttccattggatagatcttggaagcagtgtatactcagctcaaggtagattctgtacaagaaagcattcaacaaatctaaagcatcgttaggtctgaagctgtgaaatacattgattgatccatactatctgtgagagttttcacatatttgtgtgccttttcagaggagaaagattgaaagagggggtgatgtcgattatcatgacactgagtaagtccccagacaaagcatttgctagcattattgggtgtctttaaaaaaagaaaatcagatacgcagaatagctggccaagtagattatgcagaaattatccatcagtcagtttagcctgtttcaacagttggtttaaaaggaagtcagtcattgttgctttctttctccttttggaatattttctaatttggattttttttgaaatgatagttgagtttcatatagtgattacttaggagctaatataaaatagaaaactggaatagaagatggaatatcagtttcttttgttatttcacaaaattacgtgcatttttacctagcatatgatctacgttactgaaaaaaaaagagctttactcaaaggaaatggtagatactgaaaaagaagcattgttcttaataaagtttcaagtacatgtttcttaagttatttactttatatgattattatatgctatgaaataaagagatgctgtaattattttggttttgttaaaatctaaatgtagtttttccattaagtattttagatatttatgccagaattcaatgtatttagagaatgatgttaataatacacaattaactttgtttccttatttaactattgtgtagatttttttcagatttaaaacctttttgtaatggaaaatttcaaggaaaaaacctaagtaagaagaatagttatcagcctgcttcaataatcatcaactcatggccagtcttttttttatcttgccaattggcttttagattagtgtcacttcagaatgctctgtgattaacatattttaaaataaaaattcttataaatttgattggctagatgaaaccatttccccccccgccccccgcaaaacaattacttagtattgtattctaactttatttaggaaagaccctttggccatgtctcaggtatatagtatttttgaggtagaccatgtgaaaatataatcatattttcttatttttcatcacttcttaaaggcaaagatggttgtacagacttaacaaacttaaatatgattaaaaaaaatacaacaataaccaaagctataaatatacatatcttacctttttttcttttgtctctaagacttgtgtgctaaaggaaattaactctgtttcaacggcattaaaaaaagtacatcgtatgattacatttcactttgttttaacctttgtacccagtgaacaggtgatttaaaaaaaaaaactagacttccttagcaaaagattgactagaagaataatttcttaaagtcatcttttccttttttagtataacaagtaaggctgtttgcctaacctttgtgtttctttcttttttttctttttttgagatgaagtctcgctctgtcattcaggctggagtgcagtggcatgatctcggctcaatgcaacctccacctcctgggttcaagcagttctcctccctgcctcagcctcctgagtagctgggattacaggctcccggcactgcacctggctaatttttgtatttttagtagagatgcggtttcaccatgttggccaggctggtctcaaactcctgacctcaggtgatacccctgcctcagcctcccaaagtgctgggattacaagtgtgagccactgcacccagcctacctttgtgtttcttaattactctttgaaaattttattaaagtattaacaattttacttactgatttagagtttacaatattgaaaatgcatacttttgaaagatatactgttgctaaattaatttatgtttgtcctgatggtattttgtgcttagaagcattcaaactgaggtcaggtgcagagtctgacacctgtaatcccagcactttgagaagctaagatgagagaataatttgaactcaggaatttgagaccagcccggccaacttagcaagaccttgtctctactcaaaataaaaagtaaaaacattagcagggcatggtgttgtgtgcctttagtcccagttacctgggtggctgaggtggggggatggcttgagtttgagcatgcagtgagccatgattgtgctaccacagtctagtctgggtgacaagtggtacctgtcaagaaagaaagacagaaagagggagagggaaagagagagagagagagaagagaagagagaggagggggaggggaaggaggaggaggaggaagggaaggaggcagggagggaggaaaaggaaggaaggaaaggagagagagagaaaagaaaggaggtagggagggattcaaattgtaaagataccaccaagttttgtattctattgagtttcaacgtttttgtttacttattattgtgtgtttttttttttttttttttttttgagatggagtctcgctctgtcacccaggctggagtgtagtggcgcagtctcggctcactgcaagctctgcctcccgggttgacgccattctcctgcctcagcctcccaagtagctgggactacaggcgcccaccatcacgcccagctaatttttttgtatttttagtagagacggggtttcaccatgttagcaaggatggtctcgatctcctgacctcgtgatctgcccgcctcggcctcctaaagtgctgggattacaggcatgagccaccatgcccagcctgtttacttacttttatgacaccatcatcagtggttttactgccaagttataacaggagcaaagtactcaaagcatcaaaaagaccttacacctggacatcatatggcctttagaaagtcagttacttttcttatgctgtaatttctcctctgtaaaatggaatactttataacattagttctcatcttcctacattgaaagaagaaacactgttggtagtcagtaatcaaatttagaatgaattccttccaaaagattaattccactgggcttcagtatccttaatttatgaaaatagatactttcctttcaatttctttgagctcatatacctatacaaattgtagcagcaggaaacacatttgttttactgttgtaattgaagctccaagtgaagataccacttcttctccaacagtgaaacaaaaataaattgaaattccaggttgctttactatgttcatcttttatttggttattttgagattttttttggtagggaaatttctgagtttaggttgtttattctagtagtaggatatgaatgtgtagaaggtgtgtaggggatatgtggatccacaagcttagctggtgattgtgaaaactatagaagttggtatctatgagcgaaagagagtaaatagtgataggttaatcagattttgaaactcaaaatagaaattaatgatcttgggagtgaaaatgtgtgttcaatccagctttttataaaatgtaaatcttgaaagtatttagataagtggcatcttacctattcttttttcagagtttttctctaccctatcaataattgaccttgcctaggcaacaagtgacatgtcattggtatttcttttgattacgtgataaaaatggttattgcttctaattaatttcactattactacttttataggattatgtttgtaatgtttattgtgtttttagagaaatgagcttaatattttacaatgctaaaaaatagcaaaaatttgtgaaatagcaatgttaactaaagcagtaagtaaaagagaacttaagcaaagcatattattaatctaaagccataactaaaaaatcaaattgcactgcaggcctctctactccctagttctgtcagagccacactggatgatttacacgggaaacttctatacagtatttaatttagtcagaaaaacttatggctaaaggatgctttaaaaccacaattctaaaacttatttgtcttttttttttttgagatggagttttgctcttttgcccaggctagagtgaagtggcgcgatctcagcccactgcaacctcttccccactgggttcaagcgattctcctgcctcagcctcccaagtagctgggattacaggtgcccgccaccacgtgtggctaatttttgtacttttagtagagatgggtgttttgtcgtgttgcccaggctggtctcgacctccagacctcaggtgatccacctgcctcagccttccaaagtgctgggattacagacgtgagccaccgagcgcagcctcttatttgtcttttgaaggtataactttaaaaaagtataaatgcatcctcatatatataagtcattaaggattttttggtaatctttgtgatttcttagtaaaataaaatggagagtaaggaaatagaggaatttagggatggagaagagaaagatgtaaaaataagtttgtgctaatggggccaaattttatataggtcaaatagcattttttagtacaaatataaagacttttcagtcacacactgtggttgaatgtctttaagtatcctattaaattaggaccatgacttgtataaaataattggatattttttcctcaatatagtatcaggaatattacgtgcttctgattttaggaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggtaatacaaattactgctgtgtgccaagcatgtatcattcttgctactaaaagtatagtttgaatatcagcagcatcagcatcccctgagaacttgactatactttgagatcagttttcattttaacaaggtccccatctgattcatacgtatattcacatttcagaagaatttatttagaaaacttcattttcatctgctgtttgatgacctagcttttactcttattatttttggtttacttctatttattcattttgcatttcataaagacatgaaaatactcgcatttataaaaatacttgtctataaatatttgcatttataaaagtacttttctataaatgtttgcattgataaaaatacttgtctgtaaattaaaaagtctgtaaatacttgcagttacagacttttaatgcaaacattaaaaggcctcataggtggaggttgcagtagtgagctgagattgcaccactgcattccagcctgggcaacagagcgagactctgtctcaaaaaaaaaaaggcctcatagaccagatccatatatatatttactttccttttccttcctgcttaataaacagctaacctttttacctgttagcattatgatttgaatggctattgtcctgtaattatattgcctaaatttccatttttaaaaattaatttttttattgatacacaattgtacatatttatggggtacatgtgatatttccatgcacgtatgcaatgtataatgatcaaatcgggataattaggatattcatcacctcaaacatttggcattttttttgtgctggaaacatttttttttttttaatttaaaaaaaattttttttttgagacggagtctcgctctgtcgcccaggctggagtgcagtgcccatctcggctcactgcaagctacgcctcccgggttcatgccattctcctgcctcagcctcccaagtagttggcactacaggcgcccgccaccacgcccggctgattttttgtatttttttagtagggacggggtttcaccgtgttagtcaggatggtcttgatcgcctgacctcgtgatccgcctgcctcggcctcccaaagtgctggtattacaggcatgagccaccgcgcccggccttatgctagaaacattttgaatctccttttctggctattttgaaacatacaattaattactgataactatagccaccctagtgttctatcaaacatgagaatttattccttctctcccccacaccaccccatgcccccaactgggcaccaccttctcagcctctggtaaccatcattctactacccccttttttttgtttttttttttttgttttttttgagacggagtttcgctctgtcgcccgggctggagtgcagtggcgcgatctcggctcactggaagctccgcctcccaggttcatgccatgctcctgcctcagcctcctgagtagctgggaccacaggtgcccgccaccacgcctggccaattttttatgtgtttttagtagagacagtgtttcaccgtgttagccaggtgatccgcccccctcggcttcccaaagtgctggtattacaggcgtgagccactgtgcccggccgagatccacttttttaggctcctacagatgagtgagaacatgcaatattaaataagcaatttaagtccctgttgagggcatattgagaatcctctcaatactcagtcatggtggttccctttcatgcccagatggcccttaactaaagattaagcaaagaattaggccccataaatgccaataatgattatagttttagtttcttagacattcctttgctgacaatttagtaacctttttattttagagaagatttctaagatactgtgaagcgttgaagaaaaagtatggcctggccaagatggtgaaaccctgtctctactaaaaacacaaaaattagccaggcatggtagcaggcccctgtaatcccagctactcgggaggctgaggcaggtacttggttgatcccgggaggcggaggttgcagtgagccgagatcatgccactgcactccagcctgggcaacagagcgagactctgtctcaaaaagaaaaaagaaagagtatgatagaaatgccaaaatagtaccaaaatatagttaatcttgtatgggataatgaatgagtaaacagtttaaggatcttatcttaggagtgaaccatatttatatttacatatacgtgtatgtatgtgtacatgtgaaccatatttatatttacatatatgtgtatgtatgtgtgcatgtgttatatgtgtgtgtacacagtatagagaaattaggcaaaagatgtgaaaacacggttacaaatcaaaattttaaataataatcttaaacaatgacataatttgaaagcttctgatatttgatgtctcagaacatagtgatgattcagtgtgaaaaggtctaaggtctagctacttttgagaaactcatgaagttttttttttttttttttgaaggcacacagcaagtttttaagaataatgaaagaagttgggaaaaatagaaataatgaagtgttaataaattctagtcaaaatgtaagatgccagtgaagatatttagaaaatttacttagtcactttgaaatgttgagaaacagagaaataaattttttttcccagctccctccccccactacaacaaattattcttaatgtaatttggatttatgtttgcttttttttttccacttaggaattagatacacttcaacaacaattggattcacagaacatgaaaaaagagagcctggaagcagtaagtataaaatcaaataagggttctcatactactcagctaaaaaagttaattcagccaagtatattaatataactaattcaactacatattgatctggcagcttactaataggagtttaatactttttcttcctattctggacccacaaagatcctagtatggtaagaaattagattcagttattgagtacctactatgtataaaacaaatcattccgccctacctaggacatgcaaaatccaatagcaattaaaaaaattatttttttagagacagagtctttctttgtcactcaggctagagtgcggtgacatgatcgtagctcactgtaaattcaagctcctgggctcaagcgatcctccctcctcaggttcccaagtagctaggacttcaggcaggaaccaccacacctggctaattttttttttactttttgtaaagacagggtctcgttatggctgatgtacagctcctggcctcaagcaatgctcctgccttggcttcccaatgtgctgggattacaggcatgaggcattgtgctcagcctctaatggcaatttaaagacacatacacaagagattataaaaacaaagaaagagggagagacatgagttcatctctttaaggatgtaaaaacttactttttttattcatttatttaaaacgctttatttcacaaaacaaaatgtgcatatggtttaaaaatagttgaacaagaggaaagtaaaaatgtctgtttttttttttttttttttttttttttagacagagtatcgctctgttgcccaggctggagtgcagtggtgcgatctcggctcactgcaagctccgcctcccaggttcacgccattctcctgcctcagcctccagagtagctgggactacaggcacccgccaccacacccagctaatttttttgtatttttagtagagatgggatttcactgtattagccaggatggtctcgatctcctgaccttgtgatccgcccacctcggcctcccaaagtgctgggattataggcgtgagccactgcgcccagccaaaatgtctgttttgtgtccttctttccagatagaactactggaaagacatttatcaagtgcttactgtatgcttttttgagctgtaaacacatatcagcatcatcttcatgtaatccccacaagagtcctaaatcccatcttggttttacagttgtggaaaacctcaagtggggttcctacgtgctatgctagctgcagctttcttttttcaccctaacattgtatctacagtgtctatttatatcagttcctagagaacctcctcattattttaaattgctacaatgtattatgttgtataattataacacagccttgtaaatgaacaggttgtttatagttttccgggattataaacaatactcctgtgaaagcatacattttatgcgaagttatatcataagattgaattctcacaatgggtcaaaaggtatacagtttaaaaatgttgtcagattgccaaattgccttcaaaaaggttgttccaacttttacttctagatgtaatgtatgtgaatgcttatttcccctgcattcactgacagcaaatattatctgacttttccagttttagctattttgataggtaaaaattactaccttatttgaattttcatttatttatgaataaagttgagtatctatttatatcatttttggccaatgaatttctttttctttgaactcctttttcatatttttggcgtttcagtatactgtctgtatctcaaatcttgcctccctttcctgatttcctgtggattcaggtagacatcatgatgacagtattaggaactgttgtagactgatagattgctgacaccctagcttgcaaaagaaatgagtattttgtaattaattcttttgagaatttgctattgaaaaagttatttaattaaaaatagtaaggtagttggctgggcgtggtggctcacgcctgtaatcccagcactttgggaggccaaggcaggcagatcacaaggtcaggagatcgagaccatccttgctaacgtggtgaaaacccgtctttactaaaaatacaaaaaattagtcgggcatggtggcaagcacctgtagtcccagctgctcgggaggctgaggcagaagaatggcatgaacccaggaggcagagcttgcagtgagccaagatcacgccactgcactccagcctgggcgacggagcaagattctgtctaaaaaaagtaaaaaaaaagcaggtagttttctgtgtctggttgtccatctataaagacacttaatttttatttccttggatctctggtgatggaaatacgcttaaagaaagaaggaccacatttagtattaatacaaccagcttgcagaattcctcatggttcttttttggagtgggtttgagagagtcaagtcttacttcacttggtgaatttggtttccataggaaaaatcataagctataaccttagatttactttttgtactgatgccgttcttctctgatgtcagtacatttatgcctaaaataacaagagttttaaaaatacacaatatgtgcaaattaagataacatgtcactaattctatttaacttttgccagatttctttctttttaaaaaaaaaaatttttttgagacagagtcttgctctgttgcccaggctaaagtgcagtggcacagtcttggctcactgcaacctccgccttctgagttcaagcaattctcctgcctcagcctcccgagtagtgggattacaagcgtgcatcaccatgcccggctaatttttgtatttttagtagagacagggtttcactgtgttggccaggctggtcttgaactcctgaccttgtgatccacccgccttggcctcccaaagtgctgagattacaggcgtgagctatcacgcccagcccagatttcttttatttatttgtttaggacttgttcttcaagaaaatacctgtcagatagtggtcaatcaactagtattttttgaatactttatgttcactgctgtacaacgtattaggtcatgcttattcagttcacaagagtggaaaaaatcaggtgaaggattaacatgagcttaagtcttccagaacaattttatcaagatgaaattcaaacaaatctataggattgttaggcaaaaaggagacgatactatgaaaaaggatagcataaaatatctgcatttcttctatgtctttttagcatggctttttttaatcttatctgatgcctaatctgttacttgaactgtatatataatccattgcttatggactttgaaaaattatctcgtctactcgttccttttttggaggttccttctttcatacttttagaagagaagaggttggccaggcacagtggctcacacctgtaatcccagcactttgggaggctgagatgggcggatcacgaggtcaggagttttgagaccagcatggccaacatggtgaaaccccatctctactaaaaatacaaaaattagctgggcgtggtggcaggcgcctataatcccagctacttgggaggctgaggcaggagaatcgcttgaacctgggaggcggagtttgcagtgagccaagatcgcaccactgcactccagcctgggtgaaagagcgaaattccatctcaaaaaagaaaaaaaaatgaggtcttcccttctaagaattttattttgttcaagttgtaggtccggtttcaaatgtcactgttaactcttatgtctttgttaactttgaaaagttatttacatgtcagatccttagttttctcatctgtaaaatagagatgatagtactatcttgtagagtatcactttggatagtagagatagcatataaataacatgtagtatagtgcctggcacagaacagatgctcagtaaacaagagtctcaaatgtcattttaatcatcaccaacaccattcctaccttttttttggtgttgttagctaataacatttttgtcacatccttatttttttctttgtgaaaggtgggatagtggtgagtacacagtaactgttatttcatgtgttcatttcctagtgctgctataatagaatatcacaaactgggtggcttaaaagaaacacaaattttctcacagttccagagcctggaagtctgaaatcacggtgtcagcagagccatgcttcctctgagactctagacagaatcttgctctgcttcttcctagcttctagtggtatccattagctcttgatattgcttgacttgcagctgcatcactccagtctttgcctgagtcataacatggtattctccctgtgtgtctctgttgtgtctgtactcttcttataaagggcaccatcatattggattagggcccacccctaatgaccatatcttaacttgactaaatatgcaaagagcttatttccaaataaaggtcaaattgacaggtttatgatgttaagactccagcttacctttttgagcagacacaattcaacccacaaaattgtgggaaaatatatgttatgacctatttagggaaaaatatcttctctccaaagatcacttctatggactttgaatcagacattgtgtttaaagttgtacatatgttttgacattgtctttatcctcccattggtagagttgtcctatacttattcaggtcttatatgtagaaaataaaataaactaaggctatcaacttcttgtgaatcttagactgaaaatagcaggatttatttttattcttccaatttaggaatgtgctttgtagcattattgagtactaatgatatttgctgtctgtatttaaagatgctagtagtttaaatttacccccattcttataaactgaaacctattttagaataattattgataaaatactaattaaaactttcccttcttattttcctttaggaaatagctcactcccaggtgaaacaggaggcggtattgctgcatgaaaaactttatgagttggagtcccatcgagatcaaatgattgcagaagacaaaagcataggatctccaatggaagagagagagaaattacttaagcaggtgggcaaaacaaacatacttattttaagatgtctggttttggtacatgtattgatttgttttttttaaagggatattaatgcaagtagtaaagctagtaagtgtattgtctaaaaatagtttatgtgaagaaatgactttttaatctagattttcttcctcttttattattattattattattatttttgatgtaggatcttgctctgtaacccaggctggagcacagtggtgcaatcatagctcactgtagccctgagctgctggcctcaagtgatcctccacctcagcctcccgagtagctgggactgcaggcatgtgccaacacaccaattttttatttttattttttgtagagatagggttttactgtgttgcctgggctggtctccagctcctggcctcaagcagtcctcccatttcagcctctccaagtgttgggactataggcacccagcctagattttcttaatcaagtatttcatagtaacttaggtgaagctaacttttccttattaggaatacttgaaactcttctttattggtcattaaatatttagataatctttttgaagatatgtttcattattgttttgggccttgtatttagaaaatggagtatcccaaggctaatgactttttgtggttgttattatcagtgcctccatgaagagaatggaattaaaatgtcctgtgaaattatcgtatgtcctaaagtcatgacacatgtaacatgtatttagtagctttcttactaccccaggggtggatttagtttagctccaaattataattagcatgttgtttatcctgacacatcctaactataagggccttaggagaacttcatatgtatatgggcacagctccagtcagggactcctttgcccttagacttagatcaagcccagtgcatttagaagaaatgtaggtatcaattcagggactatttaattattagaatcatttcaaaaaggtattaaatctagaacctgtgtagttccttggagagaaatcattgaaagatggggaggagtgatcttgaggtacgcctaccacataaaatatagaatggctgcttaaatttgaatttcagataagcaataaataatctttcagatatatatatgtatatggaaaaattatttattgcttgtcaatgatatggatattccaaatattacatggtacatatatcctctcaaaggtattcactatttatctgaaattcagatttaactgggcttgctcaatctagcaaccctaccttgtgggaaactgaggggaatctcagaaatcctagatgtttatatcaacttatccaggcctgaagatgagctatcctcatggtgcctggagggtagctgtgagtatatcagttactacccttactttgaggaaaaaggatggaatctgtgaatggttccttggtgctgttccctttaacttcaaaggttgaaatctaaaaaatagatttcaagaaagagagtagatttgacactttagtacaattgtactctagaaggaaattatctttaagatagccttacaatgagttatttttttaaatactactttctttttatgcctttgtagattaaagatgataatcaggaaatagccagcatggaaagacagtaagtatctttatactaggacattttacatccatttctcactttaaaaattacattctaaaggtacaggagtggctttcattctttcaattttacttatagctttaaatatttctttgagtgtttaagagccattgcatagtataatttttttataagtatctttattaagatatactttataccatataatagacatatttaatgtaaacaatttaaaacattttagtatattcacagaagtgtgcagccatcacctagatcacctttatttttcaatttttatttatttttatctttttgagaccaggtctcattctgctgcccagactggagtgcaagtggcatgatatagctcactgtaacctcaaactcctgggctcaaacctcccaagtagccaggactacaggcacacaccaccatatctggctaatttatttttatttttagtagagtcgagatcttgctatgtggcccaggctagtctccagctcctagcctcaagtgatcctcccatctcagcttcccaaagagctgggattaaagatgtgagccagtatgccatgcccccagtcaattttagaactattcagtcagcccaataaaaccctgcaccctttaaccatcacctcccttatccctctcccagctctagccatgcccattctggacatttcatatatatggaatcattcaatatgtgcttctgtgtgtcaggatgctttcacttagcacagtgagccttgctttctcgaagatcagctgactattggtatttggctttatttctgggttctctgttctgttccaaggctcataggtgagccttgaaaactaagacaaatggaatattatttggaaataaaaattaataaaatactaagcatgtattagtttttattaatactaatacatgcttagtattttattaatttttatttccaaatagtattccattgtatggatataccatattttatttatttatcaattaatggatgtatgggctgttaccatttttttattatcatgagtcatgctcctataaacatccatgtacaagtttttgtgtgggcatatgttttcacttctcttgtatatatacctaggagtggaattgctgactcatgactatgtttaactttttgaagaactaccagactgttttccaaaacagctttaccattttacatttcatttatttgtatttgaatacatttatttgaaatttgtaaaacaatcattttactaccagtcaccagaaagcataccaattgttttaatttaatttttttttttttttctgatacagagtcccagtttgtcgcccaggctggaatgcagtggtgcaatcttggctcactgcaacctccacatcctgggttcaagggattctcatgcctcagcctcccgagtagctgggactacaggcacacagcaccatacccggctaagattgttttaattttaatcaactaagttgtaaattaataagtagtcaacaatgacgaaattgccttttaatgtctctcatattctattgtaatgtttttgttgctgattacaacttatgaaattaaattttggaatcacagtctctagtatcagctgaattgcagcccgtgtcaagtgttttgcaatactggctaaggtactaagaaactaattttttttttctgttttttgtaactgtaagcaaatttctatattcttatggctaagagaatatttttttcttttaggaacatttaaagcagctttattttatcttttttatttcttttttttttttttctttttttttgagacagagtctccctctgttgcccaggctggggtgcagcagcccaatctcggctcactgcaagctcctcctcccaggttcatgccattctcctgcctcagcctccccagtagctgggactacaggcgcccgccactgcgcctggctaattttttgtatttttagtagagacggggtttcactgtgttagccaggatggtctcgatctcctgacctcgtgatctgcccgcctcggcctcccaaagtgctgggtttacaggcgtgacctaccgcgcctggcctatcttttttacttcagtagtttttggggaacaggtggtatttggttacatggataatttcttgagtggtgatttctgagattttgatgcatccatcaaccaagcagtgtccactctacccactgtgtagtgttttatccctcacccacctctcactcttcccaccaagtccccggagtccattgtatcattcttatgcctttacgtcctcatagcttagctcccacttataaatgagaacatacaatgtttggttttccattcctgagtttcttcacttagaataactgtctccaactctgtctaggttgctgtgaatgccattattttgttcctttttatggctgagtagaataaacatatatatatgtatgtatatgtataaatatatatgtatgtatatgtataaatatatacgcacacacacatacataccacattttctttattcacttgttgattgttggctttttggctgtttccatatttttccagttgcaaattgtactgctgtcaacatgcgtgtgcaagtgtcttttcatataatgacttctatttcctctggatagatacctcgtagtgggatcgctagatcaaatggtagacctacttttagttctttaaggaatctccatactgttttccatagtggttgtactactttatatttccacaagcagtgtaaaagtgttcccttttcaccacatccacaccaacatctatttttaaaaattttttaattatggccattcttgcaggagtaaggtggtattgcattgtggttttgatttgcatttccctgataatgatgttgagcatcatttcctatgattgttgaccatttgtatatcttcttttgagagtcatctattcatgtccttagcccacttttcacttttttatgggatttttttttcttgctgatttgtttgaacttgttgtagattctagatattagccctttgtcagatgcacagtttaggaaagttttctccaactctgtgggttgtctattaactctgctgattcttttgtggtgcagaagttttttagtttaattaagtcccatctatttatctttgtttttgttgcatttgcttttaggttctttcagttcatgaagtctttgcttatgccgatgtctagaagagtttttctgatgttatcttctagaatttgtatgggtttaggtcttagatttaagtctctgattcaccttgaattgatttttgtataagatgagagatgaggatccagtttcattctcctacttgtggcttgccaattatcccagcaccatttgttgaatagggtgtcctttccccaccttatgttttttttgctttttcgaagatcagctgactgtcagtatttggttttatttctgggttctctattctgtgccattggtccatgtacatgtttttatgccaatacaatactgttttggtgacctcatagtccttatagtgtagtttgaagttggttaatgtgatgtctccagctttgttctttttgcttagtcttgctttggctatgcaggctcgctttgggttccatatgaattttggatttttttttctagttctgtgaagaatgatgatggtgaaatgggaattgcattgaacttgtagattgcttttggcagtatggtcattttcacaatattgattctagccatccatgagcatggaatatgtttccatttgtttttgtcatctatgatttctttcggcagtgttttgtagttttccttgtagaggtctttcaccttttgggttaggcatattcccaagtattgtattgtattatattttgttttattttattttattttcacagctgttgtgaaaggagttgagttcttgatttcttttttttttttttgagacagcgtcttgctctgtcgcccaggctggtgtgtagtggcgcaatcttggctcactgcaacctccgcctcccgggttcaagcaattcttctgcctcagcctcccgagtagctgggactaaaggcacgtgccaccacaccggctacttttttgtatttttagtagagacggggtttcactgtgttagccaggatggtcttgacctgaccttgtgatctgcctacctcggcctcccaaagtgctgggattacaggcatgagccaccgcgcccgaccgagttcttgatttcttttcagcttggttgctgttggtatatagcggtgctactgatttgtgtacattgattttgtgtcctgaaactactgaatttatttataagatctaggagttttctggttgagtcttcagggtttcctagttatatgatcatatcaagagcagacagtgacagtttgacttcctctttactgatgtagatgccctttattcatttcttttttctgattgctctagctaggacttctagtgctgtgttgaatagaagtggtgagagtgggcatccttgtcttgttccagttcttagggggaatgctttcaactttcccctgttcagtataatgttggctgtgggtttgtcatagatagcttttattaccttaagatatgtctcttctgtgctgattttgctgagggttttaatcataaaaggatgctggattttgtcaaatgctttttctgcatctattgagatgatcatatgagttttgtttttaattccgtttatgtggtgtatcacgtttattgacttgtgtatgttcactcatccctgcatctctgctataaaacccacttgatcatggaggatctttttgatatgctgctggatttggttggctaatttttttttgaggatttttgcctctaagttcattagggatgttggtccatagttttcttttttttgttatgttcattcctggttttggtattagggtgatactggcttcatagaatgatttaaggaagattccctctttctctatcttttggaatagtttcagtaagatcagcagcagaggctgccatctcccccattgaacataacttctttggcctgaaaccaccccttccatcacccacattggccatagccagccccatacaagaggagtctgagctgagacacgcctaaccctgccccgacctgatggtctttctctacccgcctcgtagccaaagacaaaagacataaacttgtggcaggcctatggcctcaccaatcacctgagaaacccaaatatttattcaggtgaccttagggcaagcttgtatccccccatactactgcagctgatgccctcttgaaagtgccacctcctagctggaggccaaccaacacaaaccattacagcaattcataacagaacaatcctgctccaagggaaggagaaaacaacagctaattccactgcctgtaacatccacactaaccagaggccctgactctgttcacatgacagcttcactgccagcataaccagcattcaagaaaaccagtgcacgaaacaaaactacaaccaagaactctcacagaatccacttcactcttcagctacctccaccagagcaggtgctggtatccacagctgagaccctaaagacagatcacttcgcaggactcttcgcagaccctcccaagtacaagcccagagcccggtagctctggtgggtggctagacccagaacagcaataacaatcactgcagtctggctctcaggaagccccatctctagggaaagggagagagcaccacatcaagggatcacctcatgggacaaacgaatctgaacagcagtccttgagtctcagatctttcttctgtcatagtctacccaaatgagaaggaaccagtaaaacaattctggtaatatgagaagacaaggttctgtaacatccccagaagatcacactagtaccagcagtggatccaaaccaagaagaaatctctgaattgacagaaaaagaattcagaaggtcagttattaagttactgaaggagccagcagagaaaggtgaaaaccaacttaaagaaatttaaaatacaggatatggatgaaaaaaatctccagagaaatatgtagcataaataaaaaaacagtcacaacttctggaaatgaaagacacactttgagaaatgcaaaatacattggaaagtttcaacgatagaatcaaacaagcagaagaaagaacttcagagctctaagacaaggctttcagaataacccaatccaacaaagaccaaaaaagaattaaaaaaaaaaaaaagcacaaaggctccaaacagtttgagattctgttaaatggccaaacctaagaataatgggtgttcctgaggaagaagacaaacctgtaagtttggaaaatgtatttgagggaataatcaaggaaaacttccctggccttgctagagatgtagacatccaaatataagaatgtcatggctgagcacggtggctcacacctgtaatcccagcactttgggaggccgaggtgggcggaacatgaggtcaggagttcaagagcagcctggccaataaggtaaaaccttgtctctactaaaaatacaaaaatccgctgggcatggtggcacgcacctgtagtcccagcaacttgggaggctaaggcagaaaaatcacttgaacctgggaggtggaggttgcagtgagctaagatcatgccactgcattccatcctgggtgacagagtgagactccatctccaaaaaaaaaaaaaaaaaaaagaaaagaaaagaaagaatgtcaaagattacaactgggaaatgcatcacaaaaagatcatcacttaggcatagtcataagattatctaaagtcaagacagaggaaagaatcttaagagctatgaggcaaaagcatcaggtaacctataaaggaaaacctatcagatcaatagcagatttcttagcagaaaccctacaagctagaaggaattggagtcctacctttagactccttaaaataattatcagccaagaattttgtatccattgaaactaagcttcataaatgaagcaaagataaagtcattttcagagaaatgctgagagaattcaccactaccaaggcagcactacaagagcagttaaagggagttctaaatcttgaaacaaaacctcaaaatacaccaaagtagaaactccttaaatcataaatctcacagggcctataaaacaacacaatggaaatgaaaaactaaggtattcaggcaataactagcacaatgaatagaacaataccacatatctcaatactaacattgaatataaacagcccaaatgctccacttaaatatacagaataacggaatggataagaattcaccaaccaagtatctcccatcttcaagtgactcacctaatgcataaggtctcacataaacttaaggtaaaagggtggaaaaagttattccatgcaaatggtcccaaaagcaagtaggagtagctattcttatattagacaaaacagactttaacaacaattgaaaaagacaaagaaggacattatgtaatgataaaaggactaatcaaacaggaaaatatcacagtactaaatctatatgcacctaacactagagctcccaaatgtaaaaaacaattaccactagacctaacaaatgagatagacagcaatacaattaatagtgggggacttcaatactccattgacagcactagacgggtcagaaagtcaacaaagaaacaatggatttaaattataccctagaacaaatggactcaacagatatttatagaacattctacccaacaactgcagaatatacattctgttcatcagcacatgggacgtcctgcaagacagaccatatgataggccacaaaacaagtctcaataaatttaagaaaatcaaaattatatcaagtattctcagaccacagtggaataaaactggaaatcaactccaaaaggaaccttaaaaaccatgcagatacatggaaattaaataatttgctcctgaatgatctttaggtcaacaatgaaatcaagatggaaatttaaaaattctttgaactgaacaataataatgacacaacctattaaaacctctgggatacagcaaaagcagtgcctagaggaacattcagagcattaagtgcctacatcaaaaagtctgaaagaacacaaatagacaatctaacgttacacctcaaggaactagagcaacaagcacaaacaaaacccaaacccaccaaaagaaaaggaaattacaaacatcagagcagaactaaattaaattgaaacaaaaaattgaaagataaatgaagcaaaaagctggttctttgaaaagataaacaaaattgatagaccaatagcaagattaatcaagaaaagaagagaaaagatccaaataagctcaattagaaacaaaatgggagatactacaaccaataccacagaaatacaaaagaccaagcttacagtgagcacctttacacgcacaaactagaaaacttagaggagacggatagattcctggaaatatacaatcctagattaaagtaggaagaaatagaaactctgaacagaccattaacgagcagtgagattgaaatggttaaaaaaaaaaaattgccaacaaaaagtccaggaccagatggagccacagctgaattctatcagactttcaaagaattggtactgttttacatttctatgtaatataataagagcagcatatgagcagcatgtgagggttccagtttttcacatcctcacttgttattatctctttttctattatagccattcctaatgggtatgaagcggtgtctcactatggttttgatttgtatttgtttgatggctaatgatgttgaggttcctttcatatgcttattggccatattctttgggggaaatgtttacttagttcatttgctcattttttaaactagattgtttttgattactgagttgtaacatttccttatatatgctagatagaggtgtcatcagatacatgatttgtaaaaattttcccttgttctatgaattctatgaattatcttttcattttcttggtgtctttggaagcataaaagtttccaattttgattttgtccagtttttctatttttcttttgttgctcttgcttttagtgtcatatctaagaaaccaatgcctaatccaaggtcataaagactatgtctatgttttcttctaagagtttggtaatttagttcttacattgagatctttgatccatttcaagttaattctgtgtatgatgtgaggtaggagtcccttagcttctgcatatgcacttttcccagcaccatttattgaaaatactcttctttccccatttaattaccttagcacccttatcaaaaatcggttagctatagatatatggtcatatttctggactcacaattttagtccattgatatatatgtctatccctatgcctatactacattgttttgttatggtagctttagagtaagtataactgctttatgttaaaatattaacctatataatcttctgccagtggtaggttttcccttattttctcatttttgagactaattttccaacttaatttggcttatagaaacctacaaaaagtattgttaaatatttttcattttcttaatactgcaaatcaaactcaaaggaaagttgggagggggtgtgctgtttaactcaggcaactagtgttctcagaatatacctgggctccaaatatgaatcagtaaaaaagatctatgcttggcgcagtggctcgcgcctgtaatcccagcactttgggaggctgaggcaggtggatctcgaggtcaagagatcgagaccatcatggccaacatggtgaaaccccgtctctactaaaaatacaaaaattagctgggcatggaggcgcgtgcctctagtcccagctattcgggaggctgaggcaggagaatcgctttttcccgggaggcagagattgcagtgagccgagatcgcaccactgaacttcagcctggtggcagagcgagaccccgtctcaaagaaaaaaaaaaaaagatctagacaagattcttcctctctaaatttatagtattgtcctcataataggatatgctatttttcgatatttatgcaatttgtaaaagatatcctaatgtcatcgtcagttatagtattgtccttagaataagacatattatttttagatattgtttatgcaacttggaaaagatatctaacctccccatcaattgtttttattgaatgtctatatttccttcataaattcattaaaaatattttcaacaggttaacagatacaaaagaaaagataaatcagtttattgaagaaattagacaacttgacatggatttagaggaacaccaaggtatgcttctggtatttttataatgtagattaacagatgtttagcagtattaatatagtgttaactggtgtctcagagactgttcaactacctgggatttattatttaattctctatgatattactaactttactaaaatatatactgtatgagtaatattaaagcaatgatttaaactgaccacttatgagttaaaatgattgcataaaatttatttagctttgccaagcagtttgtttttttttttacaaaaacagaagtaaaatgtttaaagttgttagagattcctaagttatacttcctcctaagttacacttccttcctagtaatagtcaatagtttactataaacaatatagtcggccgggtgtggtggctcacgcctgtaatcccagcattttgggaagctgaggcgggcagatcatcggaggtcgggagttcgagaccagcctgaccaacatggagaaaccacatctctactaaaaatacaaaaattagccgggcgtggtggcacaggcctgtaatcccagctattcggaaaggctgaggcaggagaatcacttgaactcggaggcagaggttgcggtgagtcaagatcgcaccactgcactccatcctgggccacaagagtgaaactcggtctcaataaataaataaattaattaaataataataatatagtcaactactaatggcagtaactggtagcgttagaggggatgaaaatcaaatcacaaataccacacaaataatccagacagaattaattccccacccaggtctagtaatgaagtagcaaagactgattaaccttatcctccccaactttccccaggagtggaatttgaagaactaatgcaggtaccagaacacctgagggagcttggggtttgactatgtagaaatactgtggtgggggtttgggtgtgggggctacattgttatttatggttaaaggaggaggttgagcatcagtttcctaacaagcttctccctaataagaaagataaaagtagattctccatagcattttaatcatagtttaactgcaaaccagttactatgctcttggattatcaagaattgattgtatattcttatgagttaggtatggtataaacagtgtgcacatgtacatgtattcttgttatggctaaggaaacattcatagcggtgcagtggctcaatcacagctcactgcaacctcagactcttgggttcaagtgatcctcctgtctcagcctcctgagtagctgggaatatataacgtctgccactacatccagctaagttttaaatttttagtagtggcgcatgcctgtaatctcagctacttgggaggctgaggcaggagaatggcttgaacccaggaggcggaggttgcagtgagccaagatcacaccactgcactccagcctgggtgacagagcaagactccgtctcaaaaaaaaaaaaaaaaaagggtacactgttctatattttagcagggaaggaatttgtgtatgtgtgtgctaactagaaacaatgagaaatagctctaatgaaagttatatggtcagaatttggctacaagctctgcatcattagtaaagcggagtattattggcagatgtcatgctactttccaaaaagcctgaacccatcctgatttctcctttcttagttgaaatgccaacaattgcatatttgcttaattattgctttttaaaatattggctctgtataagcaagggaaagtaatagaaaaagtattgttcttccaagtaaagcagaacacaccaagtggacaatagcagcttatattttcactcaacatgggatactatttttaataaggatgtttttatcctcaaggcttacttctaacatatagccaagtgacttttttgtttttaaatggagatgaatcttgctgtgttggccaggctagagtgcagtgactatttacaggcatgatcatagcttactgtggccttgaactcctgggctcaagcagtcctactgcctcagccttccaagtagccgggactacaggtccatgttactgtgcccagcttgtttttgttaaggaatctgttaagaaattcttttaggtcgtgtgcggtggctcacgcctgtagtcccagcactttgggatgccgaggtgggcggatcaccaggtcaggagatcgagaccacggtgaaaccctgtctctactaaaaaatacaaaaaattagccgggcctggtggtgggcgcctgtagtcccagctactcaggaggctgaggcaggagaatggtgtgaacccaggaggcggaacttgcagtgagccaagatcgcgcctctatgctccagcctgggtgacagagcgagactccgtcttaaaaaaaaaaaagaaattcttttattcttactacagattaatacttgagagtttatatcttatattgaagtccttcagagtaaatagtttcttcgaccacttagctgaaatcaggcccttaactttactcatttttttttttttttttaatgagatagggtctttctgtcacccaggctggagtacagtggtgtgacaacatagctcactgcagcctcaaactcctgggctcaagtgatcctcttgccttagctaaataaaataataaataaaataaaataaaataaaataaaataaaataaaataaaataaaataaataaaataaaatgtaaaataaaataaaataaaatgtaaaataaactcctgagtagctaggactacaggtgcacaccaccatgcccagctaattgttgaaaactttttttgtagggacagggttttgctctgttgcccaggctgatctcaacgtgcttggctctagcagtctttctgccttggcctcctaaagtgtggggattacaggtgtgagccactgtgcctggtgttttactctttactagtgtattcccttacattgaataaattctataaagaacagcattactattataagacatgtcaaagccttacacaaatcacaaaaaaagtgatcagttttctatgcaaaaatactgagccttttgaaatcagggtagttctcagcttcacccaatgctggcttagatttcaactttctcaagtctgctaggtcagttaccagttctccatctcctttcagcttccaaaatgttattgctgttgtctcctatttctatatgctgggggtttctacctttaaaaattctttttgctatagttttagtggggtttgcgggaggatcaaaattagatgtgcatgttcaacgtgccattcataccaggaaatgacaattataagccttaattacctagaatttctgaaactttaagcaccttgaaggtagatcattttacttatttttaaaaagattttttttgtgtgttttgccttaaatgaccatcctcatgctttcattaactgggcaattagcctcagcttataggaggtcatccttttcagcttaaaaaaaaagtgtcctggccgggtgcagtggctcacgcctgtaatcccagcactttgggaggctgaggcaggcggatcatgaggtcaggagttcgagaccagcctgaccaacatggtgaaaccccatctctattaaaaatacaaaaattagctaggcatggtggtgtgtacctgtaatcccagctactcaggaggctgaagtaggagaatcgcttgaactcgggaggcagaggttgcagtaagccaagatcgcgccactgcactccagccttgggcgacagagcaagactccatctcaagaaaaaaaagaaaaaaaaaagtcttttaaactacttaaaattattttaaagattcagattaattttttaaaattgtaattttaaatatgaatctggcatgtatttaacatgaaaaatgcaagcagaaaagtatataaagtaaaatgtcatctcctttctcctcatccaagtcttcagaggtaatcatggtttacagtttaatgtttaggcttttagacttttaatacattgataaacatatttttaaatggagtaatactaatatacagttcttctgagcttgagtcttttcatttaactgtataatatacattcttccctatgaggatgtatacttcattctgagaaatggtatagcatagtggtcaatgttagggctctaaagtcagacttaagaatggtgcctggtacaggtgtggtggctcatgcctataatcctagcactttgggaggctgaggggggtggattgcttgagctcagaagttcgagaccagcctgggcaacagggcgaaaacctgtctctacaaaaaaatacaaaaattagccaggcatggtgatgtgtgtttgacttgtagtcccagctatttgctaaggtaggatgattacttgaacctcggaagtcgaggctgcagtaagccgaaatcactccaaccaaaatcatgccactgcacttcagcctggataacaaagtgagaccctgtctcaaaaaaaaaaaaaaaaaaaaatggtgcctggtgcacattaagcgcttctgacaaccattagctacccctatgattgttgttacataggattcattgtatccacattgatatttaggctgtttctaattttttactcccaagaacagtgctgcactagtacattcatgtttataacttgtctgtttatttccacagaataaatttctagaagtgaaattttgaatggaatattatttatatttacaactggtttgcaaatttcttcccagaaaaggttgtattatgttatacaaccaaaagcagtatgtgaaggtggttccttaccaatgctagccataagttttttagtttttgtcagtcaagataaggtacacatcactgacagttccgaagttttgactgttaggcctgaatttgtagtaccaccgcgatccacaagatggggctaattttctgagcatctattaatatatacacagtaggattgacaaatagagttaacaaatgttgtacggtcactgtcatatgtctctccaggagggattattgggcattattactcaccaaaaatgattactttccagattcaagtattttcccaaatgtggagttgattgtaaaaccaaatatatgattattaaaataccataatacatataaataactagttgctacaatgtggtaaatatgtcataatagaaatatatgcaaagtgctataggaatattgaattactgtcttaaattctgaatgaattcattgtaactttctgcataatatatatgtgtcattcaaagtagtaaaataacaaaatataatactttggtttgtctatagtatactttttcatactcagagttctaaagccttggttaggaccattgtttctttaattatggagggtaaaataaacaatgttaaagacagaatacttttatttattatttatttgtttatttatttatgtattttgagacggagtttttctcttgtggcccaggctggagtaaaatggtgtgatcttgacttaccgcaacctccacctctcaggttcaaacaattctcctacctcagcctcccaagtagctgggattacaggcatgcgccaccacacctggctaattttttgtatttttagtagagatggggtttctccatgttggtcaggctggtctcaaactcctgacctcaggtgatctgcctgccttggcctcccaaagtgttgggattacaggcgtgagccaccacgcctggccagaatcattttattttaagcacatgtcctgttactagaatgcctggattcaaatccaggctgtgctgtttgatcttggacatgctatttatgctatttaatcttactttatcttagttttttttctttaaaatggaggtaattacagtacctacctcttagggttattgtgagaattagattagataattaaataaacttaattattaatagtctaatgttggctggaagccttaccaataacataaatggtaaacatatataaacacaaaacacattcataatagcagtcaatttaaaatatgctcataaatattaattagtgacttattgttaatgctgttactttataaaagcaaaattgaataactttactgcagttattttcccaaagcatacattagaaagtattttcccgtcagtatttccttcaggatgtacaaaataacctatttagtttcaaagtggtttatcttctggtatctgagatttcaaatggcatctatccattactattctgtggttttccaacatatatctgctgaagaagaatgaattattattgttcaatctagaaattgtttaaactatacattgaatctttcattaaaatggtggtattacatctacaccaggatcatcaccaccatctgaaacttgttagaaatgcaaattcttgggctctaccccagacctattgaatttgaaaccctaaggagagggctcagcaatttgtgtttcagtaagtcctcctggtgattctgattcatgttaaagttttataaccactactttcgaaaatgattaaggaccatatgtttagtatatgctgcttactaccaattatactgtatgattttatatacagtactctgttggaacaaacttctacatagtccttttgttttacataattagataataaaaattatacaatttatacaatatgtaaaaattataattacagtttttaaagtgcctcctgtctttagaaatagaattatctgatcttgtttgcatacctgtaatttaaaatttaaaatgtagttgacccttcaagacagcattgggattaggggcactgagtgtgccatgcagtcaaaaatccatgtataacttttgactccataaaaacttaattatcaaaggtctactgttggctggaagccttaccaataacataaacagttaacactattttgtatgtattatatactgtattcttacaataaagtaagctagagaaaagaaaatgttattaagagaactataaagatttttattattttccacttactaatgaaatggaagtaggtcattataaaggtcttcatcctcattgtcttcacattgagtagactgaggaagaggaggaagagtttggtcttgctatctcaggggtagcagaggcagaagaaaatctgcatgtaagtagacccaccaagttcaaacctctgtttttcaagggtcaactgtatttcccagagaatgtatatttagaaaattgggtgaaacctaatgccaaagttagtttaaaacattaagcttatatgtactctttttaccacagcaattttgtaatatagtcaattctttgtacccacgggttcttcatctgcagatcctaccaactatggatggaaaatacttgaaaaaaatacaggaagtttcaaaaagcaagtttgaacctgccatgtgctaagcactatgctgaatccatttgaactgaagaataccctgctatagcctcccattgtttcacagatcttcagtctctctctagcacccactgtttgagcagtgttcatctggcattttattcattggctacttgtgttcactctttgcttctgtgaaaaaaaaaagactcctaaaaatcaattatatggtgaaagaaatcccttacagactaagagagagcgtaaagtgctgtctctcaacaagaaaataaaattcttagatcttttgaa

SEQ ID NO: 1875 - DNA, 106562 bp, Homo sapiens
tatcccgcccccgttgccgggatacgccgcggcgcacggcagttagtgggtaggcctgagagccgaggaaaactgagcgtgggcctcagaaagaagttaaggcacccgcgagccgggcaactgccctccttccgcgccggcggaggtgagaatccccgggtcccatctcttcctccctccctcccacgtctgttctcttgccttggagatgctgatccgctccaaacaaaacaaattcaaactcggtcttagctaactgttaccgtcgggcctgtagccaggccaggcatgtaccaattctagtcgagcgaaggttgcgaacagacctcctccaacagcccgacccctccccgaccccccgcaggagacccgccaagcacagagcagagggaaggaccgcgatgggctgaaggattttagtcaaagcaatacatttctgcctcttacagtggaagggacttatttctgtctgttgatcacagtgcgggcagttagcaactttccacttattcacctgtgtgagaatggttggcttagggaggataacgatagtaataataattagaagcagatgttttaaatgtaatacttatcgtcttcacaacagccctgcaaggtagatgtcacccttctgttttacagaagatgaaatcctgaggggttaattaaggtggcaagattatgcagccgctaactttgtcagcactagtttgtatcgctaatcattctggatccaaaggccaggctgcctctctgtgtgaataattggaaattgtgtgactctttgattgaataaccccgaagttagtggtatatttgttgctaatgcccgcctcttaatcccactggtaataatataatggtaagctttttttcaccacagtaaaacggtggcaaagaaaattgggtgaaattttttatgttgtacattttctcaaagttagcaggaaacctagagtaatatcttttccactggaaagagatgtttattgtactcgttttcttctggaaaaaccattttgatcatacaccgtcttccttttcaaagagtcatttcatgaaattcctttttccatttgaaattcttttgctttgtacatagagttcaaaatggcaaggaattagaatcagggagctagtggggtcaggaagattgatgtgaacatattcaaatgagatatctgaatggaaatttcagataaacaattgaaaactcaaaattggtgcccagttgaaagggcagaactgtagacattgattagtgagccgtacacatagttggagttataaagatgcatgactgtagaaaggatagaagcagtccaaggactgattacgagtaatgctaagaaaagtcagaaaagtagtactggacatagagtgtagaaacagagaaatcattttagtccaacacacgctttgtttgccttttttttttttgagacggagtcttgctcagtcgcccaggctggagtgcagtggcgcgatctcggctcactgcaagctccgcctcctgggactacgcccgccaccacgcccggataattttttttttgtatttttagtagagatagggtttcactatgttagccaggatggtctccatctcctgatctcgtgatccacccgcctcggcctcccaaagttctgggattacaggcgtgagccaccgctcccggtcgctttgtttgctttttaacaatttagtaaatttttgtaattggcaatacctttatgtacgaggaaatttaaaagatacaagagagaacaaagtttttgcttatcactgagacagattttggggatataaagatgattaagattcagctcttgccataaagggtgagaaatacttaagcagatcatttcaagtggtgtgataggttctggaataaagtaatacacaggatgcatggtagcatgtagaacaggcctatacactgaaattgaagaagacgaagattccaagaccagttatggactggtcatggaaggattcccagagaaagtaataggcaaaatgtgtgttaggcaaggggaccacttaagaggctggtataatagtccacctgagtcagtgatgccctgaattggccagtgctgtaggaatagagagtaaagtacctgttaaacacttaggaacaaaatcagtagaactaaacaaaacaaactcagtagaactatgtgaccagccatgggagtaagggagaggaagatgtcaaggactaaatttcttacttgtgtgactaggaggtgacaccaagaggaaggacaaattttgagcagatgataatgagtttggattacatatgtttattttgaaatatttagacatctaagtggagatgttattatttggatataaacaccgcaagctgagtgctaaaataaggaagttgtgtggaatcagtttattaattgttaaaaccctgagtgtggataagggggcccaaggggagtttagagagagaaaagaaaaagatggtggatggtatcttagaaaatgctctatataaggacagatcaaggagacagaaaaaagaaccagaagagagggaagtgtcatggagatgtttcatataaatgtggacaccagtaaagtaggatgacatttacagcactggcaatattggcaggggtcatttgaatcaaacggtagcaatccaggagatactgggaaatgaagcagtagaaaatagtggatataagctattctttttgttgttgttgttgttgttgttgttgttgttgttttgagacggagtctcgctctgtcgcccaggctggagtgcagtggcacgatctcagctcactgcaagctctgccttccgggttcacgccattctcctgcctcagcctcccgattggctgggactacagacactcgccaccacacccggctaattttttgtattttttagtagagacagggtttcaccgtgttagccaggatggtctcgatctcctgacttcgtgatccgcccgcctcggcctcccaaagtgctgggattgcaggcatgagccaccgcgcccggctggatataagctattcttaggaatttggctgcataagggaaggatgtatgggacagttagatagaggtggttgcaggatcaagaaataagtttttgaaggtaggaaagaattgaacatggtaacagactgaaggaaaggagaaagtttaaagataattggtagcagtgaggttaatgccacaaaaaagatgggatcaagggtaaatcagagtaagattgatcttgaatgagagaaggaatggctgttgagactggagggcaggatggatgtagagaagtttatgtgccccaaaggtgatggagttcaagttgtaatttttttaaatgagtcatctgctgagagtggcaggaacagaggttaaatagaaaagtagttaagggtgagaatcatcaagtagagaagtatcttaacaaggataaatcatttctgaaatgagggtccagctaagatttgtgactatcactttgcagtaccccagtctgtacagttgtatgatttccatcagcaatgttcagcacttcagattggatgtagagaagggtttctgattttgccagatgggctggagaatagttcaaggatacaaattagttgatagtgctcatgagacactaatttcttgagagaaggaggagagttcttaaacacccttgtcaaggtatcactagtgacttcttgaatggggactccattggacatttcagttttcatcttacttgaatttccaacgtaaatggcatggctcagattcctgccttctcttggcgtctctgacacacactcctggtttttttctttgctttctgggccttaattttcagtctctcatactagattttcctcttgtgtgtaatctgtatgtattgatgttcctcaggacagaatcttgggcactattctctttttctccatattctttgtctagataagtatcttcataactattttatatgacctacaataggacatacatttttatattgtagcccagtaaacacatatgtgtaaatttatgtaaatatagctgaaacaaaaatttactgaaacaatgtttacccttcatattttcagtgagctctttttgtttaaattttatttcacgtttaagtatcttggtcataacctacaaaattgttttcagaacttactaacggatgtgaccaacaatttgaaaactactactctaaattatgagacagaattttaaataatgttatattctgatgaataaaggagagggctgataaactgggagagaatgagtgaattaaggaaatggtttaaaggcaggtgtagcagaatgaagatgagaaaagggtaggagaggagaagaccagagaatagagtatttcaattaagatgtttgaggtgaagcaattccagatgatgacaagctccatgtctcgccatggctataaattactgaaatggagttaagatcattgctaaagttgaggtcagggaactgtgaagctggagtgttaggtattggatctagtatctagatggaagtcatccagggtgatggtgagattggaatagagaagctgtgaactaggtacaaaagactttagtaaagatagaggagagattaggaagtcactaattaccagcaaccaggaaagatcaaggcaatattgttgcattcccagatcctcagaagaagtgaatcttgttttttttttttttttttgggtggggggatggagtctcgctgtgtcgcccaggctggagtgcagtagcgcaatctcggctcactgcaaactctgcttcccaggttcatgccgttctcctgcctcggcctcctgagtagctggtactacaggcacccgccaccacgcccagctaattttttgtatttttagtagagacggggtttccctgtgttagccaggatggtctccatctgctgacctcatgatccacctgccttggcctcccaaagtgctggggttacacgcgtttgccactgcgcctggcctcttgttaatttttttaaaggtgtggaagaatgttttgaaagtgaccctgaggagcaagaaaagtgccacctccttttctttaaaattgtgggacaggaagctaaaacacttggactaccgaaagtgttactctcaggggaaatcaagattctgttaaagttaagaaaatagaaagtatttgtaacaagattcagaatataagagttaatcatggaccagaaagtgcagagaaaggattaggggcaaagaaagatgttggctatgatgggagagaaaatttaccagagtatgggatgagaatactaaagaaatagataatagaggggcttgcattttggtaagataatagaaagatgaggaaggaatgttgcaagaaacaatctcatagttgtaaatggagcacgatgtcatatttgaacaaaattagccttgtagtggtacacagaacggcagtttgcaagaacaattgttgtgaattaaatgtaagggtatgatgggtcattattgtcttgctagagaagacatcaaaggattgaactatttattgtttccaaacagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcagtaagtttgaaacaaatctatttactttgggaggccaaggtgggaggaccacttgagtccaggagactggggcttcagtgaactctgatcatgccactgcaccccagtttttgagtttttgagactgtctcaaaaatctgttgaatgcttgtgcatatattgtggtagaagttggaaatcccctctgtaataagagattctactttgttgtttctttatttcataagcatattattaaacatgtttgttttgttttttggaaagcatctggaaatgtaaatgtggaagagtgtttgaaagacactctgggaagaagatgcctgctcctgcagatactcaatttaaagctgcaataattttagttgaatagtgtattggggccagaataaaatgaaatggaatagacctcaaatagaatcaagcatataagaatttagttaatgattaatgtgtgtttcaaattagttggcaaaacatggagcattcaatagaacattccaataattgttaaaccatttgtttaaaagtatttttaatcctctcttataccttttatcagaattctacatagcttagaaacttggtatttcaaaaatgaaaccataaatgtagtagaggaaaatgttggcaagtattctgtataaacttgatatgggctaggctttctaaacatgacagaaataacaagtactgaaaaggaaaatatttttattatatatctgaatttacaaaaaataaaacaccataaaaaattagaaatgacaactggtaaaaacatttataatatatataccatatataggatcagaatcttaaaattaaaaggtaaactttactaatttttttttttttctttttttcttttttttatttttatttttttgttatactttaagttttagggtacatgtgcacattgtgcaggttagttacatatgtatacatgtgccatgctggtgtgctgcacccactaactcgtcatctagcattaggtgtatctcccgatgctatccctcctctctccccgcaccccacaacagtccccagagtgtgatattccccttcctgtgtccatgtgatctcattgttcaattcccacctatgagtgagaatatgcggtgtttggttttttgttcttgcggtagtttactgagaatgatgatttccaatttcatccatgtccctacaaaggacatgaactcatcattttttatgattgcatggtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgacttgcatttctctgatggccagtgatgatgagcattgtttcatgtgttttttggctgcataaatgtcttcttttgggaagtgtcggttgatgtctttcgcccactttttgatggggttgtttgtttttttcttgtaaatttgttggagttcattgtagatagattctggatattagccctttgtcagatgagtaggttgcgaaaatgttctcccattttgtaggttgcgtgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtaccagtaccatgctgttttggttactgtagccttgtagtatagtttgaagtcaggtagtgtgatgcctccagctttgttcttttggcttagtattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccgtgagcatggaatgttcttccatttgttgtaaactttactaatttttaagtgctctttctgtattaagaccacaagccttatgtccaatcaaaatttcatgacatttcttttgatgctaggggtaatattataaaactattctaaaactcatctagaacaataccacaaaaataagaaaaagtacagtactctaatgtaaaatatgttatagacaatgagtgaaacaatattctgattgccacggcacctggaggtaaactctagtaaatgttaaagagcttaatataagagagtgtgtcataaatagtgaataagagaaacacatcatatgaggaaaagttagatgaagtttatgagttgatattctaagcagaaggatatcctgtaaagataattattacattttcgttatcattataatgtaaaaattgggaaacaacctagaagacttacaacaggtgaatcttaaataatgatatgtatatccctataaaggctgttagatagtcattacaaactactttcaagatatttcagaaaataatatactttaacaaaagtttaaaagtgatatcaatttaacatagaaaacataaatttataaatacatagaattgaaatggaaataaatgaatagacaaaaatgtccataaatttatctgattttcacacaggtgatttcaactgagaaggtgcagagggccaatactcaacctcctacagtaggctaagtgcaaactacagataatgttgggtcctatggttaactcataagaagagcagcattttttggagggaataattttgttaaagtcagattttcctaaagttttcagattttttttctagagtttcaggtaataatattaggacatcgtcatcaacttagactgaaataatttttctgaagtcttcatacataggatagtaagggtatctttttcttttattccagtaaaaattgataattaaatatttataaaaagaatctgacatttattggccacctactatttgccaggcacgttatctgtttatttgtaaaattttaaaatttgtatgtattcatggggtaggtcagttgtcttacatgcatatattatgtaatgatgaagtgtgggcttttagtgtacccatcacctgaatagtgaacactgtacccaatatgtaatttagcaaccctcaccttcctcccactcatcttttgtaatctttagtgtctgttatctcactctgtatgtccgtatgtacccattgtttagctcccacttataagtgagaacatgcggtatttgactttctctttctgaattgtttcacttaggatcatggcctctggttccaaccatattgctgcaaaagacatgatttctttattatggcagagtagtgtttcatagtatgtgtatatatatatatgtgtatatgtgtgtgtgtatatatatgtatatacatgtataccacattttctttacgtagccctccatctccattgatggacagtcaggtttttttttcatatattcgctattgtggcaagtagtgtgataaacataggaatgcaggtatctttttgaaataatgatttctttccttttgcagtgggattgctggatcatatgatagttctatttttagttttttgaggaacttccatactgttctccatagtagttatactaacttacattccccccaacactgtacaaaggttcccttttctttatatatttgtcagcatttgctattgcctttcttttggataaaagtcgttttaactggagtgagatgatatctcactgtagttttgatttgcatttctctgatgatcagtgatgttgagcaccttttcgtatacctgtttgacgtttgtatatcttcttttgagaagttgtctattcagaccttttgcccgttttttattgtattattagatttttttgctagtgagttgttggagcaccttatatattctgtttattaatttcttgtcagatgaatagttttcatatattttctcctattatgttggttgtcccttcactttgttgattgtttgctgtgcaggtgctttttaacttgatgtgattctatttgttcatttttgctttggtttcctttgcttgtgggatattactcaagaaatctttgcttagaccaatgttctggataatttcccctgtgttttcttttagtagtttcatagtttgaggtcttaagtctttaatccattttgatttgattcttgtatatggtgagagatatgggtctagtttcattcttttgtctatggatatccagttctcccagtaccatttattgaagaaactggcatttcctcagtgtatgttccttgcatctttgtcaaaaatgtgttcactctagatatatggatttatttctgggttctctattctgtttttatgccagtatgcttttctttttcttttccttttttttttaattcaggatgggtttggctatcctagatcttttatggttctatataaattttaggatttttttttctatttttgagaagaatgtcattgatattttgacaaggattgcattgaatttgtagattaatttggatattctggatattttgacaatgttgattcttccaatccatgaacatggaatatctttctattttttgttgttctcttcagttcattgcatcagtgttttatagttttcattgtagagatctttcacttcttgggttaattcctaggtattttattttatttgtagctattgtaaatgggataactttcttgatttttttcatgttgttccctgttagcatatagaaatgctattgatttttgtatcctgcaatttttctgagttttactgaatttactatttatcagttcagatagtttttttggtggagtctttaggtttttccaaatataagatcatatcatctgcaaacagagttaatttgacttcttcctttccagtttggatgccctttatttctttttgttgtctgattgctctagccaggaattccagtactgtgttgaataacagtggtgaaagtgggcatccttgttgtgttctagatcttagaggaaaggctttcagtttttcctcattccataggatactagctgtggatctgtcatatatagcttttattgtatttagatatgttccttctatacctggttttttgaggattttgatcatcaggagatgttaaatgtcatcaaatgcttttacaatatcaacggaaggcttttgtccttcagtctgatggtatgatttatcacattgattgatttgcacatgttgaactatctttagttacctggggtaaataccagtgagtcatgacaaatgatctttttaatgtgttgtttaattcagtttgctggtactttgttgaggatttttgcaccaatgttcatcagggatattggcctatagttttctgttttcttcatatgtcttgtctttttttttttttttttaatcaggataatactggtcttgtagaatgagtttgaaagcattttctcctcttctatttctcagaatagttttagtaggatcagtattagttcttttttaaatgtttggtggaactcagcagtgaagtcatcaggtcctgagcttttctttgctgggagacgttttttaaattaaaaaaaaattttttttttttttgagatgtaatctcgctctgttgcccaggctggagtgcagtgacgcaatctctgctcactacaacctctgcctcccgggttcaagcgattctcctttctcagcctcccaagtagctgggattataggcatgtgctaccacgtctggctaatttttatatttttagtagagactgggtttcaccatgttggtcaggctagtcttgaactcctgacctcgtgatccgcccacctcagcctcccaaagtgttgggattacaggcgtgagccacctcgcccagccgggacactttttattatggcttggatctcgttattgttattggtctgttcaggttttggatttctttatggttcagtctccgttggttgtatgtgtttagtcatttgttcatttcttccagattttccaacttattggcatagagttgctcatagtggcctctaatgatcctttgagtttctgttatcagttgtagtatcttctttttttcatttctgattatatttatttgagtcttccctctttttttcattagttagtctggctaaaagtttgttgattttgtttatcttttcaaaacaccaactttgtgtttcattaatcttttatattttttttgtttcagtttcatttatttctactgtgatctttatgaatttctaatatgaattttgtgtttggtttgctcatgcttatctgattctttcatatgcattattaggttgtttattttgtttttctacttttttaatgtaggcacttacaggtataaactttcctcttagtgctccttttgctgtatcacataggttttggatatgttgtgtttccattgtaatttgtttcaagagttttaaaaaatttcctttttaatctcttcttagacccactggtcattcaggaacatatttctatttgttggtatagtttccaaaattcctcttgttatcaatttgtggttttattccattatggtcagagaagatacatatatatttaggattgttgtatctcttgcttaattgattcctttattattatgtaattatcttcttgtctttttttttaaactgtttttgatttgaagatgtatgtatagctactcctgcttgcttttggtagtgtggaataccttttcccactcttttgtttttagcctatgtgtgtcttttagggcttgatacgtttctcatagtcaggatatagttggattatgttgttgttgtttttttaaaatcttctgctaatatgtatcttttaagtgaatatttcaattcatttacattacattcacagttaataatgatatgtgaagctttgttcctgtcattttgttagttgtttttaagttgtataaattatgtttctttctttttctctgtctttttatctttatgttttgatgaaattctttcatgttggtatttgattattttgtcctcttcctttgtgattgttctataagaactgtgagtttaatatttttatgcgtttttgtgatactgtatatccacctttaatttctatgttgaagacccctttgaacatttactttaggaatggcctagtggtgacacattccctcagcatttgcttgtcctggaaatactttatttctccttcatttatgaatcttatcctgtcagggtataaaattcgtggctgacaatttttttgttttgttttgttttttggttttttccttagcacttcgaaaatgacttcctattctcttttttatttgttgttgttttttttaatttccactgaaaggtctgcttttattctgataggattgtctttgtaggtgactagatacttttctcttattaattttaaaattctttccttcgcattgacttcagacattctgataatatgctgtggtgagggcattgcaaaaatgactttttctttgcagtgacttcacctatttaatatttgcatttttgaaaatagtagtgcttgtagtaaaacatacaaacaatggagaagtatcagagttccttcctattgtaggtataaccactatcaactgtatcttctagactttttaatgtatttataaacacacacacatacatacacagtttgtatgactttggactgttccaaaatcaagatagtactgtatacattgttatttttctcatctatttctttcagcaatatattatgaatatgtggccaagtgaatacatatacatccacttcattatttttaatgtgtacagttttaatttatatgttcttctctatactttgacctggtgaatggaaaacaaaaagtagcataattagttgagtaggtctcacagttatgcttgcataaagccaaagaagaaattattcagaacatttaccaggaagagatataacattgtcttctaaagatcactcgggttaacccttaactcattttatttgaatttgtagttgacagtcttcctgtgtccaacacattctctagaattagtactattcctggcccctatgctcaaaataattcccaagtaattcattaggggataaactgacatcttttcaaggggtggttgtgattcttaacaaggcaatggggagacatttaatccagggtaaccgggtttctaggactgatttggtcagttgactttttagggtttggttcattctttctactcttcctgaagagggtggatgccaagggatatggtattcccattttatgtctagcacctgtgctaactctctaatgacatgtgccatgaaatgggtttcattgtctgaatcaatgttttctattagtctaaacctgggtatgatgttttcaattaatgcctttataactgcattactagcagttgcgcttgagaaggagatagtctctacacagtgagtaaagtgattcactattatcaataaatacttcaggcaaccgatggggggcattttagtgtagttaattttaacactttggaatggtcttagccctggatctcttcccctgaggagtgattttcttagagcttgcttattagttttttttatatattaagcaactctctgtgacctgtttggctagggtgtaaattctgatacacccataaactctgaaaaccacatcgcacatagcttggggtctccagtgggctccttgatgtacttgagacaagacctccctcatgagaggtttggataacatctctctttgatctggtaatatccattttccttctgtgttttctttagctcctatttttattaatttttctttttcagtggaagagaaaatggggactgtggtaggggaaggaaggcaaggagttaagtgaaagacaggtgtttcagaagaaatggcggcttgtttggctatttgatctgcaaggttatttccttgacttgggaaggaaaagtcattttgatgccctgggacatgtacaatagctatctcttctggcagctggagattgtttaagacatggacaattagttctttttggaccaagtcttggcctttactattatgaccattctccgtccagttttttttcaatgtatgagccactccaaaggtgtacttagaatcagtatagatagttccttcttggttctgcaaatgtttcaaagcttggctgagtgcaaacagtttacaagtttgggcagaccaattattgggcaatctttctgactctacttcttcaagagtttttccatcagttactgaatacccattatgtcttttctcttcaattacccaggaggacccatctataaataagtgtcaccctgtcttgaagggagtttctcttaagtctggccagacctttgtatggtaatcaattagatctaaacatgtgtgctccctttttaggtttagatcccctgttaagaaactagctagtttgagtgaattatcagtagttaatgttaaatcatctttttttttaacagaatggtcttatactttaaaattcttgagtcagtgattcacctctctattttttggtttaagatagttctaacttggtggggcgtgcttactgtctattttcctccgaagtttaactttttactttcttcaaccaacactgctctagctgcaatggactggatgcattgaggccatccacaggtgactgggtctaaaacttttgacaggaaggccacgggctgccggttgcctccatgcttttgggtaagcactcctaaagctaccctgtcattcacattaacaaaaacgtgaaatggcttttctagggaagatagggctagaacaggggcagttatgaacatctgtttcagctcttcaatctgatgaattttatcgaagtccacaagagacggtcaggcttccactgggtaagtttttcatacaaaaatttactttttagtgagtatgagtcaatccatacacagcaatatccaattaatcctaaaaatttttttggttcttgcttagtttgaggcaggggtaaggacacaattcactcaatccattcgggccttattctttgcttgcctgcacttattaggtggcttaaatatttaacttcgggctctgtatattgaagctttccttttgagacccataacccctcaaactgttggtggttaagaatatgtatagagaagtcacccactttttttatatcttcaccagatatgagaatatcatccacatactgaagcaggcatatttgctttgggacaagaactttttctgatactcgttctagaatttgaccaaagacgttaggggagtctgtaaacccttggggtaagactgtccatcaatattgttgtttttgcccagaatggggatcttctcactcaaagacaaatatgtctcggctatcctcagccaaggggcatgcgcagaaagcatccttcaaatctattactgtgaaccactgatgatcataaggaatttggctgagaatggtgtaacggttggggacaacaggttgagtggtctggactatctggttaatagctctgaagtcttgtactaatcagtatgacccatctgatttcttgacaggcaggattggggtattatagggagacatacagggtttaaggagtccatctttaatgagactctcaattacaggctttaaccctatcctgccttcgaagggaatggggtattgctttctccttactatgtccccaggagtttttagtttgatgtctattgggggaacttgaagtttttctcgattcccttctcttgaccagacatcaggatgaatgtatttttcgtccacagtggtgagtagatttaatgaggtgaggaatcccttagggccagcttgaaggcctattcctaattttagcattaagtctttttctaatagattagttcccacctcagggatcaacaaaaattgaatgtgagttaatagatcttgatgtttgacttttgtattttccaagatttttgccttaaatccttctccttctccttttaccccagttcttctgaagagccagcaagattagatggagtgagacaaacagaggagtgagacactcctgaatcaattaaaaaggtgataagttcacatttaggtcccacctccaaatttatcaagagctcctggtgggactcaaattaaaagagacagagaccctgactcccctattcttccttgaaagtcatgagtggaaggacttctttttccctttttaatttgggacattgtctcttgaagtggcctgttccacatttgtaacatttatcttgtccttcctccctttcaattctgggattctttgactttgctcccccacactctttagagggcctaggaaatgaaggcccagatcctctaattggaggcttggttcctttgaacgggggttttttggatcctttatagttcttggctccctggaagtcttgttgagaagcatatgggtttggagccacctgttgaaaggtggatagcataagttttgctctttgtttttgcttttctgcgtctctccttacatacactttttgagctttcctgagaagtttacttagcggtcggtcttcccaattttccaatttttgtaacttttttgaaatatctagtcaattcttagtgacaaaatggagcttaaacatacccggcccaaggggatcttccaaatttaggcctgcatactgtttcatttgctcctttagcctgtctaagaattttataggcccctcatctttttttgttgttgtatatcaaatgctttagagaggttttgagtttggggtattgattccttaattccttttattatcatttcccttagatcttccatgttttcctggtgagctgcattattattgtcccacctgaggtcttaagcgggaaatttttggtccgcggtagggacattctgaccaggagagtattcacgtttccaaattgccatagcagccctacggttatgctttttttctcctccgaaaagaggatgcctgggatggatattaactcgacccaggtatataattgaggtcctaagaattgatcaacttaatcagccaccccataagggtcatccaacaggagctgaagctcttttttcaaactttgcacctctgaactggtcaagggaatatttacaaagccaatggctccccctccttgtggaacctcttttaaggggaagagagtcggggctgactccttaggtgtggagggaaatgggaaattttggatatcctttttacattgttctatctcacgttgaagtcctttcagggaggggtacttaataggctgggaggggacaggctcatgggatgataattcccaaagtcagggttataaggaggaggaataacgtgagcagggaaaggatctggaatgagacctgaggcggcagcagctgcctgagggggagggtcaggggcactgagcagaggaagatgatccagaggatcccatgtgttggtgggtgtgggttgtttaggaacagggactctttctcttttagaggagttggtttctggcttgttccctctggtttttaaagggtaaaggaggacaggttcttgcctccaaaaaagagcatagtctgtttccttttgggagacagggcttttgtcattaacatgttcgattaagagctgacaaatccactcttcattggaaccaaattttggccggaaaactgagggtttgaggatgggccttcagtccaaataaaacaacaatattgtatcatttgctcttttcttttatgtttagttctttcattatctttccaatattttaacataagtcccaagggactatcaggaggaatttcatcacgcgcttggctgtttatttttcctgtcttacgtgaaacatttcccatcttggaggtttgggatggtgtctaactgaaataggcctttccctggagcttctcaacctctcctactagagatttctcgccctccgtcctttcagaagctcactgaggctctgaggctcaatccctcatattagagatttcttgcctatcgatttccataggcattgttaaggctcagtccctcgtattagagatttcttgcctatcctttagccccacctgttggaggctccttgcatccttctttcgctttttccactctggctgcttcccttgtgggaaatggcaggatctgccacatgaggtgaccacgggaccgtgcagataggacccactcaatccacacagcagtagtgttaacatcatctacatacacttttatcctccaagataccctgaccacctaggaaatactttgttgttcttgtaccgtttttcaccttggtctgtgcacagagttacttggtcgccgcggtgttgtaagcctctcctttccccattgctgagagcttggatttgtttgtcacaatgggtgggtctcagtctcccatccctgaggccactgcaatgcgacagtgggacacgtctccccctgggtggggtgactgaagacctcttcttgaaggagaatgggaatccccgacaagcccccagaattgttagaaagaaagcttgaagtcgtaaagaaagacgagtactcaaacaaaggatttctcagcaaagcaaatttacttttgcgcagtagggtgcttcttacagggctgcttgtcatgagagcacactgaagaaagtagagtagaagcttttattcctaatgtgactcctgccctcgtgccctttccccattggctggggtcggactgcacaatctaaactagacccaattggctaaacatttaaactttcttagataaggtgggcgcatgatgggagagaggggagaggaggaaggggtcatctacagaggactagagagccagtcttttcctaaataaggaaaggaatgtgagctggggctgtggcatgcctgggcatgtagtaaaatcagaaagaagaaaaaaggagaagaaaggcagggggtacctggaattagagaataagtagctgagcaggctatttgaagagaaaccttgccatatctcacatcttttatatcttctcatgcctgtatgtattatatgaactgacataaagggagtcttttggcctttcctgaggtcgtatagtgttatgttggattttgcatacctgaagtagagaatcttgttgagtaataatatgaatgcttgtttaacaatgtaagccctttagtacttacatggtcatcttaggatggatttatatccatttgtttttacaagattaaagttttcttattttttcctgatttttaagggtaatagatactcattgcaataaggcggaaaataccaaattgtataaaggagaaaataaaaatcaactataatatcattatcgatcatcattactattttttcacatagtttttaaaatttttatttttgtctatattttttgtttttttaaaagacggtctctctatgttctccaggctggcctcgaactcctgggttttaaataatcttctcatctcagactgccaagtagctgggcctgttggtgcatgccaccatgcccaaacttccagcctttttttgttttaaaaaagtagagttttgaaccaggcacagtgattctcacctgtaatcccagctacttggatagctgaggcagaaggatctcttcaggccagtagttcaagaccagcctgaataacatagtgagcccttgtctctaaaacaaacaaaaacggaattataaataccatcttgtaaactgccttttaatttttattttatttacttattttgagactgagtctcactctatcgcccaagctagagtgcagtggcatgatctcggctcactgcggccttgacctcccagattcaagcgactctcatggcttagcctctcaagtagccgggattacagacgtgtgccaccacgcctggataacttttgtatttttagtagtgatggggttttgccatgttgtccaggctggttttgaactcctgacctcacatgatccacctgccttggcctcacaaagtgctgggattacaggcgtgagccaccacacccaacttaaactgccctttttatatactgcagcttatttaaccattttctgctgtggacatttaactcctttccagttttgaggtattataaataatgtctacatatagaatttaaaattttcctgaaatgtatttttaaatagtcatagaacattaaatgttaaagaaatatgttaataaattgaacaacagtatttaataattcagacatttaaaaaataaggaaatttttacaaatcaagtagaattttgtttttttaaaaaattgtctttgcagttttacaataaaagatgtacagtgttttttctggtttactaaaaatgaaatcttgtttgtcatttagatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtacctattttaagataagtatgacacttgggcctgtgttttgtaagaaataaataactgtgaacaatttaaaaaagtaaaagttgagtatattttgaacaataagtattacagtaccatttttttaaatcaggattatagcatgtaagaattattacatgtaattatggcatgtaatcagaattatggcatctaatcgttattctttgattcacaaaattattgtgatggttaaacaacagagtgaatatgaaaatacagtttgaattagaaagctatatacagatatgagctatttcagtcttcatttttctgacatggagctgtagtacaacttgaagaactttgaaatagtcttggagaaaagttcaagattgaaaattagatttttggtactatatagaaatactctgaaatagtttagatagttcctatattaaaatgacacttaaaatacttgtgtatttatgagaagtgagtcaagaaatgttactttttttctgataattagcatctgttctaatacttatgtaaggaaatgaggctaatttcctcatttatattaatctaatttcctagatttatattaaatctctcattatgcttctgcatatgtatttagagaagcataagaatatactatatattagagtttaaaatttagatctgtggtatatataaaccaaactatggtaaactcctttttcttttctttttatcataggcagtggtcagtagcctgtggtgagctgtttcagagtttttcgttttctgtatttttgacagatgatctatcaggaatgaagatatactgctagtacaaaattaattatatcatacatgctactttctataatacagtatatcatccctttcaagagacttaaattttttttttttgagacttaaattttttcatctacattctaataacatctaaatcactaaatattaaaaatgaattgattatttagaaatgtttgcttaatgattatcagtaccatgaaaaaatatttcaaaattacatagtcatttaactagccttttgaaagtggatgcacagaaatatttatatgtttaatagtattttaaaacatcgagggtaaaaacatattaaaattctatagtaaatttatcaaatgtttatttctgtattaatttatccttcaaaacagaaccaatataatttaagattgttagtctctacaagtatacttcaaagccttttaagagagaattcggaacattaccactacacagaactgtctactgtgactttcattcttaccttctctagtgccccatttcccagtataataagatactacctctacttctcagcatagaccttatagttaatacacctagttttacctctcatactttgcagggcacttcatctcttacaaggtttgagacatttaacctaggaacactttctttttttttttttttttttttttttttgagatggggtctttctctgtcgcccaggctggagtgcagtgatgtgatcttggctcactgcaacctccgcatcccagattcaagcaattctcctgcctcagcctcctgagtagctgggcttacaggcacatgccacaatgcccagctaatttttttgtatttttagtagagatggggtttcaccatattggccaggctggtcttgaacttctgacctcaagggatcctcccacctcagcctcccaaagtgctgggattacaggtgtgagccaccgtgcccggccaggaatactttcttagttctactgaaatgtaagaccatttcttaaaaagtctctgagacaaatgataaaaaatcatagtcactttctcacattgagtaatgtctgcagtgtccagtatgacagccagtagtcagaaatttaaattagttccccagtagcaccagccaaattttaagtgcttctgtagtccctctgtccactttattggacagtgttaatttagaatatttctgtcactgcagaaagttactctggacagctctgttccagattcccttagactcaattttcattccatcgtcctgttctgtagagtctactgtcttttaacagccccacctctagtcccatcttcgtagttttaattgaagcttcccttatgttgtgattctaaggtattagttctcttttcagtttcagtgattcttcttgattcattggggcattcatgaagactgtcttgagaattgtggagtgtaattctgattgtgctttggatttgctattctggtggcatttcgaactgaacactaacacttaaaacatttttttttaggtccccagaggcaaattttagacaaatcttactatcttgggcttcttaggtatgttaaacatatcttttcatccgtatgttttactcgaaatattgtgtaccttctgtcaaaatagagtatataactttaatatgaagttttagctaggcacttattaggataattaggtatctattgatttctaaaaattattttgtattctaacaatttctggttaatttggctatgctgtaaaataaatgtgatagtataattagtctgagatttatagttttatgaatttgcatgtacatgagctatattttccctcagtttgtttgtgctgctataataaaatacctgagattgggtaacttataggaatttatttcttactgttccggagacgcagaagtccaagatcaaggtgccagcagcttcagtgtctggtgggcacctgtttctcacagatagtgccgtcaaggtgtcctcatggcagaagagtggaagggcaaaaggtgctgagctagtttccttcaacccttttctaaggcactaatcccatccatgagggcagagtcgtcatgtcctgattacttcttaaagtccctacctcttaatactattgcattagagattaagttttgatatgaatttcagagggactcaaacattcaaaccatagcaaacttattttattttatttatattttagagacagagtctcactctgttgcccaggctggagtgcagtggcatgatcacagctcactgcaaccttgaactcctgggttgaagtgatcctcctgcctcagcttcccaaagtgctgggattataggcataagctaccaccacacctggcctcatagcattttttttttgagacagagtcttgttctgtggctcaggctggagtgcagtggcatgatctcggttgactgcaacctctgtctcccaggtttaagcaattctcctgcatcagcttcccaagtagctgggattacaggcgtttgccaccacacccacctaattttgtgtgtgtgtttttagtagaggtggcatttcaccatgtcagccaggcttgtctcgaactcctgacctcaaatgatctgcccatctcggccttccaaagtgctgggattacaggcatgagccaccgcgcccaaccccttgtagcattttaaaagttcacttttttcatctaatgataagaataatttttttttttttttttgagatagagtctcactctgtcgcccaggctggagtgcagtggtgtgatctcagctcactgcaacccctgccttccgggtttaagctattctcctgcctcagcctcgtgagtagctgggactgcaggtatgcgccaccatgcctggctaatttttgtattttttagtagaggtgggctttcaccatattggccaggctggtcttaaactcctgacctcaggtgatgcacctgcctcagcctcccaaagtgctgaaattataggctgagccaccgcacctggccaagaataatcttctatgttttttttcagtaattaatctgaaacgtgttactcatatcattaaaatgttaccagctacatctaataagaaagggaaaatatgtatacttatttatgttatattaatcagtaagttttacataagtatgtatttggtcagttgctaccaatgtggcctaattttaattaattcataagctttttttcttttttttttgagacggagttttgcttgtcacccaagctggagtgcaatgatgggatctcacgtcactgcaacttccaccgcctggattcaagtgattctcttgcctcagcctcgtgcctgtaatctgcaagtagctgggattacgggtgcctgccaccacacttggctaatttttgtattttttttttttttttttttttgagacagagttttgctcttgttgcccaggctggagtgcaatggcctgatctctggcaccgcaacctccgcctcccgggttcaagtgattctcctgcctcagcctcccgagtagctgggattacaggtgtgcaccaccatgcccagctaattttgtatttttagttcagacgaggtttctcaatgttggtcaggctggtctcgaactcccaacctcaggtgatctgcccaccttggcctcttagagtgctgggattacaggtgtgagccactgcacctggcctaatttttgtatttttagtagagatgggggtttcaccattttggccaggctagtcttgaactcctgacctcaggtaatgcacctgcctatgcctttcaaagtgctgggattacaggcgtgagctgccgcactcggcctcataaacttttgttatatgtctctggggatgcatctctaaatcaatgactttttcttattcttactattttcccacttacttgttctactgtcctatctccatcttcccattttacttcattttctttttggcacattatttgtatcttctttctcttttatttcgcttttgtttaatccaccctcccatcatgccctgaaagccctgttttcttttatttctcagttacctggatcctattgagtctcaaactcctagaaggcaataaagaaaagtatggtttccccccatctgttctcaaagctaagagtagtaagaaagatagtaaggccatcagttgtttagtatctctgacattcagccactttttaatcaaaagaaggaaaggaaatatagttattcctaatgattgcattgcctttctcccccaggatttgtgcttccacatcaaagaatagttctagctatttgtgtaattgtctggctctagagcagtggttctcaactggtggtgattttgcccccagggaacatttggcaatttctatacatgtttctggttgtcacaagtgaggttggaggaagtgctactgatactcagatccaggatgctggtaaacatcctgcagtgtacaagatagtgctcaacacgaggtgctaatcactgacccaaaatgtcattagtgctactgttgagaaactgtgctctagagggtagtagcagctgtgatgatgacagttaagcacctacatctgcctgtggcttgtactagtttgaccaggctttcattctggttctatttcatctttcttcatgaatctatgtcagtttctcctcagtttctcatcagttgagtagaataggatgggatatacctcattctttttttttttttttttttttttctgagatggtgtctccctctgtctcccaggctggagtgtagtggcacgatcttggctcactacagtctccacctcccagatttaagctattctcctgcctcagcctccctagtagctgggactacaggcgtgtgccaccatgcccagctaatttttgtattttgaatagagatggggtttcaccatgttggccaggcttgtcttgagctcctgacctcacgtgatgcgcctgcctcggcctcccaaagtgttgggattacaggcttgacccaccgcacccagccagaatatacctcattcttaatgaaataagccacctaaactttctgcattcttttagtgaatttcacaaaactatttatattattattacgtattaatggaaagtttaaattttgcttaactagagttttctggattaaaagtattgctgacattcttatttcttttctaatagaagtaaaataagtgaacttacaactgaagttaataaacttcagaagggaatagaaatgtacaatcaagagaattcagtatatttgtcatatgaaaagaggtgagtaataagtattcagtattcattcagtattttgtgcttataatactaactttgtagctatccatattgtttgtaatgttcattttcttatgtatatttttatgtacatatttatgaatgtatttattttatgctttcagggctgagactttagctgttgagataaaagagcttcaaggacaactagcagactacaacatggtattttatcttttctaagagaatttactgttaatattttcattagtttttactactgctttaaaaatacattagtaggcaaaggacatgcacagatacttttcaaaagaagacaaacatgcagccaacaagcatatgaaaagaagctcatcatcactgatgatgattagggaaatgcaaatcaaaagaataatgagataccatctcacaccagttagaatggctgttactaagaagtcaaaaataacagatgctggtgaaattgcagagaaaagggaatgcttatacactgttggtgagagtgtaaattagttcaaccactgtgaaagcagtgtggcgattcctcaaaaagctgaaaacagaactaccattcagcccgtcaatcccattactggatgtatacccaaaggaatataaatcattttaccataaagacacatgcacatgtgtgttcattggagcacggtttacagtagcaaagacatggaatcaacctaaatgcccatcagtggcagattggttaaagaaaatgtggtacctataccatgaaatactatgcagtcataaaaaagaaaaagatcatgtcccttgcaggaacatggatggagctggaggtcattatccttagcaaactaacacaggaaaagaaaaccaaatactgcatgttctctcttaccagtgggagctaaatgataacacatagatgggaacaacagataatgggatctacttgagtttggaggctggaaggagggaaaggatcagaaaaaataactaatgggtattagcttagttacctaggtgattaaataatctgcacaacaaacccccatgacagtttatctgtaaaacaaacctgcacatgtacccctgaacctaaaataaaaatttcaaaaatttcaaaaacaataaaacatttgatgaaaaaatatatttattaatttattatttaaaataccaaatagtacatgaatacatacttattgggaaagatgaaaccataaaaattacaacaaataaagtatccctttactttctgcttcatttccctccccagaaataacttggcttaacagattaatatatattcttccattgttttttgtaaaatacgtttactgacacatacacaaatgcacacatgcttttctccctaaaatatgttaaaataataatttaaataattttaaaagtggctaaaatgtattggtcctatcagtgatcattgctttaaaaacacattttttatcaagtgttgtcatcttgaaaattttgaaatttaattattaaacatacagatttccaccatcttgatgttttactcgaaatattgtgtacattgtcaaaatagagtatataacatgatatagttccactaaagatgcttctacctgtggactttcagaagaaacagtccccctggcaatattgataactgctcagtccttgggtgatattggccccatgaaaatttctagtgtcagaattttcttttttctaactctttagttgctttaggagcagtgatgtctggatttaatgaaaaagtcaaatttttatctcactacccttattaagaaatagtgttacaagaaataaacattctatcataatggttaggataagataagttatgatatacctacttgatagtgttaccttgtgcttatcaaaaattttgctaattatagtataactttttatttttgtttttgttgttgttactggtggtggtggtgggttttgttttttgtttttttgttgtttttttttttcaagacagtcttgctctgttgcccaagctggaatgcagtggctcaatcatggctcgctgcagcctagactttctgagctcaattgatcctcccacctaagcctcccaagcagctgggactacaggcacatgccatcacaccaggctaattttttgtattttttgttgagatgagatttggccttgttgcccatactggtctcaaactcatgggctcaagtgatctgcccaccttggtctcccaaagtgctgggattacaggcttgagtcattgtgcctggactatttttattttttaatttttttagagatagggtcttgctctgttgctctggctgaagtgcagtagcatgattgtagttcactgcagcctcaaactcctgggcacaagtggtcttcctgcatcagcctcccaagtagctgggactacaggtgcatgccagcatgcctggctaatttttaaattttttggagagatggggacttgctgtgttgcccacaatggtcttgaactcctgggctcaagtgatcctcctgcttcagcttcccaaagtgctgggattataagcatgagccattgcacccagccctcttataattcttaaatttcctggactacacaattcatcacaaacattttgtagagcccattattcactgggattttctttagtaaatgatgttctgttttaaatgtgagcaaaatagtttttttttgtttttttgttcttcttgagatggagtctcgctctgtcatccaggccggagtgcagtggcgtgatcttggctcactgtaacctccgcctcttgggttcaagtgattatcctgcttcagcctcctgagtagctgggattacaggcgcttgccaccagctgggattacaggtgcggtcctgagtagctgggattacaggtgcctgggtaatatttgtatttttagtagagaaggggtttcaccatgttggccaggctgatctcaaactcctgacctcgtgatccacccgcctcagcctcccaaagtgtggggattgcaggcatgagccaccgcgcccggccgagaaaagtagtttttaaaggtatgaaatgacatgagatgaaagggagttttagttatgctggaacaaattaggcatattcatataaaaatactaccatataaaatatgctatttatagatttaatgagctaatatctgatacagagcagttagctgtgtatctgacatatagttagcactcaataaatgttaggccttattagcacttattatttatatcataaatgaaaaatgtgatataccttacacccaaatagtttgcttttagtagaccttctgttcacattctggctctatcgcttgctaaatttctttttctgtaaaatgtgtacaatcatatctacttcatacagtaattgtaaaaattgagttaacacatatgtaatagtgtttgacactaggtaaatatcctatgttgacaactgatatccttgcctaactttttgaagtagacttactactgttccatctgtgcaagccctgttgatttttttttaattattagaagataaagaatatctttttatgtttttactagtgtaaatttgttttttgttgttgttgttgttgttgttttttgagacggaatttcacttttgttgcccaggctggagtgcagtggtgccatctcggctcaccgcaacctctgcttcccgggttcaagcgattctcctgcctcagtctctctagtagctgggattacaggcatgtgccaccacacccggctaattttgtatttttagtagagacagggtttctccatgttggtcaggctgttcttgaactcctgacctcaggtgatccgcccgcgtcagcctcccaaagtgctgggattacaggcctgagccaccgagcccggcttactagtgtaaatttgtaaatctactaacattcctctctccttggggatgttggcaggggaagagagggtgatagatctttccaaaactctcgtctgttccaaacccttatttataagctcagccatcttttcagagcaggcaaagctccacaagatataatattcaggaagagttgtttattactgctcatttatccatgttaaaaatgtgatttgtttattggccaggtgcataatatatgcttacttaggtagctcaatatttgtttttatcttaaaatagaaaatattcaaaagtattaatacttaagttactactcattatttgtaagactgaatacctatattattaattatagagaacatgtgtaaagactaacaaaatggtgtttgtttgtttgtatttttgtttttagttggtagataaacttaataccaacactgaaatggaagaagtaatgaatgattacaatatggtaagaaaatttataaaagcaaattgatctatgtaagtcatatcctacaaaacaaagcatttatatctagaaatagtttgataaaaccttaagtgctatagaggtgaatattactctgattgtaaataccactattaggtattccttgagctcccttagttgctcttttaaattttcttcctgttgattggctttcctaagtgggtgtttagtgactgtctactgtgtttgaactggtgtcacgtgcaacattagttagggagtgccatctccatttccttatatatattagtttacagtatttctggcttagtttaagcacaaatgttgatgaatactcaatgtgacaaatgataactttacatagtttttgtcaccagtggagaaaaatgaatagatatgactccagacataaaatattaatttttgattggtaaatgagaatctgtgtttaacatggacataacactggggactccaaaaagggggatggtaggagggcaataagggtggaaaaattacctagcaggtacagtgttcattatttgggtgatgggttcactagaagcccaaaccttaccgttatacaatatatccatgcaacaaacctgcacatgtacctctgattctaaaataaaaacaaatttgtattcaatgttcttagattaattgtttggtagaaaacaataaaatatgttaatagctagcttattttgattataagcatttggatgaaaataacatacaatttataatttatatagtttataatttatttacatgagtaaagactgttctatgaagacataggattgataaaatgactcttctaaatttggggttctcaaaccatgataatttagttacttttagctttagaacacaagagaattcactaattaagaatcttatttcaatgccagatataaaaagtaaaaaccttatgtgttttgtcagttgtttgggatggggggtctgttttctaggctgggtgtgcacaggtagagttaattaggtgtactcagataatatcctgaatggttcaggaataaaacttgtggtggttctaaatttaacatattactaatcaaatatttattgaacactcaatatattctttgaatgctgtttacataaattgaatttacattgaattatttgacagatcactgaagaacaatgaatatttttggtataagattacaatgcttcttaaaaagactttttaaaaatctgatattgtttgttaaatgaggcaattactttatttttcttcttaaactttgtatgtggcactaggataattatagtaatttctcatttagttcctagccaaaataacctacaaagaaaaaatttggtttaatatttatttcttactaacttatgtgttaactttattcagcttaaagctcaaaatgatcgagaaacacaaagtttggatgtcatatttactgaaagacaagcgtaagtatagctaatttaaaaattagattcataagtaagctttattaggtagtttaagttgtgatccagttatttccttgtaaattttcttaacaatttccccattgcctttttcatttaaaaatatttacaacacaaattttgttgcttatacttgttatcttcatttaccattaaatacctaaattctgtataaagactattgctacatagcttatataaataggatttatgctgctagcagctgaacacttatgatggataagaacatctttatatctactatttttggttttaacctgggcttttaactaatttgaattttggtgtttcatccccaatctagtgaaagacacattattcattaggaagctatttacattatttcattagcattgatatttaatagttatattagcaatctacgtcatatatagattgtatgtgtgtctttatatataacctatctaaagactaaataccaactaacgctggaaataacgtaattgtggcagtgggagtaatgcctacaaagataataatagatgtgatgtagttaacttatttgtgttttgtcagttgtttgggatgggtccatattctaggctgggtatgcacaggttgagttaactagggatactcagataaaatcctgaatgattcaagaataaaacttgtgttggttctaaggtcaaaaagttgatgaagaataattaatttagaaccaacacaaattttattcctgaattatttattctaaggcaacacaaacacaatgagctatgttgtgtaaacacacatacaagcacattctctcccagaaatttgttaatattagtctctttgagagcaaagacaataataaacccaaattaccatattcaattaccaaaattcagtaacagcaaatacactctcttgttacctctgcataaaacagtaaatatttgatgatggatagatgttaaaatatactgataaaacatttgaaagataaatgtaattcttctattgattaaaaacaagaatctcttttcccctgcctttaagtagagttttgctctgttgcccttgctgaattgaagtgacatgctcatggctcactgcagccttgaacacctgggttcaagcgatgttgcctcagccctccaagtagctgagactacaggtgcatgccactatgcccagctaattttttgtttcttggggagacagggtcttattacgttgctcaggctagtctcaaactcctggtctcaagcagtcctcctaccttggcctcctcaagtgttgggattacaggagtgaaccattatacccggccaccatctatcatttgctgctgctgtaaagtggtatcttataaactcaaaatactagcagtctttttccttttacaaggaaaattttgttcatggtaaccacgctcttacttgaaaacgttccttttttttttgttatcctggttttaatccatttagcaaatatttatcatttactatatataagatactctcttaggtacttcaaagaataagaaatatataagctataggccagtgtggtggttcacacatgtaatcccagcactttgggaggccgaggcgggtggatcatgaggtcaggagatcaagaccatcctggccaacacggtaaaaccatatctctactaaaaatacaaaaattagctgggcatggtggcacgggcttgtagtcccagctactcgggagactgaagcaggagaatcacttgaacctgggaggcagaggttgcagttagctgaggtcgcgccatcgtgccactgcactccagcctggtgacagagcgagactccgtctcaaaaaaaaaaaatagagaaatatataagctataatcccctgaaggccttaaagagtttagaacatttaagttctcatttatttcatcatttatctcaaagttatataatacctaggtcaggttttaaatattatatttacatattttacagatatttcatctgaaaacataatttcaagaataaaagttaaagaatgtcatagatttttacatctatttggttttttttatttaggaaaatcttcaaatatggtaatttgtcctgaagatacatccaaaccatttaaaaactctgtctgtaatttgtaattgaggctgagtgaaattggttctcttgtctgttttaggcagaaattgaaattaagaacaacaattggccaggtgcagtggctcatgcctgtaatcccagcacttttggaggctgaagtgggtggatcacctgaggtcaggagttcaagaccagcctgggcaatgtggcgaaactctgtctctactaaaaatataaaaattagctgggtgaggtggcaggtgcctgtaatcccagctactcaggaggctgaggcacgcgaatcacttgaacccaggaggcggagggttcagtaagccgagattgcgccactacactccagcctgggtgacagggcgagactttgtctcaaaaaaaaaaaaataacaaaaagtattgttacgaaggttacttttctatacagcagtagaatagatttatttcttgtgttaaccagatggccaacgtctcaataacacaaagatctatcttgactctacacagagtgaccaagaaatgccatacctcgagaaggcaggtgtaaaaagcttctgttttcattctcttctctttcaatacaaccatttagtgtggtctgaccatctggtttattatggaaaactcatctataaaaagttggttataataaacagcctcaatatattacaacaacaatatgtaagacacctggcattaattcagtttcacagtcttgcttgaactaatgattctcttctaatcctgcactttctagttaatattagtcaagatcagttgtcctgtaaaaatatatgtaattataattttatacccatttatttttctttgtgtagtcagatatttattgaataccccatattcaacagaggcccttgaatataaaagcttaagtgtagtctttgctcatttgcaattatatttcattttgctacatttctcaaatattaatatttgcatcttataattaggaaataatttagcagaatgatacattgtttagaaaaagatattttatgttcctataatcatctcattcttataattaaggtttaaaacaaagtataattgatatataaagaaacattagccataatatacttatatcctttgttgaaaacatgtgtctgtaaacacaagcaaatatgtattataaattagtaagttcttctattttacaggtatatcatcctagtttttattttctctcagtagacatttgtattgaatttactaattatgtaacttttaaaatgactattctatagattatgacatagatctattttattttagcctcttttttctaaggaattgtcaagtacatacaaatttttaaaactttattatatacataaacaatttgaacatacacagaaatagcatactataccatacacaacatacacagaagtagcatattatacccttatttagctcccagctccatcagctcatatttgaccttgctccatccatacctctagccactgttccattccacgtgttataatgaagaaaataccagaaatattatttcacccatcaatatatttcattatttcagagatatacatatttgtaaaagatgtaaattcttaatttctctgcatatgaaggtaaaaattatagattgtgctacagtttttaatgtactgtttgcattgataaattattaaattgtgattatagccaattgattatgaggactcagcaaataattttctttagacccttcctattacagccgataggccagtgttttccaaactacgttctttggaatgttattgaactacgagctcttagtagatgtaactgaaagaatgggttttgttgtcaagtaagtttgagaaatttttaatactttgctcttgaataatcagagagcagtttagcttagtaaagttttacataaatcctattgtaaagaatcttggccaggcacggtgctccatgcctgtaatcccagcactttgggaggccgaggcgggtagatcatgaggtcaggcgttcgagaccagcctggccaacatggtgaaaccctgtctctactaaaaatacagaaattagccaggcatggtggtgtgcacctgtactcccagctactcgggaggctgagtcagaagaattgcttgaacccaggaggcggaggttgcagtgatctgagactgcgctgctgcagtccagcctgggagacagtgcgagactttgtctcaaaaaaaaaaaaaaaaaaaagaaaaagaatcttgtttcaccttgtttaaactactagtttttcctgtagtaatttgaccatgtacctccttcttcttctgtaaatacttgtgaatgtctctctggaaattagtattctagaaaaacaatttgggaaacattgctctatctactgaatagatagaaatagctgtccatggaccacatgaagattccttagtgtcagcacagaccaatttgaataaaaatctcccagagagaggtggaaatatgtatttttaaaacaagatttatagataattgtgatgcccactttggaagccagtatgacattaaactgtagtgatcctgcattatggtgacagcctttctttataaccagaatcaatagtgacttattagggattatgcctgaacattgtgcttgtgctttaaattgctatgaaattttaaggaaatttattgtgctatttcaggaagcatttcaaaaaaatattttccaactctatgattttattctgggagcataaaatcaatcttagtgtattatttaagctatctctgttcctcactttgacttccatatattaataaatcctaaacttttatttctttactgattgaaacattagtataacttaatacatattatgtcaaatacctgtgttaatatgagaatccattcattttaattcatgaataatttagacctttttactagttcgtatggtcacccaagcactgctaagaatagtagtgctagtattgtagactatgtaactgtcaactaccgaggagtgtcagttactgtatttgaacctgcttgctcaatataatgcaaagaacataattttatgatattcatgtatgttgtcattaatatgaatgcctgccagctgtattttgttatgtcacatagcaaaatctccatatctaaactgagtgagctgataactttgctttaaaaagcaaactttgaaagaaattaattttcttcacataattcatggatatctatatatttgtcttcaataaatccatcatcatctaccacaaatgaatgtaattgttcaaatattactgtagtttcttcagagtttgtttctggtatctgtgaaagagagcttggatttccagtaaaaccatcttcataggtttctgcttcatgctcttccaggcgatgatgattataactaagcagaatattgtaccatattgggcatttgatagcaataaaaatgagaagtgaagtcgtcagtacagtgacaacaacaccaacaagaaaagcccaactttttccaagaggttcatgttctttaatggaataccaagagaggagagagaaagaaaatttgttaagttggcaaaataatcataattatatatcctaattctcctcaatattggtattaaaaataaacatacattgtagttttctttagattttgtttggtggatgaattctctttgttcaaaatagctgtgtttgcaattttgttacccttttacctaagaccattattgatttatactcgttaagatttgtgactagactagttaaaacaaaggctcagagaagttaaataatttgcacgatggcatttggcttgtaactagcagagcctagtttggaagagcaatattttgtaaatctttagttgagatgaggaatctttcttttacattttttatacaaatttaaaataaagataactacctcagtttatttagtatgatacattcagcagtgttaatatatagaaccagtatattacctgaatttcttgttaagttgttcgaagagctattaaatattgaattgctgatgggctgaaaatgaatataaagatcttcagttactgatgaaggaaattttgagtggcattcagccttatgaggtactgttttgatattgtagctctgcaggctgttggggtagctacacatggtgatgttctcattttctagtaaatcagaaagaataagatttagtatagagaaaaataatagttaacaacattttataattgttttatctagaatttttgacatatttgtcattcttaaaggcattataagaaattcctgttgtatttgtctagcaacataatgaaagaatgatgcacatttctgtttattattttataaatatggcttaaatgcagtatctttgttatttagtttatctgtattagtgtagattttattattaatattgtggttacatggttacaatctggatctcaggcacagtatggtttgcagttaaaatacgtcacttgttttcacttagtctaggaagcacttttaaaaaattagtctgacatattgactttgctaacaatacatgaaatgacattatcatctcacatgtatagaacatttacatttctggccgggcgcagaggctcatgcctgtaatcccagcactttgggaggccgaggcgggtggatcacctgaggtcgggagtttgagaccagcctgacaaacatggaggaagcccatctctactaaaaatacaaaaaattagccaggcgtggtggctcatgactgtaatcccagctactggggaggctgaggcaggagaatcacttgaacctgggaggcggaggttgtggtgagctgagatcacgccaatgcattccagcctgggtaataataacaaaactctgtctcaaaaaaaaaaaaaatttcttaatttttccccctggtaatggggaaggagagcatctatgcagctgttactttttagtgtttcttcctgttttgcttaaacagaaattgtttcctttcctttttttttttttttttttttgagacagagtctcactctgttgcccaggctggagtgcagtggcacgatctcggctcactgtaacatctgcctcccaggttcaagcaattctcccacctcagcctcctgagtacctggtactacaggcatgcgccaccatacccagctaatttttgtatttttagcagagatggggtttcaccatgttggccaggctggtctcaaactcctgacctcaggtgatccccctgccttggcctcccatagtgatgggattacaggcatgagccactgcgcctggctgcttccttttctttaaaacgtgatatgagagatttttctgtggtggaacattgagttaatcacattttggttttgcttaattatgatagcttacctaatgtcacatttgatgtgttcaaccagttctgcaaattaaatagactgcaagagcagttccataggtttccatataaagttattaattccagatgaaatagtggtggtacatccaaatagctaatcaaattgccttgcagattcagaagttttaggcttcttagaggcacaaatacatcagcattcagttgttctattttgttttggcagagatataactgttttagtttatttaagcctaaaaatgcaccctgttgaattacatagatggagtttctacagatatttaaaatttctagactggagaggttaccaaaaccgttattatgtaagatagtaaccttgttctcaatcaaatagagctctgtgagtaaaaagtatgtctgtagaactcttgtgtctgtaccattaagagtaatttggttataactgagatcaagtatagtaacatctttcttgatatctgctggaatcaaggtataatttttttcagtaaaattacattggacttcctagaaaaacaaaaaaaagaaaggcattaatcagaaaaaaaattaatagaatttcaccaaatttcatatttaagcacttagacattagaaggacgttattttgggaaaaaaacctactatctaatattttggtgttacagtagagcaaatctttttctttattgggatgaaatactaaaaattaaggatattctgatacatacaattgaacaaagagattccaatttgtcatacgggtattttccaactgttattacatgatcattacagaaagtaatgctactggaatattcccatttatatatgtggaaatgtatggtaaataataattctgttaacatttaatattccagtgtgcacaattgctttatagtgaggaaattattttaaactatatgtgtttttaaaatcagcagagctaacaacattatacctagggctgttcaataattaataaatgggctgggcatggtggctcacgcctgtaatcccagcactttgggaggctgaggcaggcgggttacctgaggtcaggagttcaagaccagcctgtccaacacagtgaaaccctgtctctactgaaaatacaaaaaaaaaaaaaagtcagccgggcatggtggcaagcacctgtaatcccagctacttgggaggctgaggcaggataatcgcttcaacccaggaggcggaggttgcagtgagctgagatcatgccattacactccagcctgggcgacagagcgagattccgtctcaaaagcaagcaatcaatcaatcagtctgaataaactctctggtttaactctcttaaactctctgggtttaacagctcaaagtttggtgttttaaaaggaaatatttatcttttatcagaaatggagccaggtattgaatttaaagagccacacaatctgaaattctttatgtggatatagatggaaagaaagaaatagttcttgtttttactgaacagtaaactaagaataaatagaactaagaatagttctggtttattactgtttttgcagttagattttttcaccaataataattcaatagcagtttctctcataaatatgtgctttttaaaaaaaagtttcctacattttaaacaagattttactcttaaaactaatttctgattttatagtgaaaattttcagatctctccctttaatcaacttttaaagaactcagtttttataaatgaaggctgcttttgtcaaattggaatttggatatacagagctaaataaactcttaattttagtaggtcagattttctttgctttcttattgcccttttatattttactaaatatacagaaaatgtacctttgaaaatatttttactattttgattgtaaaaacttactcttttagaagactggattttgtctgataataatatcatggagaggggccaaaagaggattgtgatgcctgtgactttcatgttgcagacctgatagaaaagagagtattttcattaaggacatttttatttttccctcttttgaatctgtttattctttttttttttttttttttttggctgagacagggtctcactctgtcacacagacctggtggcatggtcacagctcactgcagccttgatctcccaggcttaagcagtcctcccaactcagcttcctaagtagctgaaacacaagcatgcactaccatgcctggctaattttaaaaatttttgtagagatggggtcaccatgtgttactcagcctggtatcaaactcctgggtgcgagccatttccccccagccactggcgtggccttgaaaagtgctgggattatagatatgagccacttaccctggcctttcaaatctactttttcttgaaatacataaaatgtgaaacaagtgcatggccattcaccatccttgcactctgatcttaataaactagaaagcccctttgaagaatgagactgatttctattttttctttttagagaaaattaatatttttaagtgtgtctcattagtttctagatctcatgaaaggagctttaaagcaatttaagtggttgtaaattttaaaaatttaatatagaagtgcacaaaagaaattcaggaaaacgtatatttatgcatgtttaagtatatgcttatattgatggtcttgattttttcaattttaggcattatctattggcattatctatctattattcttgacttaaaactgtgggagatgagaatctttagcactctttttccccccatggtaacttttaaaaattttattgaggcgtggtagatatacatagttttggggtacatgtgataaagtagtgcattcatataatttttaaagatcaaattaatgtacttgggatatccaacacgttaaatatttgtcttttctttataatggaaacattcaaattctcttctagctgtttttaaatgtacagtaaattagacgagagggagagcatcagaaaatagctaatggatgctgggcttaatacctaggtgacgggttgatctgtgcagcaaaccaccgtggcacatgtttacctatgtaacaaacctgcataacctgcacatgtaccccggaacttaaaaataaaagttgaaggaaaaaaattactgtaaactataattaccctactgatctaacactaggccttctttttttaagcaaactgtatgtttgtatgcattaataaacttttctgcattcctccctccctaccaccctttccagcctctggtaaccactagtctactcttaatctatatgaggtccacttttttagctcccacatgccggtgagaatgtgtgatatttgtctttctgtgcttggcttatttcacttgacataatgacctccggttccgtttttgttgccgcaaatgacaggatttcatttgtttttatggctgaataatattccattgtatatatatgctacttttttttaatccattcatctgttgatgggcacttaggttgattccatagttttgctcttgtgaatagtcctccaatacacatgggagtgcagctatctctttaatatattcatctcttttttttaaatgtatacccagtggaattactggatcaaatgtaaatgtaagtgttatatttttagttttttaaggaaccttcatactgctctccagagtggctatactaatttacattcccaagagtgtatgagggttcccctttctccacatcgtcaccagcatccgttattgcctgtcatattgatagaagctactttaatgggggtgagattatatatcattgtagttttgatttgcatttccctgagtgattactgatgttgagcattttttccacatacttgtttgtcttttgtgtgttttttgagaaatatctattcagttcttttgccatgtttacttggattatttgttttttatcggtttgtttttggctagtgagctgtttgagctctttatatcttctgattattaacccctttttagatgggtagtttgcaaatattttctcattccgtgggttgtctcttcacttttttgatcattttctttgctgtgcacaagcttttttgcttggcgaaaccccatttgtacatttttgctttggtttcctgtgcttttgaggtcttagagacacaaaaaaatctttgtccaggccagtgttctagagcaattctccaacgttttctttttttctcttttttttttttaaataaagaaaagaggtttaattgactcagttccacaggctgtacaggatgcacgtctggggggtcctcaggaaacttacaatcatggtggaaggtgaaggggaagcaggcatgtcttacatggctagagaaggaggaagaaagagcagagggaggagctacacacttttaaacaaccagatctttttttcttttgagacagagtctggctctgttgcccaggctggagtgcagtgatgccattttggctcactgcaacctctgcctcctgggttcaagtgattctcatgcctcagcctcctgagtagctgggactacaggcatgtgccactttcatgcgggtccatgtgaagagaccaccaaacaggctttgtgtgagcaacatggctgtttatttcacctgggtgaaggtgggctgagtccgaaaagagagtcagccctccagtgttttcttgaaacagttttatagtttgaggtcttattaaagtctttaatccatttttattcctggatatggcaagagataggggtctggtttcatttttccatatatagttatgcagtttttctagcaccatttattgaaacaactattatttctccattttatgttcttggcacctttgttgaagatgagttgatgtaaatgtgtgtatttatatctgagttctctattccattccattggtctatggatctgtcttgatgccagtaccatgctgatttggttactatagctttgtagaaaattttgaagtcaggtagtgtgatgcctccagctttgttcctttttgctgagggttgttttagctatttgggatcttttatggttccatatgaattttaggatttttttttctacttctatgaagagcgtcactgtattttgataggaattgcattgaatcagtaaattgctttggttagtattgatattttagcaatgttcttccactccatgaacatggattatatttccatttttttttgtatcctcttcagtttctttcatcagtgttttacagtttttgttatatagatatttcacttcattggttaaattgattccaaggtattttatattctttgtagctatcgtaaacaggcttgctttcttgatttctttttcagattcttcactgttggcatatctaaattctaccaatttttatatgatgattttatatcttgcaactttactgaattcagttgtcagtttttacagattttttgtggagtatttagggtttgttttttttttaattttttaagtgtaagatcatgtctgccaggtgcagtggctcacgcctgtaatcccagcactttgggaggccgaggcgggcagatcacctgaggtcaggagtttgagaccagcctggccaacatggcgaaacctcatctctactacaattacaaaaattagccgggtgcagtggcaggcacctgtaatcccagctacttgggaggctgaggcagcagaattgtttgaacctgggaggcagaagttgcagtgagccgtgatcatgccactgtgctccagcctgggtgacagagtgagactctgtctcagaaaaaaaaaagaaaaactaatcagagtaggcaagaatccatgcagcatactaaagtctctcgcctcgttagcaataaggaatttactgctattttagtgctagtctgttctagtcaacttcctcattgcctttgatttgttgatccatttatgcacattccccttctaccttttctctttccatagttaaatgaaatttgttaggaaaagctactctgcctcctatattttataaaatttggatgtagatcataatagaatcccttttagagccagaagtgcatttaaactatcacttattcaagatgattgcccatagaagagggatgcctaaatcatttacaaaaggtagtttacctatgtttaatgatttataggaataggtgttcagctccttcaatggcttgtttcagtatttctcaatgatgtggtgaaattcttactgatgtctctagtaggctgcagaggtgactgaggagaggtgggtaagggaagtgctgttttttttccagaaacaaataggatggggatagtgaaagaaagcaaataggctacaaagaaaatgaactagatttaagttaaaagttgatatgaaatagaagcaggtgaaaaaagtaatggaggcaagacaggactgtgagcttatgtggaaatggagacggagtatggttttatatttattatctgtatctgctatttaatgctaataattgttttctcaagtgcgctaaaagaaaaaaatcataaggattagaaaaggattttttttcctttccattggatagatcttggaagcagtgtatactcagctcaaggtagattctgtacaagaaagcattcaacaaatctaaagcatcgttaggtctgaagctgtgaaatacattgattgatccatactatctgtgagagttttcacatatttgtgtgccttttcagaggagaaagattgaaagagggggtgatgtcgattatcatgacactgagtaagtccccagacaaagcatttgctagcattattgggtgtctttaaaaaaagaaaatcagatacgcagaatagctggccaagtagattatgcagaaattatccatcagtcagtttagcctgtttcaacagttggtttaaaaggaagtcagtcattgttgctttctttctccttttggaatattttctaatttggattttttttgaaatgatagttgagtttcatatagtgattacttaggagctaatataaaatagaaaactggaatagaagatggaatatcagtttcttttgttatttcacaaaattacgtgcatttttacctagcatatgatctacgttactgaaaaaaaaagagctttactcaaaggaaatggtagatactgaaaaagaagcattgttcttaataaagtttcaagtacatgtttcttaagttatttactttatatgattattatatgctatgaaataaagagatgctgtaattattttggttttgttaaaatctaaatgtagtttttccattaagtattttagatatttatgccagaattcaatgtatttagagaatgatgttaataatacacaattaactttgtttccttatttaactattgtgtagatttttttcagatttaaaacctttttgtaatggaaaatttcaaggaaaaaacctaagtaagaagaatagttatcagcctgcttcaataatcatcaactcatggccagtcttttttttatcttgccaattggcttttagattagtgtcacttcagaatgctctgtgattaacatattttaaaataaaaattcttataaatttgattggctagatgaaaccatttccccccccgccccccgcaaaacaattacttagtattgtattctaactttatttaggaaagaccctttggccatgtctcaggtatatagtatttttgaggtagaccatgtgaaaatataatcatattttcttatttttcatcacttcttaaaggcaaagatggttgtacagacttaacaaacttaaatatgattaaaaaaaatacaacaataaccaaagctataaatatacatatcttacctttttttcttttgtctctaagacttgtgtgctaaaggaaattaactctgtttcaacggcattaaaaaaagtacatcgtatgattacatttcactttgttttaacctttgtacccagtgaacaggtgatttaaaaaaaaaaactagacttccttagcaaaagattgactagaagaataatttcttaaagtcatcttttccttttttagtataacaagtaaggctgtttgcctaacctttgtgtttctttcttttttttctttttttgagatgaagtctcgctctgtcattcaggctggagtgcagtggcatgatctcggctcaatgcaacctccacctcctgggttcaagcagttctcctccctgcctcagcctcctgagtagctgggattacaggctcccggcactgcacctggctaatttttgtatttttagtagagatgcggtttcaccatgttggccaggctggtctcaaactcctgacctcaggtgatacccctgcctcagcctcccaaagtgctgggattacaagtgtgagccactgcacccagcctacctttgtgtttcttaattactctttgaaaattttattaaagtattaacaattttacttactgatttagagtttacaatattgaaaatgcatacttttgaaagatatactgttgctaaattaatttatgtttgtcctgatggtattttgtgcttagaagcattcaaactgaggtcaggtgcagagtctgacacctgtaatcccagcactttgagaagctaagatgagagaataatttgaactcaggaatttgagaccagcccggccaacttagcaagaccttgtctctactcaaaataaaaagtaaaaacattagcagggcatggtgttgtgtgcctttagtcccagttacctgggtggctgaggtggggggatggcttgagtttgagcatgcagtgagccatgattgtgctaccacagtctagtctgggtgacaagtggtacctgtcaagaaagaaagacagaaagagggagagggaaagagagagagagagagaagagaagagagaggagggggaggggaaggaggaggaggaggaagggaaggaggcagggagggaggaaaaggaaggaaggaaaggagagagagagaaaagaaaggaggtagggagggattcaaattgtaaagataccaccaagttttgtattctattgagtttcaacgtttttgtttacttattattgtgtgtttttttttttttttttttttttgagatggagtctcgctctgtcacccaggctggagtgtagtggcgcagtctcggctcactgcaagctctgcctcccgggttgacgccattctcctgcctcagcctcccaagtagctgggactacaggcgcccaccatcacgcccagctaatttttttgtatttttagtagagacggggtttcaccatgttagcaaggatggtctcgatctcctgacctcgtgatctgcccgcctcggcctcctaaagtgctgggattacaggcatgagccaccatgcccagcctgtttacttacttttatgacaccatcatcagtggttttactgccaagttataacaggagcaaagtactcaaagcatcaaaaagaccttacacctggacatcatatggcctttagaaagtcagttacttttcttatgctgtaatttctcctctgtaaaatggaatactttataacattagttctcatcttcctacattgaaagaagaaacactgttggtagtcagtaatcaaatttagaatgaattccttccaaaagattaattccactgggcttcagtatccttaatttatgaaaatagatactttcctttcaatttctttgagctcatatacctatacaaattgtagcagcaggaaacacatttgttttactgttgtaattgaagctccaagtgaagataccacttcttctccaacagtgaaacaaaaataaattgaaattccaggttgctttactatgttcatcttttatttggttattttgagattttttttggtagggaaatttctgagtttaggttgtttattctagtagtaggatatgaatgtgtagaaggtgtgtaggggatatgtggatccacaagcttagctggtgattgtgaaaactatagaagttggtatctatgagcgaaagagagtaaatagtgataggttaatcagattttgaaactcaaaatagaaattaatgatcttgggagtgaaaatgtgtgttcaatccagctttttataaaatgtaaatcttgaaagtatttagataagtggcatcttacctattcttttttcagagtttttctctaccctatcaataattgaccttgcctaggcaacaagtgacatgtcattggtatttcttttgattacgtgataaaaatggttattgcttctaattaatttcactattactacttttataggattatgtttgtaatgtttattgtgtttttagagaaatgagcttaatattttacaatgctaaaaaatagcaaaaatttgtgaaatagcaatgttaactaaagcagtaagtaaaagagaacttaagcaaagcatattattaatctaaagccataactaaaaaatcaaattgcactgcaggcctctctactccctagttctgtcagagccacactggatgatttacacgggaaacttctatacagtatttaatttagtcagaaaaacttatggctaaaggatgctttaaaaccacaattctaaaacttatttgtcttttttttttttgagatggagttttgctcttttgcccaggctagagtgaagtggcgcgatctcagcccactgcaacctcttccccactgggttcaagcgattctcctgcctcagcctcccaagtagctgggattacaggtgcccgccaccacgtgtggctaatttttgtacttttagtagagatgggtgttttgtcgtgttgcccaggctggtctcgacctccagacctcaggtgatccacctgcctcagccttccaaagtgctgggattacagacgtgagccaccgagcgcagcctcttatttgtcttttgaaggtataactttaaaaaagtataaatgcatcctcatatatataagtcattaaggattttttggtaatctttgtgatttcttagtaaaataaaatggagagtaaggaaatagaggaatttagggatggagaagagaaagatgtaaaaataagtttgtgctaatggggccaaattttatataggtcaaatagcattttttagtacaaatataaagacttttcagtcacacactgtggttgaatgtctttaagtatcctattaaattaggaccatgacttgtataaaataattggatattttttcctcaatatagtatcaggaatattacgtgcttctgattttaggaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggtaatacaaattactgctgtgtgccaagcatgtatcattcttgctactaaaagtatagtttgaatatcagcagcatcagcatcccctgagaacttgactatactttgagatcagttttcattttaacaaggtccccatctgattcatacgtatattcacatttcagaagaatttatttagaaaacttcattttcatctgctgtttgatgacctagcttttactcttattatttttggtttacttctatttattcattttgcatttcataaagacatgaaaatactcgcatttataaaaatacttgtctataaatatttgcatttataaaagtacttttctataaatgtttgcattgataaaaatacttgtctgtaaattaaaaagtctgtaaatacttgcagttacagacttttaatgcaaacattaaaaggcctcataggtggaggttgcagtagtgagctgagattgcaccactgcattccagcctgggcaacagagcgagactctgtctcaaaaaaaaaaaggcctcatagaccagatccatatatatatttactttccttttccttcctgcttaataaacagctaacctttttacctgttagcattatgatttgaatggctattgtcctgtaattatattgcctaaatttccatttttaaaaattaatttttttattgatacacaattgtacatatttatggggtacatgtgatatttccatgcacgtatgcaatgtataatgatcaaatcgggataattaggatattcatcacctcaaacatttggcattttttttgtgctggaaacatttttttttttttaatttaaaaaaaattttttttttgagacggagtctcgctctgtcgcccaggctggagtgcagtgcccatctcggctcactgcaagctacgcctcccgggttcatgccattctcctgcctcagcctcccaagtagttggcactacaggcgcccgccaccacgcccggctgattttttgtatttttttagtagggacggggtttcaccgtgttagtcaggatggtcttgatcgcctgacctcgtgatccgcctgcctcggcctcccaaagtgctggtattacaggcatgagccaccgcgcccggccttatgctagaaacattttgaatctccttttctggctattttgaaacatacaattaattactgataactatagccaccctagtgttctatcaaacatgagaatttattccttctctcccccacaccaccccatgcccccaactgggcaccaccttctcagcctctggtaaccatcattctactacccccttttttttgtttttttttttttgttttttttgagacggagtttcgctctgtcgcccgggctggagtgcagtggcgcgatctcggctcactggaagctccgcctcccaggttcatgccatgctcctgcctcagcctcctgagtagctgggaccacaggtgcccgccaccacgcctggccaattttttatgtgtttttagtagagacagtgtttcaccgtgttagccaggtgatccgcccccctcggcttcccaaagtgctggtattacaggcgtgagccactgtgcccggccgagatccacttttttaggctcctacagatgagtgagaacatgcaatattaaataagcaatttaagtccctgttgagggcatattgagaatcctctcaatactcagtcatggtggttccctttcatgcccagatggcccttaactaaagattaagcaaagaattaggccccataaatgccaataatgattatagttttagtttcttagacattcctttgctgacaatttagtaacctttttattttagagaagatttctaagatactgtgaagcgttgaagaaaaagtatggcctggccaagatggtgaaaccctgtctctactaaaaacacaaaaattagccaggcatggtagcaggcccctgtaatcccagctactcgggaggctgaggcaggtacttggttgatcccgggaggcggaggttgcagtgagccgagatcatgccactgcactccagcctgggcaacagagcgagactctgtctcaaaaagaaaaaagaaagagtatgatagaaatgccaaaatagtaccaaaatatagttaatcttgtatgggataatgaatgagtaaacagtttaaggatcttatcttaggagtgaaccatatttatatttacatatacgtgtatgtatgtgtacatgtgaaccatatttatatttacatatatgtgtatgtatgtgtgcatgtgttatatgtgtgtgtacacagtatagagaaattaggcaaaagatgtgaaaacacggttacaaatcaaaattttaaataataatcttaaacaatgacataatttgaaagcttctgatatttgatgtctcagaacatagtgatgattcagtgtgaaaaggtctaaggtctagctacttttgagaaactcatgaagttttttttttttttttttgaaggcacacagcaagtttttaagaataatgaaagaagttgggaaaaatagaaataatgaagtgttaataaattctagtcaaaatgtaagatgccagtgaagatatttagaaaatttacttagtcactttgaaatgttgagaaacagagaaataaattttttttcccagctccctccccccactacaacaaattattcttaatgtaatttggatttatgtttgcttttttttttccacttaggaattagatacacttcaacaacaattggattcacagaacatgaaaaaagagagcctggaagcagtaagtataaaatcaaataagggttctcatactactcagctaaaaaagttaattcagccaagtatattaatataactaattcaactacatattgatctggcagcttactaataggagtttaatactttttcttcctattctggacccacaaagatcctagtatggtaagaaattagattcagttattgagtacctactatgtataaaacaaatcattccgccctacctaggacatgcaaaatccaatagcaattaaaaaaattatttttttagagacagagtctttctttgtcactcaggctagagtgcggtgacatgatcgtagctcactgtaaattcaagctcctgggctcaagcgatcctccctcctcaggttcccaagtagctaggacttcaggcaggaaccaccacacctggctaattttttttttactttttgtaaagacagggtctcgttatggctgatgtacagctcctggcctcaagcaatgctcctgccttggcttcccaatgtgctgggattacaggcatgaggcattgtgctcagcctctaatggcaatttaaagacacatacacaagagattataaaaacaaagaaagagggagagacatgagttcatctctttaaggatgtaaaaacttactttttttattcatttatttaaaacgctttatttcacaaaacaaaatgtgcatatggtttaaaaatagttgaacaagaggaaagtaaaaatgtctgtttttttttttttttttttttttttttagacagagtatcgctctgttgcccaggctggagtgcagtggtgcgatctcggctcactgcaagctccgcctcccaggttcacgccattctcctgcctcagcctccagagtagctgggactacaggcacccgccaccacacccagctaatttttttgtatttttagtagagatgggatttcactgtattagccaggatggtctcgatctcctgaccttgtgatccgcccacctcggcctcccaaagtgctgggattataggcgtgagccactgcgcccagccaaaatgtctgttttgtgtccttctttccagatagaactactggaaagacatttatcaagtgcttactgtatgcttttttgagctgtaaacacatatcagcatcatcttcatgtaatccccacaagagtcctaaatcccatcttggttttacagttgtggaaaacctcaagtggggttcctacgtgctatgctagctgcagctttcttttttcaccctaacattgtatctacagtgtctatttatatcagttcctagagaacctcctcattattttaaattgctacaatgtattatgttgtataattataacacagccttgtaaatgaacaggttgtttatagttttccgggattataaacaatactcctgtgaaagcatacattttatgcgaagttatatcataagattgaattctcacaatgggtcaaaaggtatacagtttaaaaatgttgtcagattgccaaattgccttcaaaaaggttgttccaacttttacttctagatgtaatgtatgtgaatgcttatttcccctgcattcactgacagcaaatattatctgacttttccagttttagctattttgataggtaaaaattactaccttatttgaattttcatttatttatgaataaagttgagtatctatttatatcatttttggccaatgaatttctttttctttgaactcctttttcatatttttggcgtttcagtatactgtctgtatctcaaatcttgcctccctttcctgatttcctgtggattcaggtagacatcatgatgacagtattaggaactgttgtagactgatagattgctgacaccctagcttgcaaaagaaatgagtattttgtaattaattcttttgagaatttgctattgaaaaagttatttaattaaaaatagtaaggtagttggctgggcgtggtggctcacgcctgtaatcccagcactttgggaggccaaggcaggcagatcacaaggtcaggagatcgagaccatccttgctaacgtggtgaaaacccgtctttactaaaaatacaaaaaattagtcgggcatggtggcaagcacctgtagtcccagctgctcgggaggctgaggcagaagaatggcatgaacccaggaggcagagcttgcagtgagccaagatcacgccactgcactccagcctgggcgacggagcaagattctgtctaaaaaaagtaaaaaaaaagcaggtagttttctgtgtctggttgtccatctataaagacacttaatttttatttccttggatctctggtgatggaaatacgcttaaagaaagaaggaccacatttagtattaatacaaccagcttgcagaattcctcatggttcttttttggagtgggtttgagagagtcaagtcttacttcacttggtgaatttggtttccataggaaaaatcataagctataaccttagatttactttttgtactgatgccgttcttctctgatgtcagtacatttatgcctaaaataacaagagttttaaaaatacacaatatgtgcaaattaagataacatgtcactaattctatttaacttttgccagatttctttctttttaaaaaaaaaaatttttttgagacagagtcttgctctgttgcccaggctaaagtgcagtggcacagtcttggctcactgcaacctccgccttctgagttcaagcaattctcctgcctcagcctcccgagtagtgggattacaagcgtgcatcaccatgcccggctaatttttgtatttttagtagagacagggtttcactgtgttggccaggctggtcttgaactcctgaccttgtgatccacccgccttggcctcccaaagtgctgagattacaggcgtgagctatcacgcccagcccagatttcttttatttatttgtttaggacttgttcttcaagaaaatacctgtcagatagtggtcaatcaactagtattttttgaatactttatgttcactgctgtacaacgtattaggtcatgcttattcagttcacaagagtggaaaaaatcaggtgaaggattaacatgagcttaagtcttccagaacaattttatcaagatgaaattcaaacaaatctataggattgttaggcaaaaaggagacgatactatgaaaaaggatagcataaaatatctgcatttcttctatgtctttttagcatggctttttttaatcttatctgatgcctaatctgttacttgaactgtatatataatccattgcttatggactttgaaaaattatctcgtctactcgttccttttttggaggttccttctttcatacttttagaagagaagaggttggccaggcacagtggctcacacctgtaatcccagcactttgggaggctgagatgggcggatcacgaggtcaggagttttgagaccagcatggccaacatggtgaaaccccatctctactaaaaatacaaaaattagctgggcgtggtggcaggcgcctataatcccagctacttgggaggctgaggcaggagaatcgcttgaacctgggaggcggagtttgcagtgagccaagatcgcaccactgcactccagcctgggtgaaagagcgaaattccatctcaaaaaagaaaaaaaaatgaggtcttcccttctaagaattttattttgttcaagttgtaggtccggtttcaaatgtcactgttaactcttatgtctttgttaactttgaaaagttatttacatgtcagatccttagttttctcatctgtaaaatagagatgatagtactatcttgtagagtatcactttggatagtagagatagcatataaataacatgtagtatagtgcctggcacagaacagatgctcagtaaacaagagtctcaaatgtcattttaatcatcaccaacaccattcctaccttttttttggtgttgttagctaataacatttttgtcacatccttatttttttctttgtgaaaggtgggatagtggtgagtacacagtaactgttatttcatgtgttcatttcctagtgctgctataatagaatatcacaaactgggtggcttaaaagaaacacaaattttctcacagttccagagcctggaagtctgaaatcacggtgtcagcagagccatgcttcctctgagactctagacagaatcttgctctgcttcttcctagcttctagtggtatccattagctcttgatattgcttgacttgcagctgcatcactccagtctttgcctgagtcataacatggtattctccctgtgtgtctctgttgtgtctgtactcttcttataaagggcaccatcatattggattagggcccacccctaatgaccatatcttaacttgactaaatatgcaaagagcttatttccaaataaaggtcaaattgacaggtttatgatgttaagactccagcttacctttttgagcagacacaattcaacccacaaaattgtgggaaaatatatgttatgacctatttagggaaaaatatcttctctccaaagatcacttctatggactttgaatcagacattgtgtttaaagttgtacatatgttttgacattgtctttatcctcccattggtagagttgtcctatacttattcaggtcttatatgtagaaaataaaataaactaaggctatcaacttcttgtgaatcttagactgaaaatagcaggatttatttttattcttccaatttaggaatgtgctttgtagcattattgagtactaatgatatttgctgtctgtatttaaagatgctagtagtttaaatttacccccattcttataaactgaaacctattttagaataattattgataaaatactaattaaaactttcccttcttattttcctttaggaaatagctcactcccaggtgaaacaggaggcggtattgctgcatgaaaaactttatgagttggagtcccatcgagatcaaatgattgcagaagacaaaagcataggatctccaatggaagagagagagaaattacttaagcaggtgggcaaaacaaacatacttattttaagatgtctggttttggtacatgtattgatttgttttttttaaagggatattaatgcaagtagtaaagctagtaagtgtattgtctaaaaatagtttatgtgaagaaatgactttttaatctagattttcttcctcttttattattattattattattatttttgatgtaggatcttgctctgtaacccaggctggagcacagtggtgcaatcatagctcactgtagccctgagctgctggcctcaagtgatcctccacctcagcctcccgagtagctgggactgcaggcatgtgccaacacaccaattttttatttttattttttgtagagatagggttttactgtgttgcctgggctggtctccagctcctggcctcaagcagtcctcccatttcagcctctccaagtgttgggactataggcacccagcctagattttcttaatcaagtatttcatagtaacttaggtgaagctaacttttccttattaggaatacttgaaactcttctttattggtcattaaatatttagataatctttttgaagatatgtttcattattgttttgggccttgtatttagaaaatggagtatcccaaggctaatgactttttgtggttgttattatcagtgcctccatgaagagaatggaattaaaatgtcctgtgaaattatcgtatgtcctaaagtcatgacacatgtaacatgtatttagtagctttcttactaccccaggggtggatttagtttagctccaaattataattagcatgttgtttatcctgacacatcctaactataagggccttaggagaacttcatatgtatatgggcacagctccagtcagggactcctttgcccttagacttagatcaagcccagtgcatttagaagaaatgtaggtatcaattcagggactatttaattattagaatcatttcaaaaaggtattaaatctagaacctgtgtagttccttggagagaaatcattgaaagatggggaggagtgatcttgaggtacgcctaccacataaaatatagaatggctgcttaaatttgaatttcagataagcaataaataatctttcagatatatatatgtatatggaaaaattatttattgcttgtcaatgatatggatattccaaatattacatggtacatatatcctctcaaaggtattcactatttatctgaaattcagatttaactgggcttgctcaatctagcaaccctaccttgtgggaaactgaggggaatctcagaaatcctagatgtttatatcaacttatccaggcctgaagatgagctatcctcatggtgcctggagggtagctgtgagtatatcagttactacccttactttgaggaaaaaggatggaatctgtgaatggttccttggtgctgttccctttaacttcaaaggttgaaatctaaaaaatagatttcaagaaagagagtagatttgacactttagtacaattgtactctagaaggaaattatctttaagatagccttacaatgagttatttttttaaatactactttctttttatgcctttgtagattaaagatgataatcaggaaatagccagcatggaaagacagtaagtatctttatactaggacattttacatccatttctcactttaaaaattacattctaaaggtacaggagtggctttcattctttcaattttacttatagctttaaatatttctttgagtgtttaagagccattgcatagtataatttttttataagtatctttattaagatatactttataccatataatagacatatttaatgtaaacaatttaaaacattttagtatattcacagaagtgtgcagccatcacctagatcacctttatttttcaatttttatttatttttatctttttgagaccaggtctcattctgctgcccagactggagtgcaagtggcatgatatagctcactgtaacctcaaactcctgggctcaaacctcccaagtagccaggactacaggcacacaccaccatatctggctaatttatttttatttttagtagagtcgagatcttgctatgtggcccaggctagtctccagctcctagcctcaagtgatcctcccatctcagcttcccaaagagctgggattaaagatgtgagccagtatgccatgcccccagtcaattttagaactattcagtcagcccaataaaaccctgcaccctttaaccatcacctcccttatccctctcccagctctagccatgcccattctggacatttcatatatatggaatcattcaatatgtgcttctgtgtgtcaggatgctttcacttagcacagtgagccttgctttctcgaagatcagctgactattggtatttggctttatttctgggttctctgttctgttccaaggctcataggtgagccttgaaaactaagacaaatggaatattatttggaaataaaaattaataaaatactaagcatgtattagtttttattaatactaatacatgcttagtattttattaatttttatttccaaatagtattccattgtatggatataccatattttatttatttatcaattaatggatgtatgggctgttaccatttttttattatcatgagtcatgctcctataaacatccatgtacaagtttttgtgtgggcatatgttttcacttctcttgtatatatacctaggagtggaattgctgactcatgactatgtttaactttttgaagaactaccagactgttttccaaaacagctttaccattttacatttcatttatttgtatttgaatacatttatttgaaatttgtaaaacaatcattttactaccagtcaccagaaagcataccaattgttttaatttaatttttttttttttttctgatacagagtcccagtttgtcgcccaggctggaatgcagtggtgcaatcttggctcactgcaacctccacatcctgggttcaagggattctcatgcctcagcctcccgagtagctgggactacaggcacacagcaccatacccggctaagattgttttaattttaatcaactaagttgtaaattaataagtagtcaacaatgacgaaattgccttttaatgtctctcatattctattgtaatgtttttgttgctgattacaacttatgaaattaaattttggaatcacagtctctagtatcagctgaattgcagcccgtgtcaagtgttttgcaatactggctaaggtactaagaaactaattttttttttctgttttttgtaactgtaagcaaatttctatattcttatggctaagagaatatttttttcttttaggaacatttaaagcagctttattttatcttttttatttcttttttttttttttctttttttttgagacagagtctccctctgttgcccaggctggggtgcagcagcccaatctcggctcactgcaagctcctcctcccaggttcatgccattctcctgcctcagcctccccagtagctgggactacaggcgcccgccactgcgcctggctaattttttgtatttttagtagagacggggtttcactgtgttagccaggatggtctcgatctcctgacctcgtgatctgcccgcctcggcctcccaaagtgctgggtttacaggcgtgacctaccgcgcctggcctatcttttttacttcagtagtttttggggaacaggtggtatttggttacatggataatttcttgagtggtgatttctgagattttgatgcatccatcaaccaagcagtgtccactctacccactgtgtagtgttttatccctcacccacctctcactcttcccaccaagtccccggagtccattgtatcattcttatgcctttacgtcctcatagcttagctcccacttataaatgagaacatacaatgtttggttttccattcctgagtttcttcacttagaataactgtctccaactctgtctaggttgctgtgaatgccattattttgttcctttttatggctgagtagaataaacatatatatatgtatgtatatgtataaatatatatgtatgtatatgtataaatatatacgcacacacacatacataccacattttctttattcacttgttgattgttggctttttggctgtttccatatttttccagttgcaaattgtactgctgtcaacatgcgtgtgcaagtgtcttttcatataatgacttctatttcctctggatagatacctcgtagtgggatcgctagatcaaatggtagacctacttttagttctttaaggaatctccatactgttttccatagtggttgtactactttatatttccacaagcagtgtaaaagtgttcccttttcaccacatccacaccaacatctatttttaaaaattttttaattatggccattcttgcaggagtaaggtggtattgcattgtggttttgatttgcatttccctgataatgatgttgagcatcatttcctatgattgttgaccatttgtatatcttcttttgagagtcatctattcatgtccttagcccacttttcacttttttatgggatttttttttcttgctgatttgtttgaacttgttgtagattctagatattagccctttgtcagatgcacagtttaggaaagttttctccaactctgtgggttgtctattaactctgctgattcttttgtggtgcagaagttttttagtttaattaagtcccatctatttatctttgtttttgttgcatttgcttttaggttctttcagttcatgaagtctttgcttatgccgatgtctagaagagtttttctgatgttatcttctagaatttgtatgggtttaggtcttagatttaagtctctgattcaccttgaattgatttttgtataagatgagagatgaggatccagtttcattctcctacttgtggcttgccaattatcccagcaccatttgttgaatagggtgtcctttccccaccttatgttttttttgctttttcgaagatcagctgactgtcagtatttggttttatttctgggttctctattctgtgccattggtccatgtacatgtttttatgccaatacaatactgttttggtgacctcatagtccttatagtgtagtttgaagttggttaatgtgatgtctccagctttgttctttttgcttagtcttgctttggctatgcaggctcgctttgggttccatatgaattttggatttttttttctagttctgtgaagaatgatgatggtgaaatgggaattgcattgaacttgtagattgcttttggcagtatggtcattttcacaatattgattctagccatccatgagcatggaatatgtttccatttgtttttgtcatctatgatttctttcggcagtgttttgtagttttccttgtagaggtctttcaccttttgggttaggcatattcccaagtattgtattgtattatattttgttttattttattttattttcacagctgttgtgaaaggagttgagttcttgatttcttttttttttttttgagacagcgtcttgctctgtcgcccaggctggtgtgtagtggcgcaatcttggctcactgcaacctccgcctcccgggttcaagcaattcttctgcctcagcctcccgagtagctgggactaaaggcacgtgccaccacaccggctacttttttgtatttttagtagagacggggtttcactgtgttagccaggatggtcttgacctgaccttgtgatctgcctacctcggcctcccaaagtgctgggattacaggcatgagccaccgcgcccgaccgagttcttgatttcttttcagcttggttgctgttggtatatagcggtgctactgatttgtgtacattgattttgtgtcctgaaactactgaatttatttataagatctaggagttttctggttgagtcttcagggtttcctagttatatgatcatatcaagagcagacagtgacagtttgacttcctctttactgatgtagatgccctttattcatttcttttttctgattgctctagctaggacttctagtgctgtgttgaatagaagtggtgagagtgggcatccttgtcttgttccagttcttagggggaatgctttcaactttcccctgttcagtataatgttggctgtgggtttgtcatagatagcttttattaccttaagatatgtctcttctgtgctgattttgctgagggttttaatcataaaaggatgctggattttgtcaaatgctttttctgcatctattgagatgatcatatgagttttgtttttaattccgtttatgtggtgtatcacgtttattgacttgtgtatgttcactcatccctgcatctctgctataaaacccacttgatcatggaggatctttttgatatgctgctggatttggttggctaatttttttttgaggatttttgcctctaagttcattagggatgttggtccatagttttcttttttttgttatgttcattcctggttttggtattagggtgatactggcttcatagaatgatttaaggaagattccctctttctctatcttttggaatagtttcagtaagatcagcagcagaggctgccatctcccccattgaacataacttctttggcctgaaaccaccccttccatcacccacattggccatagccagccccatacaagaggagtctgagctgagacacgcctaaccctgccccgacctgatggtctttctctacccgcctcgtagccaaagacaaaagacataaacttgtggcaggcctatggcctcaccaatcacctgagaaacccaaatatttattcaggtgaccttagggcaagcttgtatccccccatactactgcagctgatgccctcttgaaagtgccacctcctagctggaggccaaccaacacaaaccattacagcaattcataacagaacaatcctgctccaagggaaggagaaaacaacagctaattccactgcctgtaacatccacactaaccagaggccctgactctgttcacatgacagcttcactgccagcataaccagcattcaagaaaaccagtgcacgaaacaaaactacaaccaagaactctcacagaatccacttcactcttcagctacctccaccagagcaggtgctggtatccacagctgagaccctaaagacagatcacttcgcaggactcttcgcagaccctcccaagtacaagcccagagcccggtagctctggtgggtggctagacccagaacagcaataacaatcactgcagtctggctctcaggaagccccatctctagggaaagggagagagcaccacatcaagggatcacctcatgggacaaacgaatctgaacagcagtccttgagtctcagatctttcttctgtcatagtctacccaaatgagaaggaaccagtaaaacaattctggtaatatgagaagacaaggttctgtaacatccccagaagatcacactagtaccagcagtggatccaaaccaagaagaaatctctgaattgacagaaaaagaattcagaaggtcagttattaagttactgaaggagccagcagagaaaggtgaaaaccaacttaaagaaatttaaaatacaggatatggatgaaaaaaatctccagagaaatatgtagcataaataaaaaaacagtcacaacttctggaaatgaaagacacactttgagaaatgcaaaatacattggaaagtttcaacgatagaatcaaacaagcagaagaaagaacttcagagctctaagacaaggctttcagaataacccaatccaacaaagaccaaaaaagaattaaaaaaaaaaaaaagcacaaaggctccaaacagtttgagattctgttaaatggccaaacctaagaataatgggtgttcctgaggaagaagacaaacctgtaagtttggaaaatgtatttgagggaataatcaaggaaaacttccctggccttgctagagatgtagacatccaaatataagaatgtcatggctgagcacggtggctcacacctgtaatcccagcactttgggaggccgaggtgggcggaacatgaggtcaggagttcaagagcagcctggccaataaggtaaaaccttgtctctactaaaaatacaaaaatccgctgggcatggtggcacgcacctgtagtcccagcaacttgggaggctaaggcagaaaaatcacttgaacctgggaggtggaggttgcagtgagctaagatcatgccactgcattccatcctgggtgacagagtgagactccatctccaaaaaaaaaaaaaaaaaaaagaaaagaaaagaaagaatgtcaaagattacaactgggaaatgcatcacaaaaagatcatcacttaggcatagtcataagattatctaaagtcaagacagaggaaagaatcttaagagctatgaggcaaaagcatcaggtaacctataaaggaaaacctatcagatcaatagcagatttcttagcagaaaccctacaagctagaaggaattggagtcctacctttagactccttaaaataattatcagccaagaattttgtatccattgaaactaagcttcataaatgaagcaaagataaagtcattttcagagaaatgctgagagaattcaccactaccaaggcagcactacaagagcagttaaagggagttctaaatcttgaaacaaaacctcaaaatacaccaaagtagaaactccttaaatcataaatctcacagggcctataaaacaacacaatggaaatgaaaaactaaggtattcaggcaataactagcacaatgaatagaacaataccacatatctcaatactaacattgaatataaacagcccaaatgctccacttaaatatacagaataacggaatggataagaattcaccaaccaagtatctcccatcttcaagtgactcacctaatgcataaggtctcacataaacttaaggtaaaagggtggaaaaagttattccatgcaaatggtcccaaaagcaagtaggagtagctattcttatattagacaaaacagactttaacaacaattgaaaaagacaaagaaggacattatgtaatgataaaaggactaatcaaacaggaaaatatcacagtactaaatctatatgcacctaacactagagctcccaaatgtaaaaaacaattaccactagacctaacaaatgagatagacagcaatacaattaatagtgggggacttcaatactccattgacagcactagacgggtcagaaagtcaacaaagaaacaatggatttaaattataccctagaacaaatggactcaacagatatttatagaacattctacccaacaactgcagaatatacattctgttcatcagcacatgggacgtcctgcaagacagaccatatgataggccacaaaacaagtctcaataaatttaagaaaatcaaaattatatcaagtattctcagaccacagtggaataaaactggaaatcaactccaaaaggaaccttaaaaaccatgcagatacatggaaattaaataatttgctcctgaatgatctttaggtcaacaatgaaatcaagatggaaatttaaaaattctttgaactgaacaataataatgacacaacctattaaaacctctgggatacagcaaaagcagtgcctagaggaacattcagagcattaagtgcctacatcaaaaagtctgaaagaacacaaatagacaatctaacgttacacctcaaggaactagagcaacaagcacaaacaaaacccaaacccaccaaaagaaaaggaaattacaaacatcagagcagaactaaattaaattgaaacaaaaaattgaaagataaatgaagcaaaaagctggttctttgaaaagataaacaaaattgatagaccaatagcaagattaatcaagaaaagaagagaaaagatccaaataagctcaattagaaacaaaatgggagatactacaaccaataccacagaaatacaaaagaccaagcttacagtgagcacctttacacgcacaaactagaaaacttagaggagacggatagattcctggaaatatacaatcctagattaaagtaggaagaaatagaaactctgaacagaccattaacgagcagtgagattgaaatggttaaaaaaaaaaaattgccaacaaaaagtccaggaccagatggagccacagctgaattctatcagactttcaaagaattggtactgttttacatttctatgtaatataataagagcagcatatgagcagcatgtgagggttccagtttttcacatcctcacttgttattatctctttttctattatagccattcctaatgggtatgaagcggtgtctcactatggttttgatttgtatttgtttgatggctaatgatgttgaggttcctttcatatgcttattggccatattctttgggggaaatgtttacttagttcatttgctcattttttaaactagattgtttttgattactgagttgtaacatttccttatatatgctagatagaggtgtcatcagatacatgatttgtaaaaattttcccttgttctatgaattctatgaattatcttttcattttcttggtgtctttggaagcataaaagtttccaattttgattttgtccagtttttctatttttcttttgttgctcttgcttttagtgtcatatctaagaaaccaatgcctaatccaaggtcataaagactatgtctatgttttcttctaagagtttggtaatttagttcttacattgagatctttgatccatttcaagttaattctgtgtatgatgtgaggtaggagtcccttagcttctgcatatgcacttttcccagcaccatttattgaaaatactcttctttccccatttaattaccttagcacccttatcaaaaatcggttagctatagatatatggtcatatttctggactcacaattttagtccattgatatatatgtctatccctatgcctatactacattgttttgttatggtagctttagagtaagtataactgctttatgttaaaatattaacctatataatcttctgccagtggtaggttttcccttattttctcatttttgagactaattttccaacttaatttggcttatagaaacctacaaaaagtattgttaaatatttttcattttcttaatactgcaaatcaaactcaaaggaaagttgggagggggtgtgctgtttaactcaggcaactagtgttctcagaatatacctgggctccaaatatgaatcagtaaaaaagatctatgcttggcgcagtggctcgcgcctgtaatcccagcactttgggaggctgaggcaggtggatctcgaggtcaagagatcgagaccatcatggccaacatggtgaaaccccgtctctactaaaaatacaaaaattagctgggcatggaggcgcgtgcctctagtcccagctattcgggaggctgaggcaggagaatcgctttttcccgggaggcagagattgcagtgagccgagatcgcaccactgaacttcagcctggtggcagagcgagaccccgtctcaaagaaaaaaaaaaaaagatctagacaagattcttcctctctaaatttatagtattgtcctcataataggatatgctatttttcgatatttatgcaatttgtaaaagatatcctaatgtcatcgtcagttatagtattgtccttagaataagacatattatttttagatattgtttatgcaacttggaaaagatatctaacctccccatcaattgtttttattgaatgtctatatttccttcataaattcattaaaaatattttcaacaggttaacagatacaaaagaaaagataaatcagtttattgaagaaattagacaacttgacatggatttagaggaacaccaaggtatgcttctggtatttttataatgtagattaacagatgtttagcagtattaatatagtgttaactggtgtctcagagactgttcaactacctgggatttattatttaattctctatgatattactaactttactaaaatatatactgtatgagtaatattaaagcaatgatttaaactgaccacttatgagttaaaatgattgcataaaatttatttagctttgccaagcagtttgtttttttttttacaaaaacagaagtaaaatgtttaaagttgttagagattcctaagttatacttcctcctaagttacacttccttcctagtaatagtcaatagtttactataaacaatatagtcggccgggtgtggtggctcacgcctgtaatcccagcattttgggaagctgaggcgggcagatcatcggaggtcgggagttcgagaccagcctgaccaacatggagaaaccacatctctactaaaaatacaaaaattagccgggcgtggtggcacaggcctgtaatcccagctattcggaaaggctgaggcaggagaatcacttgaactcggaggcagaggttgcggtgagtcaagatcgcaccactgcactccatcctgggccacaagagtgaaactcggtctcaataaataaataaattaattaaataataataatatagtcaactactaatggcagtaactggtagcgttagaggggatgaaaatcaaatcacaaataccacacaaataatccagacagaattaattccccacccaggtctagtaatgaagtagcaaagactgattaaccttatcctccccaactttccccaggagtggaatttgaagaactaatgcaggtaccagaacacctgagggagcttggggtttgactatgtagaaatactgtggtgggggtttgggtgtgggggctacattgttatttatggttaaaggaggaggttgagcatcagtttcctaacaagcttctccctaataagaaagataaaagtagattctccatagcattttaatcatagtttaactgcaaaccagttactatgctcttggattatcaagaattgattgtatattcttatgagttaggtatggtataaacagtgtgcacatgtacatgtattcttgttatggctaaggaaacattcatagcggtgcagtggctcaatcacagctcactgcaacctcagactcttgggttcaagtgatcctcctgtctcagcctcctgagtagctgggaatatataacgtctgccactacatccagctaagttttaaatttttagtagtggcgcatgcctgtaatctcagctacttgggaggctgaggcaggagaatggcttgaacccaggaggcggaggttgcagtgagccaagatcacaccactgcactccagcctgggtgacagagcaagactccgtctcaaaaaaaaaaaaaaaaaagggtacactgttctatattttagcagggaaggaatttgtgtatgtgtgtgctaactagaaacaatgagaaatagctctaatgaaagttatatggtcagaatttggctacaagctctgcatcattagtaaagcggagtattattggcagatgtcatgctactttccaaaaagcctgaacccatcctgatttctcctttcttagttgaaatgccaacaattgcatatttgcttaattattgctttttaaaatattggctctgtataagcaagggaaagtaatagaaaaagtattgttcttccaagtaaagcagaacacaccaagtggacaatagcagcttatattttcactcaacatgggatactatttttaataaggatgtttttatcctcaaggcttacttctaacatatagccaagtgacttttttgtttttaaatggagatgaatcttgctgtgttggccaggctagagtgcagtgactatttacaggcatgatcatagcttactgtggccttgaactcctgggctcaagcagtcctactgcctcagccttccaagtagccgggactacaggtccatgttactgtgcccagcttgtttttgttaaggaatctgttaagaaattcttttaggtcgtgtgcggtggctcacgcctgtagtcccagcactttgggatgccgaggtgggcggatcaccaggtcaggagatcgagaccacggtgaaaccctgtctctactaaaaaatacaaaaaattagccgggcctggtggtgggcgcctgtagtcccagctactcaggaggctgaggcaggagaatggtgtgaacccaggaggcggaacttgcagtgagccaagatcgcgcctctatgctccagcctgggtgacagagcgagactccgtcttaaaaaaaaaaaagaaattcttttattcttactacagattaatacttgagagtttatatcttatattgaagtccttcagagtaaatagtttcttcgaccacttagctgaaatcaggcccttaactttactcatttttttttttttttttaatgagatagggtctttctgtcacccaggctggagtacagtggtgtgacaacatagctcactgcagcctcaaactcctgggctcaagtgatcctcttgccttagctaaataaaataataaataaaataaaataaaataaaataaaataaaataaaataaaataaaataaataaaataaaatgtaaaataaaataaaataaaatgtaaaataaactcctgagtagctaggactacaggtgcacaccaccatgcccagctaattgttgaaaactttttttgtagggacagggttttgctctgttgcccaggctgatctcaacgtgcttggctctagcagtctttctgccttggcctcctaaagtgtggggattacaggtgtgagccactgtgcctggtgttttactctttactagtgtattcccttacattgaataaattctataaagaacagcattactattataagacatgtcaaagccttacacaaatcacaaaaaaagtgatcagttttctatgcaaaaatactgagccttttgaaatcagggtagttctcagcttcacccaatgctggcttagatttcaactttctcaagtctgctaggtcagttaccagttctccatctcctttcagcttccaaaatgttattgctgttgtctcctatttctatatgctgggggtttctacctttaaaaattctttttgctatagttttagtggggtttgcgggaggatcaaaattagatgtgcatgttcaacgtgccattcataccaggaaatgacaattataagccttaattacctagaatttctgaaactttaagcaccttgaaggtagatcattttacttatttttaaaaagattttttttgtgtgttttgccttaaatgaccatcctcatgctttcattaactgggcaattagcctcagcttataggaggtcatccttttcagcttaaaaaaaaagtgtcctggccgggtgcagtggctcacgcctgtaatcccagcactttgggaggctgaggcaggcggatcatgaggtcaggagttcgagaccagcctgaccaacatggtgaaaccccatctctattaaaaatacaaaaattagctaggcatggtggtgtgtacctgtaatcccagctactcaggaggctgaagtaggagaatcgcttgaactcgggaggcagaggttgcagtaagccaagatcgcgccactgcactccagccttgggcgacagagcaagactccatctcaagaaaaaaaagaaaaaaaaaagtcttttaaactacttaaaattattttaaagattcagattaattttttaaaattgtaattttaaatatgaatctggcatgtatttaacatgaaaaatgcaagcagaaaagtatataaagtaaaatgtcatctcctttctcctcatccaagtcttcagaggtaatcatggtttacagtttaatgtttaggcttttagacttttaatacattgataaacatatttttaaatggagtaatactaatatacagttcttctgagcttgagtcttttcatttaactgtataatatacattcttccctatgaggatgtatacttcattctgagaaatggtatagcatagtggtcaatgttagggctctaaagtcagacttaagaatggtgcctggtacaggtgtggtggctcatgcctataatcctagcactttgggaggctgaggggggtggattgcttgagctcagaagttcgagaccagcctgggcaacagggcgaaaacctgtctctacaaaaaaatacaaaaattagccaggcatggtgatgtgtgtttgacttgtagtcccagctatttgctaaggtaggatgattacttgaacctcggaagtcgaggctgcagtaagccgaaatcactccaaccaaaatcatgccactgcacttcagcctggataacaaagtgagaccctgtctcaaaaaaaaaaaaaaaaaaaaatggtgcctggtgcacattaagcgcttctgacaaccattagctacccctatgattgttgttacataggattcattgtatccacattgatatttaggctgtttctaattttttactcccaagaacagtgctgcactagtacattcatgtttataacttgtctgtttatttccacagaataaatttctagaagtgaaattttgaatggaatattatttatatttacaactggtttgcaaatttcttcccagaaaaggttgtattatgttatacaaccaaaagcagtatgtgaaggtggttccttaccaatgctagccataagttttttagtttttgtcagtcaagataaggtacacatcactgacagttccgaagttttgactgttaggcctgaatttgtagtaccaccgcgatccacaagatggggctaattttctgagcatctattaatatatacacagtaggattgacaaatagagttaacaaatgttgtacggtcactgtcatatgtctctccaggagggattattgggcattattactcaccaaaaatgattactttccagattcaagtattttcccaaatgtggagttgattgtaaaaccaaatatatgattattaaaataccataatacatataaataactagttgctacaatgtggtaaatatgtcataatagaaatatatgcaaagtgctataggaatattgaattactgtcttaaattctgaatgaattcattgtaactttctgcataatatatatgtgtcattcaaagtagtaaaataacaaaatataatactttggtttgtctatagtatactttttcatactcagagttctaaagccttggttaggaccattgtttctttaattatggagggtaaaataaacaatgttaaagacagaatacttttatttattatttatttgtttatttatttatgtattttgagacggagtttttctcttgtggcccaggctggagtaaaatggtgtgatcttgacttaccgcaacctccacctctcaggttcaaacaattctcctacctcagcctcccaagtagctgggattacaggcatgcgccaccacacctggctaattttttgtatttttagtagagatggggtttctccatgttggtcaggctggtctcaaactcctgacctcaggtgatctgcctgccttggcctcccaaagtgttgggattacaggcgtgagccaccacgcctggccagaatcattttattttaagcacatgtcctgttactagaatgcctggattcaaatccaggctgtgctgtttgatcttggacatgctatttatgctatttaatcttactttatcttagttttttttctttaaaatggaggtaattacagtacctacctcttagggttattgtgagaattagattagataattaaataaacttaattattaatagtctaatgttggctggaagccttaccaataacataaatggtaaacatatataaacacaaaacacattcataatagcagtcaatttaaaatatgctcataaatattaattagtgacttattgttaatgctgttactttataaaagcaaaattgaataactttactgcagttattttcccaaagcatacattagaaagtattttcccgtcagtatttccttcaggatgtacaaaataacctatttagtttcaaagtggtttatcttctggtatctgagatttcaaatggcatctatccattactattctgtggttttccaacatatatctgctgaagaagaatgaattattattgttcaatctagaaattgtttaaactatacattgaatctttcattaaaatggtggtattacatctacaccaggatcatcaccaccatctgaaacttgttagaaatgcaaattcttgggctctaccccagacctattgaatttgaaaccctaaggagagggctcagcaatttgtgtttcagtaagtcctcctggtgattctgattcatgttaaagttttataaccactactttcgaaaatgattaaggaccatatgtttagtatatgctgcttactaccaattatactgtatgattttatatacagtactctgttggaacaaacttctacatagtccttttgttttacataattagataataaaaattatacaatttatacaatatgtaaaaattataattacagtttttaaagtgcctcctgtctttagaaatagaattatctgatcttgtttgcatacctgtaatttaaaatttaaaatgtagttgacccttcaagacagcattgggattaggggcactgagtgtgccatgcagtcaaaaatccatgtataacttttgactccataaaaacttaattatcaaaggtctactgttggctggaagccttaccaataacataaacagttaacactattttgtatgtattatatactgtattcttacaataaagtaagctagagaaaagaaaatgttattaagagaactataaagatttttattattttccacttactaatgaaatggaagtaggtcattataaaggtcttcatcctcattgtcttcacattgagtagactgaggaagaggaggaagagtttggtcttgctatctcaggggtagcagaggcagaagaaaatctgcatgtaagtagacccaccaagttcaaacctctgtttttcaagggtcaactgtatttcccagagaatgtatatttagaaaattgggtgaaacctaatgccaaagttagtttaaaacattaagcttatatgtactctttttaccacagcaattttgtaatatagtcaattctttgtacccacgggttcttcatctgcagatcctaccaactatggatggaaaatacttgaaaaaaatacaggaagtttcaaaaagcaagtttgaacctgccatgtgctaagcactatgctgaatccatttgaactgaagaataccctgctatagcctcccattgtttcacagatcttcagtctctctctagcacccactgtttgagcagtgttcatctggcattttattcattggctacttgtgttcactctttgcttctgtgaaaaaaaaaagactcctaaaaatcaattatatggtgaaagaaatcccttacagactaagagagagcgtaaagtgctgtctctcaacaagaaaataaaattcttagatcttttgaaaagtggcgtgtgatttaccaaagtgacacaataaaacagaaggaagctgaagctgacatttgtggaagttttagtgctgcccctacaatggcaaaaaaaattattgctgtgattcatgataaaatgcttgcagagactggtcgggcacagtggctcacgcctgtaatcccagcactttgggaggctgaggcgggtgaattacctgaggtcaggattcaggaccagcctggcccaaatggtgaaaccccgtctctactaaaaaatacaaaaacttagccggtagtggtggtgggcacctgtaatcccagctactagggaggctgagacaggagaattgattgaacctgggaggcagaggttgcagtgagccaagatcgtgccattgcactccagcctgggcagcaagagtgaaatcccatctcaaaaaaaaaaaaaaaaaaagcttgcagagactaagaaaacatcaaatgtatgagtagacaaaatatcacagaagcatgtccctgttgatggcaaaattatgtatgaaaaagcatttagcctttgtgagcattcctatgaggaagttgaagagagtgagaggaaggaatttaaggatagtaagggatgactagctagctgtggaaagtagtacagccacacgaacttaaagatcacaggagaatcagcattagctgatgaccaggcagtatcagcattcccagaagagctcaagaaactcagaagacaaaggatacctttcatagcaagtcttcagttgtgttgaaagaaacttgttatagaagaagaggcctaatacctacatccgtaagagtgtcaagcaggctttggggttcaaagcctggaaagatcgttttactctggtgctatgtggcaacacagcaggttacatggtcaagccaggtcttgtgtaccaagcaaacagtccctgggtccttaagaacaaaatcaaaaattgcctacctgtgttctggcaacacaataggaaggcttgggtgatggccatcttgttcctggaattcagttttattcctaaaatgaagaaatacctggaagagaacagggtgccattcaaggtcatcctcataattgacattactcacagccatccctgatctctctacttcactaatgacaatgttgcagtgatgttcttgcctaaggcaagtactacctcactgttttagccatttgatcgaggcatcagcaagtgcattaaatgacttacacccacctcacctttgggaggatttgtgctgtccttgatgctaaccttgactacagtgtcatggatttatggaagagctttacaattgcaaatgtagttgtgctttttacagaggctgtagatgccccaaagcccaagacagtcagtgcatgttggaagccattatggaatgaggtagtcagtgatttcaggagcttccccattattggtgcagaagtcaggaatatggttttgtttttgtttttgttttttttgagttagagtctcactctgtcacccaggctggagtgcaatggcgcgattttagctcactgcaacctctgcctcctgggttcaagcagttctcacgcctcagcctcctgagtagctggaattacaggcacatgccaccacgcctggctaatttttgtatttttagtagagatgggtttcaccatattgcccaggctgctctcttggccaggctggtctcaaactcctgacctcgtggtccgcctgtcttggcctcccaaagtgctgggattacaggcgtgagcccaccgcgcccggcccaggaatatcttgaatgttgcaaaggaagttgatgaggaatgcttctctgacatgatcaagggtgacttcgaggaacacatagaagagcatagagaaacccttaccaacaaggaactcaaggttctgctgaaattctctacaggagatgatgacagtgataacagatttagcagaaacagagtcctcaatttggatacttgaaaaatttgcagcagtttttcaacaggtgcaagtgttaaagggtatgatccttcagtggaacaaagcctccgtgtcacctgagggatagcaacatgcctacaagcactgcaagagttgtttgatgcttcaagaaaaaaggagaaacagcttcctagaacaatgttcccaactaaagccgtctgtattatgaagcctcgaccttaaacgcttgaagattcttccagcataaatgatctttccgatgtcctgttagaaggttcaagttagccttgtgtttcaccacttacctacagtgctgcgcatctcaccacctcaccatatgggcaccatgggcaccaaatagaaattataatcgtcatcatcgtcaaatgagggttatcaagagagaaaagcgacagtttatgcttctttttttttaatttttaaattttttgtaaagacaggattcactattttgcccaggctcgtctcgaactcgcagcctcaagcagtcctcttatcttggcctcccaaagtattgggatcataggtgtgagccactgtgctcagccagaagagccagagttttgatgcgtcttaatgtactctttcaggtcattaaatgaaagtcatctgcaagtgttgatagaaaatgtggctgggcgtggtggctcatgcctgtaattccaacactgtgggaggctgaggcaggaggatttcttgaggtcaggagcttgaaatcagcctggacaacatagaccccatttctatttttaaaataaaaataaaacaaaaagtgttacattgttgctgatgtatactgtgtagtttgccctacagtggttgcatctgtactgaacatgtacagtcttattttccttgtcattattccctagacaacacagtgtaacaaccatttacaatatattaggtatcataagtaatctagggatgatttaaagtatgtagcaggagggtatatgtaggttatatgcaaatactgtgccattttatgtaaaagacttgaacatcctcaggttttgttatctacagaggggtgggggtactgaaaccagtccccatcagataccaaggaatgactattttatatactaacttgctgcttactgtaataatggtatgtgaaaagtagatgggagagatagactgaatgcaaaaagatggaattttataggcccccacaactaattaaaattgaaataggagtcagggaggagaaagtgttctggctcactaaaatatgtgaaaatgttagaaggggtttagataactcaatatgaattaatgtgatacagccttgaaaacggctgaaatcctagattgcataacaaaaaatggttatgtagactatggagagtgacatcttcttggaatcttaagtttcttggcataatatgttaaaagggttagagaaaaactagagctcgttcatagcagagtgaccagaatggtaatagggatagaaaccatgccatatagaagatattgaggccaggtgcagtggctcacgcctgtaatcccagcactctgggaggctgaagtggggggatcacttgaggtcagaagttcaagaccatcctggccaacatagtgaaaccctgtctctgctaaaaacaaaaattagctgggcatggtggcgtgtgcctgtagcctcagctagctgggaggctgaggtaggagaatcgcttgaacctgggaggcggaggttgcagctgagattgcaccattgcactccagcctgggcaacagaacgagacactgtctcaaaaaaaaaaaaaaaaaaaaaaagaaggaaaggtactgggagactttgcgtgcttcagaagtattccaagtgctaagaaacagtctggctgtgcaaaagtcctgtggagttttttcttgccccgtctccctgattttgttttctgttgacctttcaactccaaaatcagtaggctttgctgagttggggaccttgagttcaggagagttactagtacatgccttgttgtgtattgatcaggagagaagattgggatagccacctatttggaaaatggtaatcagaccttcttaggggcagaactacttctcagagtataaaagcctataaagcctgagtcaggagaacgtcatttgatgccagagaagtaaaagtatggggtgaacttcccttgcagtgaggacagaggtagttttggtggtgctcagactattggcagtgcaagaagagcatatctcccttactgcactgctggctatagcagagactataaaaaagcaatggtgtcctttctacagtagccccagtcttttgttaacagcacatacgcatttcttctttcctacttgagggatgaaaaagcctgaatttatagtatacatttttgtatacttgtcttattagagtataaattcttcagaggaaaatattttacttttttctttaatccccatgttacccgataaagtaccttgctggtataattcctgtgtaaaatcctcctgaagtcttttcacgcatctggttaccacagcacttcatacattcctgtcagagcacttatgttgcattataaatttttggttttgtacacctaatggagtgtaagccctttgagaatagggtggaaactgtcttactcagtttgatatcccaaaacctattacagtatctggcacttagtatctgataatcagtaaatttatcggaaataaataaatgagtatagaagtatgcgcacatcaaatgctccgaattaaaggatatctccaaaattaccttccttttaccgttgtgtccctttccctctcccttggtctcctcattgttgattctactacattagacccttctgcttacttgctggtacctccattgtgatacactgatttgcttccgtctatctacaatctcatcctgtcctgtgatattgaatctaaggatatatttgctaaaaaccattatgttttaccctaccttaggactgcctacatttacactgcctttatgagcaactcagatactaatcctccactgagaaatcaccaaatagagaagttcactaatgctctgaccactctccttcttagcaatagtgatattggaggaagttttatgaagcttgggaatctgctgagatgtgtaggagctctgtcccatctaatccagctggccagctgtacagctgtaaatgttaaccagttacatcttccagctcaatctgttggcaactaggaggatgacttttaggagagaaggagggaggagtctcctctcaggtttctgacttgaatgatgaatggatggtaaggacagccaaatgtaatagggaataaagagagggaagactatgagtttaattatgagtatactgagttaggatgtcctgaaagggcttccaaatcaatatatatagtaagcatttagattaaagaatctaaaactcagagaatatattaaatttgacagttcttaaaccacaagaatgtatgaaattgccatggatatagcgttagaagttcattaagaacagaactctagaatataaatgaagaaggaagcagacccatgaagagaagacagaaaaataatgatctgagagtaagaaacgccagagaagccctcccatccccgcaaaaagcaaaaataaaacatagaggaaaacaaagaaaattgaaaagttgtaccaatagtgtcaaatattacagagtaagataactgactgccgtttgaatttgatcattaagcagttgtataatctcactgagaacaatttcattggaacaggaggaggaaaagcctcattgcagtgtcttggggtttaaaagcaagatgagaaactggaaacatcatgtgtaggaattctcttaagattaaaagaaaaaagataagatgatagttaaatccttgtaaagtctaggatccaggcctccctcctaatcccttaatgcctgaccagtctcccaagagtggaacttaaatagccagaacaagaaactaggactttcttggaaacatgggccatggcaggttcaggagatagtagcttttctgccacttcacatgggcaatgatatttatatgcacatcttcctcctataagggtatcccagatcatgtgtgctgcaaactccaactctttctgtttcccactcaaaaacctgtctgtagtatattttacaaatgtgtgtatatatataaacacacacacatatacagacaaagtttgtttaataacagagtacctctggcctcctcttcacagttaatcagggggcgtcagtgtattttgagaccatggttgatcatttgaactgagtagtagttgagtaaagttgctaatccatctagagccttatctgagtggatccagggtttcctattggtgctgggtgtagcctggctaggaatttgtgaccattaggtatttactgtccttaaacattagctttcacttgcagctttttactaccagtaatattttggaagccttaacataagattttctcagcatcagggttgtcgtcaatgaatttcagaaaactcttcagaccagaaggcagaaaagctgtttgctaatccacgtctctgactttgccatcacccttgtgttctcataattcacttaatgccaagcaagtatatgcacagatggaggttcatgtctctgtctgctttctctacagaaggcagctgccatgttccttcaaagctcagtttttcttacagtgaaatcctattgtcataaaataatcatgatccactcctactaatgggtccctctgtgaggcctaaatggcagaattcattcatttttctaggccttggatttttgtctctttagacatgcttttcatgtttgttaaactcaacatatccaaaactgctgtaagcaactctttctcacctttttccccatttaggttagttgtactaccatcttctcagatgcccaagccagaagcctgggaatcatacttgattcctccctgtttaaccctcaccaagccaatcactctggctcttaaatgtcacaaataataattcactactttccatcccaattaccaccgctctactcaaggcagctttcatctttcacccagattatcctgacaactttctaactggttttattgcctccaatcttacttctcttttattctccagactggaaatatttttcaaaattgcaaacggattatttcatctccctggttaaaattctttagtaattgtccttaggagaaagtccaaactctttaacatggatcttataaggtgcttcgtaagctgcctcatctttgtgctactttttcacttcattctctgcctcggccataccactccctcagttctttatgctaccatattcatcctcagtttgaaactttttactggtaatgctttgacatttgcagtttctgtattttgaccaggtaactcctactattctttataatacaacttaaatattacttgtttagggaaactttctctgtaaccctaacctagattagttgcccttgctgtgtgctcctatagcatcttttatttttcctatgatagcagttagtaccttttaattttaattaattgttcaatctttagagtataaactctgtgagtgaagttactctgctgtcttgctggtgatctttcaaagatggaatggactttcttgggaacttatgtttctcagcacccatagtgttcatgtataggttgaatagccccaggttgggaatggaaagcctttaagtcctttccaatcatattgtttgttccacatattcaagttacatgcatatgtctacttgaaaagtctctataagtcattgtaaaagaatttcacctaatcgaacacgtcgaatagtcaatgactaatggcatagagagaaccaaagagagatttttaatttagagccctgtatgtgcaatttttgaaattcatgttgtattttatatctctcataggtgaaatgaaccagaaatacaaggagctaaagaaaagggaggaacatatggacagtaagtgatattcttgtagatataaaaatataatattttcagattgctgttcatttataccaaatcagagacctcattttgggcagatataatggctaataaatgcagaagtgtggacattcaaagcattttgccttgaagaatagtttctagcataatttagagatgggtagaaaattctaaaaagatatgtgatgagtgtctatacgttggggctagattctaaagctagtacttacattcgtagtctgtacagaggaaacctatagaccaggggtccccaatccccaggctgcagaccggtaggaaccaggccgcacaccaggaggtgagccactggcaagcgagcattaccgtctgagctctgcctcctgttagatcagcagcagcattagattctcatatgagtgtgaaccctatcgcgtatgagggatctaggttgtactcttgttatgagaatctaacccctgatgatctcaggtagaacagtttcatcccaaaaccatcacccgcatctgcccccagccctggtccatagaaaaattgtcttccatggtccctggtgccaaaatggttggggactgctgctatagatcatttattgattgaatgttctcttttacatgcttcactatattcacctttagtatctttcacttttatatttagctttccataatacttatctcattgtttattagccctcacatcagatattgtcacttttttctatcaccagctataattttagttgccttttgttagttttgattcacttaaaaaaaatctcagcctgattttataaattggttttcacttaaacctatacatttataatttttttaaaaaattggcatgtattctcaattactggtttccttttaagttatcattttgctggaatctgaattctagcgaagtgctagaatttcatctaggtctgatgtcaatagttaccttcatggaggcatgcaataaaagagtaattgtcacctcttattttacaatgtaccaagttttctttaaaatgtcagtaaataccaaaaattatctcaaaaatatttttttaagtcttttggtaaaggagaaaggtgtaaaatcaaggaacaatgtgtcatgacaccacagtattggaaattactagatactacctagtgtggtatctggcacttaggtgtcaataagtgttcatttaatgaatgtttactgaatgaatggaaagaattcctatactacagaatcttaaaatagaaggtcacctagctcagatttctttccacatattaattatggtttgttttccttaaaaaataacccctgaaagacaatgttcatttatgcctttgtatatgtaaaaatctcatatgtccacttaatgtgtgatcaacagattatagaagcaggatattcacacataagacctgtgtgaatgctgaagcaggacattaaagaaaattcagttttataaaaaatgttgattgtggtcctctaccaccatattcaaataaaaaatgttttgttgaagactgttttactttaaaaaatatgctaaatataagaaaaaagtataatgggaatccattacagaaggcaagctattgatgttattcatgctaacagtaaaattatttttgactgaaagtttctattttttagatgctccatagaaatactcgaaaatgtaaataagagctgtttctatattaaacaagtaaaaagataatttcctagaatatttatttacaatctgaatacattattaaattcatttagttgaaatgaatccagcattgtaaataaaatacttattttcagataaaatgggtattcagcattggaaattatagaaataaagttagtagtcagggtgttaataattattgatgtatcaaaggagatctttataaaagcaaatttcttctgattgtcattttatcagctatttcttttgagcttatatttataactttctgatttacttatatcaaggtcacaggatttaggcagtttgaaagtatataaagttcttattgaataataattacctttgggttaataacaaattaaacagtggcagcttaaaatttctaaaaattgggccaggtgccgtggctcaagcttataatcccagcactttgggaggccgaggcgggtggatcacgtggttaagagatcgagaccatcctggccaacatggtgaaaccctgtctctggtaaaaatacaaaaattagctgggcgtgatggtgcatgcctgtagtcccagctactcaggaggctgaggcaggagaatcccttgaacccagaggtggaggttgcagtgagccgagatcgtgccactgcactccagcctggcaacagagtgagactctgtctcaaaaaaagaaaattctaaaaagcactcttaagaactgcaaatcagagtttatatagtgttaactctatcagcagtaatctctcttatgttttccaattgtcagcttttattgagacttttgaggaaacaaagaatcaggaactgaaacgaaaggcacagatagaagccaacattgttgcactcttggagcactgcagtcgagtgagtaccatgtgcctgtcttggtgtcctctttatttttgccgtgattaactttccaaatacaactcaaaaaatagaacggctcactattgtatcttctcatttaactgcttcctttcaattcccttacttgttactatttatttcagctattaacttttttatcactctagcaaaatgtcaggtaattagggcaatagagaaaaaggatgacatgtataatatcaatattcagcagtaaatgaagcactaattcagagtaattattatgatcttcttccattgttaatctatctgaacttttgaaagtaacatttgcacagataatttcaaaatctagacatgttagaaaatgttaatgtatttttatactgtaaatttattgtaaataaaaagattcttgtatgtatatgtaatgagtatctcaaattatcaaaaaatgtttattgggcatctattatgaaatgcatgcccccctttcaatattctagtgttttaagactccaaccagtttctaaaatagtgtagttgaattttttctgcagtgaaataaaggaaatgaaaaaaaacccacaattttgaatttatagtctgtctttattgagaaaacccaatttggaatctcattttctatacaatatataacttgaatggtgtatttcaaaaaaaatacctgatccaaacatctcatcctttgacagtgttttccaagagttttattgagaactaactaaatcagtggatttttttctatttttatttctctgcaaatgcagaatataaatcgtatagaacagatatcctctatcaccaatcaagagctaaagatgatgcaggatgacctcaattttaaatctactgaagtgcagaaatcacaaagtacagctcagaatttgacttcaggtgagaaaacaacctagattttaatattctttttttttaaaatatatcaatgttattctctgattattttaaagcctcattgacagaggctataatttatgattgcctattgccccagaattatgtgtggcttttttcatcagctggctagtattatgttgtatattgtcactgatttaacaacatttattgaatacttatttcaagcctgtgctatataattctggatattgttaaagataaacaaagctggatgcatgttaaagtgctaaggatagattttagtcagtaatacagcgtggcagtaaggcaggagggtccagcatgaattgaaatcaactttgatttgtacagaggtgattgagtgttttaaagggagaatgagggagtagtaagggaaatgaaaaattacagggttcatcaatgtacatgctggttaggccagctgtgtctgttagctggcaattatcaagttaggagtctatgtttatacacagactagcagacagaggccctaactttcctgataatcacgttttaatggaatggcttttaggtccttgaggaaaatactcctgagttgtgggaggtacatacagatatggtttggattttttgtcccctccaaattttatgttgaaatgtgacctctagtgtgggaggtgggcctagtgggaaatgtttgggtcatgggggcggatctctcgtgaatggctcagtgtcatccttgcagtaattagtatgttctctgtgagttcacgcaagatctggttgtttaaaagagcctggtacctcctccttctctctcttgccttgtaacatgcaggctcccctttgccttctgtcatgattgtaagcttcctgaggccctcaccagaagcagttgctggcaccatgtttcatgtacagcctgtagaaccattagccaaataaacttattttttaaaaataaattacccagtctcaggtatgcctttatagcaatgcaaatagactagtacacatatacatcttaaaggtacagaggaaagattcacaactggataccctaagaaagggtagtcaggggcctgttgaccagtacgggctagaataaatagtacattctttcggcggccttgagctttgtctggcaggcactttaagtggggatagggtcatcccagggatgcagacttgagctgttagaaactgtttgtttaaatcttctaatgtgggtagaaggtggtgcatgaaatcatttgtgctgagagtggaatttttataggcagaggttgaggcctagttgagaagagagctcagaggagcctagctagtttggtcaaggattgaatctttgtcagtataagaggcttaaaaaaatctaatctgtttcctcaagaaactttcaacttggtggagtgacagttatgatacaatgaaataatgctatgatagaagtaagcataaggagcaacggaagtacatagggcacatatccagcctagtcttggatagttaagaagagatgatgtttcactttaattagtttcagtcatgcttgctatcatgagactagagcagcactgtccaagagaaatttaatgacagtatatattatatttatataaagttttcgagtagccatgttgacaaagtaaaaagagacagattaattttaataatatattgtatttaaactgatatagccaagttattatttcaacatgtaagctatataaaaatgatcaaagagatattttatcttcacgacatttcaattaggactagccttatttatttatttatttatttatttatgagacagggtctcactctcattgcccaggctggagtgcagtggcgtgatcacagctcactgcagcatttacttcctgggctcaggtgattctctcacctcagcctcccaactagctgggactacaggcacacaccagcacgcctagctaatatttcgtatttttaatagagatggggtttcaccatgttttccaggcttgtctcaaactcctgggctaaagccatctgcccacctcggcctcccaaagtgttgggaatacaggcgtaagccactgcacctggcctggactagacatacttaaaagggctcaaaaatcacatgtggctaatggctgccattgggatggtgcaggtggagattagatacaaataaacaaagttgaggttaaagagactaggataaggtcatgtaaaaatttgtatgggatctttggtttatgaactaatggcttctgtgggtgttctttatgctggtgtgttgcagctttgaattagctatgtttttgtctacctggaattactacagttagtgagatagtgagaaatgaagacctaattaatatttgctaacttaagaatgttgaaagatttttgggtgggaattgaacaatgagaacacttggacacaggaagggggacatcacacaccggggcctgttttggggtggggggagggaggagggatagcattaggaggtatacctaatgtaaatgacgagttaatgggtgcagcacaccagcatggcacatgtatacatatgtaacaaacctgcacgttgtgcacatgtaccctagaacttaaagtataataatatatatatataaaagatttttgaaatgaaataatgatccataatacctttatctggattcccaaaatctaaaaagatattggcagcaaaacctgacctgacctgaactgacgtgaggctatttatagtttttaattatcctacctagtgtgactatttatgctttttgctatagaaatattcgtgtacttgatgacaaggtattccctcagactttgccatgggagttatgtaatcataagtatatgtgctgtattacttttctaaaatccaaagaattctgcattctgaaatagaactgcccaagggttttagataagggattatggacctataaatgcatactgaatgctattaattgcattagtagtggtgatataggtatataattgctatatttaagcctattttatatccagatttgttgagagtttgtttgccgtagtttttttttgtatgtctatatgccaagtaactggaggagttacattcttgatatataactactgttggtttgactgtgagtatatttttattgtggtaaaaaaacacataacaaaatttatcatcttaaccattttgaagtatacagtacagtagtgttaactatatgcacattgttgtgccacgaatctctagaactttttcatcttgcagaacaaaaacactttacctcctgaataacaactccatatttccctatcccctgacccctggagaccaccgttctacttctgtttctatgagtctgactactttaaattacctcatataaatgaagtcatacagtatttgtccttttgggactgacttagttcacttagcgtaatgtccttaaggttcatccatgttgtagcaaagaaggattttcttttttaaggttgaaacattctattgcatgtatatatcatattttaaagtctatctgtagacagacagattgcttccaccttttagctattgtgaataatgctgcagtgaacatgggtgtgtaagtatttcttcaggatcctattttcatttcttttggacatatatgaatatttaagaatattttctcttttctataaactaaataattttatagttttatttcatttagaaaacctctgtttcgtattttagaccttcatgcctaagtttttcatttatctaaagtcaatgtaaattcaacaagtttttccccctttaagctatctttctgtaacagctgtcaagaaatgtacattttttaaaaggcaaaaatcaataccaggaaacaaattcaataatcaagactttgtattcattccgtactttatactttgtgtttataattccttttaacaactagtcattatgggccaggggaggtggctcacgcctgtaatcccaccactttgggaggccaaggcgggcggatcatctgaggtcacgagttcaagagctgcctgaccaacatggtaaaaccccatctctactaaaaatacaaaattagcctgtgtggtggtgcaagcctgtaatcctagctactcaggaggctgaggccgaagaatcacttggacccgggaggtggaggttgcagtgagccgagatcgcgccattgcactccagcctgggcaacagagtgaaaatctatctcaaaaaaaaaaaaaaaaaaaaaaagtagtcattatgtgttctcctgagatgtacagtttgaaaaaaaattgaaaactggcttcaatggagataaaaatccagtttaatagtatgataaggattttgctggaaatttttctttgtaagggttaaattctttgatgcttataattaatttcatttactacattgttttcattttaacttcaaccaaccatataatttattctttctttccttccctaacaccatcccccacctcaagaaatttttttgtatcttcaaaacaccatgagaggtttataatattcttgttcgcctttcagatagaatggatttagtgtactccatgttgttgttgttgttgttgttgtttgagacggagtctcactgtcgcccaggctggagtgcagtggcgcgattttggctcactgcaggctccgcccccaggggttcacgccattctcctgcctcagcctcccgagtagctgggactacaggcacccaccacctcgcccggctaattttttgtatttttagtagagacggggtttcaccgtgttagccaggatggcctcgatctcctgacctcgtgatccgcccgcctcggcctcccaaaatgctgggattacaggcgtgagcaccgcgcctggccttttttttttttttttttttttttttaatggagcaatcacttcttgggggaagggtgaagaaaacttagatattataatggccctccagaggtcaccatacctaaatggctacacaccacatgggtgatgtaaaaatttcaggggagggaggtgattggggaaaaagagtctgtaatcgacttcttagggaatcaataatgtaagaaaaaggttgagaaacactggtgtactgcatgggcaaagaggcaagggatttatgagcaatattttttatttatatttttggaaaggaaactccagagagtaaacaaatgtgctgatgacagactatcttagaaacacttccccgggtcaaagtggttccttctgagattttgctcctatgtacacactgcttggtaaactttgcaacttcacggcatatcagaaggaactagactgcatcctcttcctgtctcttcccttggagtagcatttagcttttcattgcggacctgttgttaaaggaagataaactttaccctataccagccattttctccttttatcaagaaaaatcaatttgtatggttcttaaatgtatttccctagtatatattcaaattaaacttgcagttagatttatatcagtgtttactccaaatagtcaaaatatctacaggctaaaaacagttcctatttcgagcattaaaatagcataagccttagtcacttgttcagctctttgattctcataactatttctaaccgtggtagagataagaatccaacaaaacaaaactctttgcaacaacatttaagttttgctatatacatatttgtatttacgtgtacatacacatatatatttttaaatagtgtatgtcgctgtggttgacttttaaaactcttaaagggataaaaggaaacattcaagaaatactggcttaattatactaactttaaaaattttggttggataacagcctgttttctcaaatcagtgactttcgaagcattgttttttactcttcaaattcattcatattcatttactattcagtatgctgaacttgttactggctcaaaggtactagactttcttacctctagactttgcacatgctgattgtttttgctggaacacttttaccttcctctttgtgtgatattcataaaccttaagcctttaattgaaaggcatatctttagagagctctcttcatccctgctacatgcttttatggcaccctgtgctactcttttcatatttatccagtttattgtaaatacttatttaattgcctgcttctacctctaaaatacagctccctgagtgaaaaccatgtctctgttgattgctattatatcctcagcacctggcacatagtagatgcttgatatttttgaatggaagaatgagacacacacaggtatcctcattattcatatatttcatattgtgaatttgccctctcactaaagttactttgtaccccccaaatcaatccttgcagcattttcatgatcatttgtgggcatgtgcagactcgtgaaaaatttcaacagcctgacatgcacattgccaacagaagttgaaaaaggcaacactctgccttcttatgtcagttctcatactataaagaggtttcctttttgcagtatatttagtggcatgttttttgcatttttgtgctttctgttggtgatcatgccatttaaaatggccccaagcaaagtgctgatgtgctaagtgttcctaaggcacatcatagccttatggagaaaatgtgtgataggtaaacttaattcaggcataagttacagtgctgttggctgtgagttcaatgttagtgaatctacaacctatagtaaataaaatgtctttaaacaaacataaagcaagattatgtattggctaattgactaaaatgtgactaaaggctcacaggaacttaactctgtatttcctttgggagcaatagttcaatatttgctaactcattgttcacaataacttcataggacataactaccacagatagtaagagttgattatgtgtgcaattataaaattgtgctcaaatatatatataatgttttataacttggttttttccctacataactgtgtcatgcttctgttaaaaataatgtgtctttatctcataatatagattatattactaagcaagaaaaaaacttaaatgtttgttagcatggagacagctgtggctaatagacatcaggttaccttgattccctaatatattggttacctgaaattggttattgaggggatgagtatttttttttcttagtttatattatctcactggttacagtgaacatatatttcttttacagatattcttaaaaaacatgatttttaatagttgcattacatttccttatgtgaaaggaataaaattttgattaattatcaccttaaattcttatgtttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaaggtaaatgttaaccaagtcttacagaattacaattcagattgtttttttcttgatcaaatgtaatatatttgtggtttataggatttattattttaagttgattattttatatatataagtgagaaaaaataaaaatgtttacatatgtagttggaatttagagtgacttaaagttttaaagaaaagcaaaaattgaaaagcaaggtataagctgctacttaatacagagcatttcagcagatgtgagctttgttaaatgcagtttagattatgactctatcctacctgaaacttgtcagtggctttccattgccatttacattaatttagacttaatttggtagggtcgggagagatatggcagcattaatagagttattaatacagataatgttaacatagcttatagttcaaaggatatttttacaaacgggttttagagtagttatagccttgatataattttaccagaatatagttattgaaattaagttaaatatgatttatattggcttactacatattttctataacctgtcacttctatttggatctttctagaaattacatcaggagagaatgatattatcaacccacagaaatgcctttaagaaaataatggagaagcaaaacatagagtatgaggcactaaaaacacaattgcaagaaaatgagacacattctcaggtaaaaaatgttttaaatgactttgaaattgtcttagtctatattttcaccccaaaacaatcaattttttattttaaaatttgctttatataccttctagattttctgacttttaagacagccagattctgtacagtcttcattcagaatgaatggactcctgctttcttaccttccataaacctatattgaaagccaactctgttagatactgtcttgggcacaactgttaagatatatggggtagtatattttaaaaattttggaagtgaaacattactaatacagaaactaaaaatccataaaatcacaaataaaataaattctaatgattagtaccccaccacccagaagagagaatgcttattgttgctttagtgtgggttcttttagtcaatggatagatagatagatagatagatagatagatagatagatagatagatatgtgtatacacatatttatgcatatacttaggtacacatttatttctatgcatttatagaaattgtgccatattgtacatatcatttaggagcttgtttttcatgattaactatacatcataagtactttcccttgtcaatatatatattgacttttaaaaaatattaatagcttaatgatattctagtgcatggatgtcgcataatatattgaaccaattccctttcgttggatatttaggtaatttctagttttaaaaccattgaaataatgctataaagagcaatccaggtatccttgaacttcttaattcatatctccaattatttacataggatgcgtagatatatatacctgcagcccccttttcatatcactcatcttgctgataattacttgaacagtgtgtgaggtctagattgagagctctgacgggacagagacaatgtctgtctcgtttactttattccttgccctgtggtattggttggcacatagtaggtactcagcaattatttgttgaatgattgaatgaagcattatgtgtcatgtacaaagtcaataactacggtctgaaaaaaattgatcattcttatatctaattagtctatattagaaatttgcacacatggtttaaaaccctaaatgcattaaaaattccctcttttggccaggcacggtggttcacgcctgtaatcccagcactttgggaggctgaggtgggcggatcacgaggtcaggagatcaagaccatcctggctaacaacggtgaaaccccgtctctactaaaaatacaaaaaattagccaggagtggtggcgggtgcctgtagtcccagctactcgggaggctgaggcaggagaatggcttgaacctgagaggcggagcttgcagtaagctgagatcgcgccactgcactccagcctgggtgacagagcgagactctgtctcaaaaaaaaaacaaaactctctttttcttcatatggttatgtgatcatgatagagcaaaataaaaatgatgtcatttgattttccactacataggtacaaccgttgttaacattttggtgccatatccttgtagtattttcatcctttgcaatcatacatccatattgtttttacaaaaaataaaaccatgctattcatacagtctttcaacattttcttaacttttttcagccttctttttttttttttcaaacagagtctcactgtgttgcccagggtagagtgtagtgacataattgtagctcactgcaacctggagctcctggactcaaccgatcctcctgcctcagccactgagtagctaggactacaggcacagaccaccatgctcagccaatttttattattttttatagagacagggtcttgctgtattgccctggctagtcttgaactcctggcctcaaactgtcctcctgcctcagcctcccaaagtgctgggatcacaggcatgagccactgtgcttagccttttttttctttttgagacgaagttttgctcttgtcacccaggctggagtgcagtggtgtgatcttggcttactgcaacctccacctcctgggttcaagcaattctcctgcctcagcctcccaagtagctgggattgtaggcgccagccaccacgcctgtctaatttttttgtgtttttagtagagacagggtttcaccttgttggccaggctggtctcgaactcctgaccttaggtcatccacctgcctcggcctcccaaagtgctgggattgcaggtgtgagccaccacactcggcctttggtgacatttctatagcattagctatttcattgtatggatgtaccatttgaaaacaacatacaccttacattctttttgaaaagggtagaatctcatgaaagcttgctacaactactaaaagcttagaaatcactaatttacataattcaaatttaccagttattctgttctacttcatatggaaacctagatatagacttataattgacacaattttcttaggttgtttagagtgaggatgagtgctggggaagaaacaagacaaagtttgggaggtcattgtcttcagcaattcttggaaaaaaatactgatacttcttatggaatattagccctcctcattcactgaatagatgatttaaggtggaaagcacttgaaaaacaccatttcttagagccagtgagtggttaacttgtttatccccacattaattgctaattttaactccatgtattgataactggaaatcataacataagccacaatttcgaatccttctctgtgttatttgtcatcttttgtgaatcccaactgattaagtcaaatcctggtcttcctatctttcacaattatcttcttgaaaactggcttttggcatctctaaagaattttatgtaacagattatttaaactagttagggaaaaacagattttcaaaatgaatttttgcttcatgatgtccttggaggtttaaaggagtcaataatatagaggtataatgtaaaaggaatttgaccatctgacacagcattgcttttataccattcctgtagcacttaacaggtctgatgcattataagaaggccacctgtttgtatgaaacaatgacaaaaaagtctggtacttgactttgctgaaggttattagaaatttactgccagaaactgctgactgcttccttaagtccatcttaacttcaaggtcctgtctgggggagattgatgtgattagtaataccagctcacagcacatacagttcacataattaattagctatgattcattctaatatctagatttatctctttggaggaaacaatgagatggatctacatcaagcctgaatttacgccctgaaaattattttaacatgaggatagaaacatttccactgttgcttcaattattgtatttttaaaaataatcattacttctttgaaatgtccaggtggaacataattttagcatttcaattttcaaatggtcctttgctttggaaaaaactatgtgcatcttaaaaaagaaagaccataaccagagttacaaggttaattaaatcagaaaaacaatataattctataacagtaaaattgtcttctgaggaagcaaccatcaatataatatccacattagcttcctgttgatgcagaaattattgtaacagtgccagctttttaccagctctcttataatcttcacactgcagctctgctcttatcacagcttgtggaattacacaggaaatttagccctggaaataaggaagtttctcctatatggctgaacctttgacagtgtttgaatatgtattatatttgtggcattagacttccagattttaagaagagattcccatcatgtcccatttttcttttaaaagtttttttagggaaaggaaaatcataaattgtctttcagttggcatgttcattggtataataaacatttaaaatataattaaaataaatatatagagtaaaacatgttataggattcatcactgtattaatatatttactattatttaatctttttttttctaccgtggctttatctcaataaaatgtaagttgataagatttaaagttggagagattttttttgtcttatcctcttagaaaggcatttaattgttttaaatatgggtcctaattaatatttttcttttatgtttttagcttacaaatttggagagaaagtggcaacaccttgagcaaaataattttgcgatgaaagaatgtatcctttaaaaagctgaaaatggggccgggtgcggtggctcatgcctatagtcccaacactttgggaggccgaggcaggtgggccacaaggtcaggagattgagaccaccctggctaacacggtgaaaccccatctctactaaaaaatacaaaaaaaacatagccgggcgtggtggcgggtgcctgcaatcccacctacttgggaggctgaggcaggagaatggcgtgaaaccgggaggtggagctctcagtgagccgagatggcaccactgcactccagcctgggcgacagagcaagactccatctcaaaaaaaaaaaaaaaaaaaaaaaaaaaaaagctgaaaatgaaattgactgagttatttttttctaggaatttttttaaagactcaaatttagttcaacacctacttattaaataccagatatgtacaaaaccctgggccaaattaaatgaatatgactgtttcaattctacagtagttaagaggtgtgtgtgtgtgtgtgtgtgtgtgcgcacgcacgtgccctcaagtaactaatagaaagcagattttgggagttgccaaaaaaggagtacaaagacttaatgtggcatagtgattaagtgcccagattttggagttgggcgatccaattttaaatgtcaactctactgcttgtaagttacaaactggacaatttaatctgttcaagctagaactgtatcatctcttaagattcagttttccgggatcacagggcttgggtaaagttaaacattatcagtaaatcttctgataaacatggcaagaatttctcttttgtttagagacaggggtctcgccaacttagccaggctggtctcaaactcctaggctcaatcccacctcggcctgctcaagtgctgggattagagacatgagccactgctctcggccccagaattgtatcatctctaaaatctctaaaatatagttaatattaccttctcatagtgttgggagaattatatataaccatatagttatatatatccacaagtatatatatatatatatatgtacataatatataatatatagttgtttgttgtttatatggttctaccttgaatatctgggcagcaaagggaggtaaactaagtaagatcctgagaagtttgacttccaagctcatccatgttttagccatttcaactccattatatgtctacaaagatgatacttatgtctcatcttattgtttacttttagtttgattacaggaggcagcaagcagctgttgagaacatgtgttgtgaagttgtaacagatatttccttaaaagttgtttcctattcccttctttgacccattcaaggatgtctctgcctggagaactagatcctgactcagtggcagcataggttctcccccagggtggtgctgaacttcagctcagaagcagcctggaccccatcttacctccagataaggtgttttaggtactctgttgccagtgttagtgcaacttagtttaaaaatagaggacttgttcacagtatgctctaagtctcacactggagttttgtgcaacataaagtaggtgattttggagcagagcgaagtctagaaatttgccttaaattatttgtggtactctagagaacgtggtatgtgtatgtgtgtatgtgtgtttgaatataggaactagttcattgaacgttagattgttctaagaccagaattagattaaaaatgcataacatattaagtattaaaaagtgtttatattgtatatgaattttttgcggtaagtttagcttggcattttaggttttaattgatgcttaatctgttaaaatgatgtactgtattttaaagtattctaattgtgcttttttgtaccatcttcagtatgaaaaatgtcagtatttagttcctttctcaggcacaattagatttttattgacattgttttcccccttaactcatgtaattagtcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaagta

SEQ ID NO: 1876 - DNA, 115623 bp, Homo sapiens
cgacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtggtaaatcgggaagcgggccgggactacaattcccataatgccgcgccagctggcgtggacatccggcgcgccgaatccggatattttaaacctgagtctttcgcgctgggcatggcggaatggctgagtgaggttgtttggtgtctactgttaggtcatcctcactgcttttccctgagaatctcgaggtttttgcaagttaaccttgtttttcaattaaaacgagaaagcttgaggccaaattgggaactattaatcattgaactattcctccgtttcaagttatctgaatctcctactctctgttgtcaaatttagcaaatacggtggtccaagtcaattttttaaaggtataactacttttctctggcggcttgttaaaatgtagattctgattcagtaggtctgagttagagctgagatacgtatttttaacaaccccgccgcccacccacccgtggtgctacttgctagtcattatcagaccttattgagtgccagggtaaacatgacctgtctccttactttgttttcttcccatccgctattctctcgcatccaactacacttttccacaaacctttctaaattgctaagcccaattcacacttttctgacttctcccttcctaaaactcctactctaggtttggaatcacttttcccctggtttgggagatcattcttgaaatgctgacttttgatacttctttgctatcatatcccctccctgggtggattatttactacttggcttatttctagagctgtattcccatattgtcttctccaaactctagatctgtatttctagctatctgttagaaatctgtaccaattagtcctacttaaattatttcaacatttctctggcctttctaccccttctctccagccaatcctacacattaaaatataattatctttctgaaatatacacttaattgttttttctctgtttgacaacctgtgatggctttccattattttttttttttttttttttttttttttttttttttttttgagacggagtgtcgctctgctgccaggctgagtgcagtggcgcgatctcggctcactgcaaccctcgcctcccgggttcaagcgattcctgcctcagcctcccgagtagctgggactacaggagcgcgccaccatgcccagctaaattttgtgtttttagtagaaacgagtttcaccatgttggccaggatagtctcaatctcttgacctcataatctgccctcctctgccttccaaagtgctggattataagcgtgagccaccacgcctggccggctttccattcttatagtacagcattacatagggcctttcacacaatctccctaatctgttttactagattcatctccctctgttatctctcttactctagacatttcgaatttgtcacaattccctgaacacattatgctgtatgctctccatgtctctatgctctttgtacatgcattttttttttaaacttagaattccactttctccatctgtcatagttcaacaccagtttatcttctgtttttttctagttcctctggggaaccaatgcagttttgtctgttgtcaatatagtatttactgcattctaatatgttcttttatgtctgtcttttctaccggactacattttattattatcaagacctttattttacatgaatcttaaccatctaatttactgcctcctatataataggaaatgtttttcaacttggtatagtattcagtttaccaattttcacagtctctcatttagttctcacaataaccctgcaaggtagatagtattattcccatttcacacatgaagaatttgccttgtttaaaaaatgttaatttggaggccattaggttgagatagttccagctctggagcccaactcaatgtaaacagtaaaatgaaacttaagcttaactaacagaaacagacaaacctctaactaaggactttccactttaaccaatcaagtaagtatattttcttagtcttgcttccaccaaccccttataaaagttttcccctcgtgctgtaattgcccctgtgttcttttacacagggaaatgtgtaatttcacatttccctgtgtaattgcctgctgccttccaaaaaaccaatgcactgagaactacaaatgttgcagcagggaaagatgaataatcacagggccagccaacgaggaggatgggagatatttctcaaatccacctccaagaatgtagagactaggtttttaaaggatcggttggtgggcaggaggctaggaaatgggaaatgctaattggttgggtcagggatgaatcacaggtgtgtcagaactatcttcgtgaacctgagtcatttctgaggagtggggttcacaggtccaggttgtgtctgttggtctgccaaaatgctaaatttgaaaaatatctcaaagaccagttaattaggtttcacaatagtgatgttatctgtaggagtacttggcgaagttacaaatcttgtgacctctggttacgtgactccagggcaggaggctctatagaaaagcaagctaattaggctgggtgaggtggctcacgcctgtaatcccagcactttgggaggccaaggcaggtggatcacaaggtcaggagatcgagaccatcctggctaacatggtgaaaccttgtctctactaaaaatacaaaaagttagccgggtgtggtggcacgcgcctgtagtcccagctactcaggaggctgaggcaggagaatcacttgaacccgggagggggaggttgcagtgagctgagattgcgccactgcactccagcctggcaacagagcgagactctgtctcaaaaaaaaaaaaagaaagaaagaaaagcaagctaatcaaacaatgccaagttattgtttgagcatgtctattctttagcaaagttcaagcctctaccataattctaatcttgtcttatgaatgtagcttcaatctccatacaaggagttggggtggggggtcacttttccttgcctcaaagtttaactataaaccaaattcctggcatagttattttagcctccacactagaataagcaaaaaacaaactaacaataaaacgacaacaacaaaaaactagtttagcctgtgaggttttgagcaaaatggagtcagtcatgttagatttctctcattagttataattctgcaaaggtagtttaagtgcccctagatggagtttcaccacttgtggtttggtgctgcccaattcatgaatcactgtctgctcaactgaactgtttaatactttaatgtgtgttgtcttttaacagcttgataggaggttaatgctcagtagatgttattggttaccttaatgaattaatgaataactgaaataactattttaatgtcacataactagaacatagtgcagctgggactaaaattctatgaacactaaattgggttcttgatactttaaaaataattttaatgtttttatgtgttcagcagttcaaaggtttaaaacaaatcatttatgtcaactgtctgtctgcatacaaataacaattctggatccccctcccatatgcctgaaggcatgaaggaaaaatgtccgtaatgacagtagttctctcagagaaaatgcatggaatagttgggtagctggactaaacatcacagtttgtgtaaattgaggtaaacatcacagtttatgttctcaatatgatgttttcattaaaatttaattttaaaagccctcaatgcactgagaacagcattaatgcagattatacaggaatgaagttggggtcaatatggttcagggctggcaacttagtaggaaaacccaggcaaactaaagaaaggaattgtaacagggatggtatttggcttgtgtgtgaaagtgatggtgacagaatattgtttagcattttttttttaactaaaattcgccacatagactctggtgccaaaactttgggctggtatagcacaatacatacatgaaataaaatattaaaatgcattggaaaatgatagaaattttacatgtacagatcttagaaaattgaggctacaaatatgtcccccataaggggaatgttgaaaaaacaaagtccatatatataagaaaaaaacccataaaatgtgaaatatgggctgggcgcaatggctcacgcctgtaatactaccactttgggagactgaggcaggtagattgcctgaactcaggagttcacaaccaccctgggcaacacagtgaaaccccgtctctactaaaatacaaaaaattagccgggtgtggtggtatgcgcctgtagtcccagctactcgggagcctgaggcaaagaatcacttgaacctgggaggcagaggttgcagtgagccgagatagctccactccactccagcctgggtgaaacagcaagactctctcaaaaaaaaacaagtgaaatatgaacttcatctttaaggatggttatcagcttctaaatcacattcgtcttgccagtactgtggaacatgacagaaaatgtttcaaagctaatacatttcaatttcccaaaagataattgttttcaagcttttggtgcccaaagaggagaaaaacattcttctagtgccaatacatttagtaagcgtttttcttggcttttagtgagtttttttgttaaacatttaaggacactttttcctttgttttcatatgctttgaaatattatctagataattgcataattcattaaaagctggctaatgtgaatattcattatgatttttatcgtcccctcattgaaagtttatttaattttttttaaccttttttttttttttgagacgaagtcttactcttgtccccaagctggagtgcaatggcgcgatcttggctcactgcagcctctgcctctagggttcaagcaattctcctgcttcagcctcccgagtagctgggattacaggcgtctgtcaccatgcccggctaatttttgtatgtttagtagagacggggtttcaccatgttggccaggctggtctcgaactcttgacctcaggtgatccgcctgcctaggcctcccaaagtgctgggattacaggcgtgagccactgtgccttgccgaaagtttatttttaaaaagtaataataatgcattccttggtttaaaattcaaaagacgtaaaggatgcacattttcaaaccctaaccacccagttttcctctctggaggcttatcagtttcttgtgttcttcccaaagattgtttatacagatgcaagaaaatgttaacattgaatacttactcaccttactttatatatcttggaaaactctccatattgtatgggaagaagaaagcttttcctctaccctgtcatgttcactattcaagggcctatgagttaaactgaaaaaagacagactaacaggagaaaaatatcaatttcttatgcataaaacagccaacaaaagcagcagctgactagtcaaatgattaaagttaaaggcttatataactaacttagtagggaaaatggtgggggagaaacagcttttacagggaaaaaaatagaaacattgacttttaggagaacaaataagaaagtttgtgttcacgttcatctatacagttaggagtggtgttcttccgggccataagttagggtatttatggtagcatcattccccagaaattttgctttcagtgagataaggaactctctgagaaggtttttttcccccttcatcaaatgccttcaggttaaaataatatttttatactagctctggggttcctagtcagcctctgcaatatcagtatacaaggagcattcttttttatagatggccaaattttatgtgattttatgactatagcattattaattcagtgttgtttgatttttttcctaatctttctctgtaacaaacactgctcaaataaataaccttggacatcagcatatgtcatttatatgtataaattcagtgtgaatatatgctcacttcctagaagtggagttactgggtcaaaggacatgtgcatttggatttctatagccatcttctttcaatagacactcctaccagtgtatccaaaaatcttatttcagttgatgtacatattcactagtaagttcactaacttttctctattttacagtagaataccttaatgatgtcactcctcaaagtgtcttttcttttttaagattcatttttgttttcattttttgtagggggggggtctcactatgttgcccaggccagtcttgaactcctggccttagtgaccctcctgccttggcctcccaaaatgttgggattagaggcatgagccaccacacctggccaaaaaatttattttcttaaaaaacctacaaacatcctacaaagacatttttgagttattttgttaacatttttcttctgtgcaccctgggctacataagcgtaactggccatattcagtaccaagtggtatcctcttcattgggccttattgcccttgactctactgagtacccacttgctcccttccctactccctcattctccctttaaaacatccaatcactgctgtacaaatcaaggttgaattcctttcacattggactattttccctattgcagtagtaaattatggataaaaatgtgtccctactgtcagggtttgttatctttgacaacaaaaataaacatataactgcaagttataatgagtgatatgtagtgttaaaataattaaattggaggccattagactgaagtcgctctaatgcactgagttcctacatgaggaaactgaaacttaaaacggaatcacaagtggccaactagtcatcagttatatcgtcttgaacttcccacaagaacagtccaaataaggcaactgctcaaactttaaccagtcaaataatttctttgctgtgctctgcatttactctctgaaagctttcaactacctctgggggagccccaaaccacttatgatttggagctgcctaattcatgaattgctgtctgttcaaataagctctttaaaattttaatgtgccaaagtttaccttttaacagataggaatagtacagggtgcactgaggacatataatgaggtggggggccagaaggagttggagcactaatctagtatggactggcagagaagacctctctaataaaagacatttgggttaagacctgaatgatgaacaggactttggacagtgaaaagcagagggacaaagattccaggaagagagaattgcagtgaaaaggactagagacagaaaggaacttgaaacacaagtagtcttacaataaacttaaaatttgacataacctaattactaaccaaattacaacttgatataacctaattccaatttgatataaccttaaaagcaacagaacctaatacataatgatccaaagtcaaataagatatggtgcctactctaaggaagctcagaggcaaataagtgagatgtattcctattctctattcctttttcatcatgaaaaagaaatggggacagggatcaatacttactacctaaatgagcttaagcaaattatttaatctctttaaaacttggataatagtatctgtcctgccaatttcaactgttaatatctgtcagggtccttaagtgcaaggaacagaaatcatctataaatgatataaaagctgaaaatgaatttattaaaggacattaagcagctcacagactctcccagaagctgaagaaacaagctagaggttctcctcccaataaagcctctgagtacctaacactgcagcttgcaacaacacactgatgctggacactggttgctggtgatagaacattgcagtctcggaaacgatgtagttactgcggctgtcacccttacttcaacagactctctgaagtcctgcttctggttgtcattcaagtttgagttgagtccaccaaattagattggagagtctagcaagcaataatactcatgtcccagtaataaggaagactaggaaagccagtatctgtcactttcagttcctgtaagggtgttggggggcagggtaagggagaaactctgccaaaaggatgacaaatggccactgcaaatagggtgagctcaaatgagataattacatgaaaatgtttcacaaactaagggagaattcagccacataacattatctcattttgtgttgtattgatttttaactcctcgaaggcaggcaagttggaaataatgtgtaaaataatgttaaaatcccaatacatatgcaatcacatttaagctgttatcaatgaagattggaaggaaacatacagtaaaagttattttattagagaagtgggatttaaggtgaagtagttcttaaattaaaaaaaaaaaaaaaaaggacactttccattgaattcacagtcttccccacaaacttggatccaaattctaatgaaaggaagcttaaagacgcaaagcttctggtgaaagcaggaacggaacagttggtgccagaatcgcatccatacttcatgatgcgttgtgtacgctatgccgtcctaataggaaggaaaactaccacaaattaggagtttagaaaattgcacaatgctgcctaccacttaacttcaaatgtaacctgttaacaacgttagccgacgtgaggttacctagggacatagcaaaactcgctagagttacttcaagtaaggcacacggaggttgctctgattatcaagaaaaccaaacgttcacataaaatgtttgtcttccagccgccccgctgttttccactttttccaaaaagcactgaagcgtggtgaagaaacaaacatatcctcaattctcgcgagagctccgtgtgtaaccaagggctgaggcggaggattggtcactcaggatgaggagcctccgctatcccgcccccgttgccgggatacgccgcggcgcacggcagttagtgggtaggcctgagagccgaggaaaactgagcgtgggcctcagaaagaagttaaggcacccgcgagccgggcaactgccctccttccgcgccggcggaggtgagaatccccgggtcccatctcttcctccctccctcccacgtctgttctcttgccttggagatgctgatccgctccaaacaaaacaaattcaaactcggtcttagctaactgttaccgtcgggcctgtagccaggccaggcatgtaccaattctagtcgagcgaaggttgcgaacagacctcctccaacagcccgacccctccccgaccccccgcaggagacccgccaagcacagagcagagggaaggaccgcgatgggctgaaggattttagtcaaagcaatacatttctgcctcttacagtggaagggacttatttctgtctgttgatcacagtgcgggcagttagcaactttccacttattcacctgtgtgagaatggttggcttagggaggataacgatagtaataataattagaagcagatgttttaaatgtaatacttatcgtcttcacaacagccctgcaaggtagatgtcacccttctgttttacagaagatgaaatcctgaggggttaattaaggtggcaagattatgcagccgctaactttgtcagcactagtttgtatcgctaatcattctggatccaaaggccaggctgcctctctgtgtgaataattggaaattgtgtgactctttgattgaataaccccgaagttagtggtatatttgttgctaatgcccgcctcttaatcccactggtaataatataatggtaagctttttttcaccacagtaaaacggtggcaaagaaaattgggtgaaattttttatgttgtacattttctcaaagttagcaggaaacctagagtaatatcttttccactggaaagagatgtttattgtactcgttttcttctggaaaaaccattttgatcatacaccgtcttccttttcaaagagtcatttcatgaaattcctttttccatttgaaattcttttgctttgtacatagagttcaaaatggcaaggaattagaatcagggagctagtggggtcaggaagattgatgtgaacatattcaaatgagatatctgaatggaaatttcagataaacaattgaaaactcaaaattggtgcccagttgaaagggcagaactgtagacattgattagtgagccgtacacatagttggagttataaagatgcatgactgtagaaaggatagaagcagtccaaggactgattacgagtaatgctaagaaaagtcagaaaagtagtactggacatagagtgtagaaacagagaaatcattttagtccaacacacgctttgtttgccttttttttttttgagacggagtcttgctcagtcgcccaggctggagtgcagtggcgcgatctcggctcactgcaagctccgcctcctgggactacgcccgccaccacgcccggataattttttttttgtatttttagtagagatagggtttcactatgttagccaggatggtctccatctcctgatctcgtgatccacccgcctcggcctcccaaagttctgggattacaggcgtgagccaccgctcccggtcgctttgtttgctttttaacaatttagtaaatttttgtaattggcaatacctttatgtacgaggaaatttaaaagatacaagagagaacaaagtttttgcttatcactgagacagattttggggatataaagatgattaagattcagctcttgccataaagggtgagaaatacttaagcagatcatttcaagtggtgtgataggttctggaataaagtaatacacaggatgcatggtagcatgtagaacaggcctatacactgaaattgaagaagacgaagattccaagaccagttatggactggtcatggaaggattcccagagaaagtaataggcaaaatgtgtgttaggcaaggggaccacttaagaggctggtataatagtccacctgagtcagtgatgccctgaattggccagtgctgtaggaatagagagtaaagtacctgttaaacacttaggaacaaaatcagtagaactaaacaaaacaaactcagtagaactatgtgaccagccatgggagtaagggagaggaagatgtcaaggactaaatttcttacttgtgtgactaggaggtgacaccaagaggaaggacaaattttgagcagatgataatgagtttggattacatatgtttattttgaaatatttagacatctaagtggagatgttattatttggatataaacaccgcaagctgagtgctaaaataaggaagttgtgtggaatcagtttattaattgttaaaaccctgagtgtggataagggggcccaaggggagtttagagagagaaaagaaaaagatggtggatggtatcttagaaaatgctctatataaggacagatcaaggagacagaaaaaagaaccagaagagagggaagtgtcatggagatgtttcatataaatgtggacaccagtaaagtaggatgacatttacagcactggcaatattggcaggggtcatttgaatcaaacggtagcaatccaggagatactgggaaatgaagcagtagaaaatagtggatataagctattctttttgttgttgttgttgttgttgttgttgttgttgttttgagacggagtctcgctctgtcgcccaggctggagtgcagtggcacgatctcagctcactgcaagctctgccttccgggttcacgccattctcctgcctcagcctcccgattggctgggactacagacactcgccaccacacccggctaattttttgtattttttagtagagacagggtttcaccgtgttagccaggatggtctcgatctcctgacttcgtgatccgcccgcctcggcctcccaaagtgctgggattgcaggcatgagccaccgcgcccggctggatataagctattcttaggaatttggctgcataagggaaggatgtatgggacagttagatagaggtggttgcaggatcaagaaataagtttttgaaggtaggaaagaattgaacatggtaacagactgaaggaaaggagaaagtttaaagataattggtagcagtgaggttaatgccacaaaaaagatgggatcaagggtaaatcagagtaagattgatcttgaatgagagaaggaatggctgttgagactggagggcaggatggatgtagagaagtttatgtgccccaaaggtgatggagttcaagttgtaatttttttaaatgagtcatctgctgagagtggcaggaacagaggttaaatagaaaagtagttaagggtgagaatcatcaagtagagaagtatcttaacaaggataaatcatttctgaaatgagggtccagctaagatttgtgactatcactttgcagtaccccagtctgtacagttgtatgatttccatcagcaatgttcagcacttcagattggatgtagagaagggtttctgattttgccagatgggctggagaatagttcaaggatacaaattagttgatagtgctcatgagacactaatttcttgagagaaggaggagagttcttaaacacccttgtcaaggtatcactagtgacttcttgaatggggactccattggacatttcagttttcatcttacttgaatttccaacgtaaatggcatggctcagattcctgccttctcttggcgtctctgacacacactcctggtttttttctttgctttctgggccttaattttcagtctctcatactagattttcctcttgtgtgtaatctgtatgtattgatgttcctcaggacagaatcttgggcactattctctttttctccatattctttgtctagataagtatcttcataactattttatatgacctacaataggacatacatttttatattgtagcccagtaaacacatatgtgtaaatttatgtaaatatagctgaaacaaaaatttactgaaacaatgtttacccttcatattttcagtgagctctttttgtttaaattttatttcacgtttaagtatcttggtcataacctacaaaattgttttcagaacttactaacggatgtgaccaacaatttgaaaactactactctaaattatgagacagaattttaaataatgttatattctgatgaataaaggagagggctgataaactgggagagaatgagtgaattaaggaaatggtttaaaggcaggtgtagcagaatgaagatgagaaaagggtaggagaggagaagaccagagaatagagtatttcaattaagatgtttgaggtgaagcaattccagatgatgacaagctccatgtctcgccatggctataaattactgaaatggagttaagatcattgctaaagttgaggtcagggaactgtgaagctggagtgttaggtattggatctagtatctagatggaagtcatccagggtgatggtgagattggaatagagaagctgtgaactaggtacaaaagactttagtaaagatagaggagagattaggaagtcactaattaccagcaaccaggaaagatcaaggcaatattgttgcattcccagatcctcagaagaagtgaatcttgttttttttttttttttttgggtggggggatggagtctcgctgtgtcgcccaggctggagtgcagtagcgcaatctcggctcactgcaaactctgcttcccaggttcatgccgttctcctgcctcggcctcctgagtagctggtactacaggcacccgccaccacgcccagctaattttttgtatttttagtagagacggggtttccctgtgttagccaggatggtctccatctgctgacctcatgatccacctgccttggcctcccaaagtgctggggttacacgcgtttgccactgcgcctggcctcttgttaatttttttaaaggtgtggaagaatgttttgaaagtgaccctgaggagcaagaaaagtgccacctccttttctttaaaattgtgggacaggaagctaaaacacttggactaccgaaagtgttactctcaggggaaatcaagattctgttaaagttaagaaaatagaaagtatttgtaacaagattcagaatataagagttaatcatggaccagaaagtgcagagaaaggattaggggcaaagaaagatgttggctatgatgggagagaaaatttaccagagtatgggatgagaatactaaagaaatagataatagaggggcttgcattttggtaagataatagaaagatgaggaaggaatgttgcaagaaacaatctcatagttgtaaatggagcacgatgtcatatttgaacaaaattagccttgtagtggtacacagaacggcagtttgcaagaacaattgttgtgaattaaatgtaagggtatgatgggtcattattgtcttgctagagaagacatcaaaggattgaactatttattgtttccaaacagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcagtaagtttgaaacaaatctatttactttgggaggccaaggtgggaggaccacttgagtccaggagactggggcttcagtgaactctgatcatgccactgcaccccagtttttgagtttttgagactgtctcaaaaatctgttgaatgcttgtgcatatattgtggtagaagttggaaatcccctctgtaataagagattctactttgttgtttctttatttcataagcatattattaaacatgtttgttttgttttttggaaagcatctggaaatgtaaatgtggaagagtgtttgaaagacactctgggaagaagatgcctgctcctgcagatactcaatttaaagctgcaataattttagttgaatagtgtattggggccagaataaaatgaaatggaatagacctcaaatagaatcaagcatataagaatttagttaatgattaatgtgtgtttcaaattagttggcaaaacatggagcattcaatagaacattccaataattgttaaaccatttgtttaaaagtatttttaatcctctcttataccttttatcagaattctacatagcttagaaacttggtatttcaaaaatgaaaccataaatgtagtagaggaaaatgttggcaagtattctgtataaacttgatatgggctaggctttctaaacatgacagaaataacaagtactgaaaaggaaaatatttttattatatatctgaatttacaaaaaataaaacaccataaaaaattagaaatgacaactggtaaaaacatttataatatatataccatatataggatcagaatcttaaaattaaaaggtaaactttactaatttttttttttttctttttttcttttttttatttttatttttttgttatactttaagttttagggtacatgtgcacattgtgcaggttagttacatatgtatacatgtgccatgctggtgtgctgcacccactaactcgtcatctagcattaggtgtatctcccgatgctatccctcctctctccccgcaccccacaacagtccccagagtgtgatattccccttcctgtgtccatgtgatctcattgttcaattcccacctatgagtgagaatatgcggtgtttggttttttgttcttgcggtagtttactgagaatgatgatttccaatttcatccatgtccctacaaaggacatgaactcatcattttttatgattgcatggtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgacttgcatttctctgatggccagtgatgatgagcattgtttcatgtgttttttggctgcataaatgtcttcttttgggaagtgtcggttgatgtctttcgcccactttttgatggggttgtttgtttttttcttgtaaatttgttggagttcattgtagatagattctggatattagccctttgtcagatgagtaggttgcgaaaatgttctcccattttgtaggttgcgtgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtaccagtaccatgctgttttggttactgtagccttgtagtatagtttgaagtcaggtagtgtgatgcctccagctttgttcttttggcttagtattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccgtgagcatggaatgttcttccatttgttgtaaactttactaatttttaagtgctctttctgtattaagaccacaagccttatgtccaatcaaaatttcatgacatttcttttgatgctaggggtaatattataaaactattctaaaactcatctagaacaataccacaaaaataagaaaaagtacagtactctaatgtaaaatatgttatagacaatgagtgaaacaatattctgattgccacggcacctggaggtaaactctagtaaatgttaaagagcttaatataagagagtgtgtcataaatagtgaataagagaaacacatcatatgaggaaaagttagatgaagtttatgagttgatattctaagcagaaggatatcctgtaaagataattattacattttcgttatcattataatgtaaaaattgggaaacaacctagaagacttacaacaggtgaatcttaaataatgatatgtatatccctataaaggctgttagatagtcattacaaactactttcaagatatttcagaaaataatatactttaacaaaagtttaaaagtgatatcaatttaacatagaaaacataaatttataaatacatagaattgaaatggaaataaatgaatagacaaaaatgtccataaatttatctgattttcacacaggtgatttcaactgagaaggtgcagagggccaatactcaacctcctacagtaggctaagtgcaaactacagataatgttgggtcctatggttaactcataagaagagcagcattttttggagggaataattttgttaaagtcagattttcctaaagttttcagattttttttctagagtttcaggtaataatattaggacatcgtcatcaacttagactgaaataatttttctgaagtcttcatacataggatagtaagggtatctttttcttttattccagtaaaaattgataattaaatatttataaaaagaatctgacatttattggccacctactatttgccaggcacgttatctgtttatttgtaaaattttaaaatttgtatgtattcatggggtaggtcagttgtcttacatgcatatattatgtaatgatgaagtgtgggcttttagtgtacccatcacctgaatagtgaacactgtacccaatatgtaatttagcaaccctcaccttcctcccactcatcttttgtaatctttagtgtctgttatctcactctgtatgtccgtatgtacccattgtttagctcccacttataagtgagaacatgcggtatttgactttctctttctgaattgtttcacttaggatcatggcctctggttccaaccatattgctgcaaaagacatgatttctttattatggcagagtagtgtttcatagtatgtgtatatatatatatgtgtatatgtgtgtgtgtatatatatgtatatacatgtataccacattttctttacgtagccctccatctccattgatggacagtcaggtttttttttcatatattcgctattgtggcaagtagtgtgataaacataggaatgcaggtatctttttgaaataatgatttctttccttttgcagtgggattgctggatcatatgatagttctatttttagttttttgaggaacttccatactgttctccatagtagttatactaacttacattccccccaacactgtacaaaggttcccttttctttatatatttgtcagcatttgctattgcctttcttttggataaaagtcgttttaactggagtgagatgatatctcactgtagttttgatttgcatttctctgatgatcagtgatgttgagcaccttttcgtatacctgtttgacgtttgtatatcttcttttgagaagttgtctattcagaccttttgcccgttttttattgtattattagatttttttgctagtgagttgttggagcaccttatatattctgtttattaatttcttgtcagatgaatagttttcatatattttctcctattatgttggttgtcccttcactttgttgattgtttgctgtgcaggtgctttttaacttgatgtgattctatttgttcatttttgctttggtttcctttgcttgtgggatattactcaagaaatctttgcttagaccaatgttctggataatttcccctgtgttttcttttagtagtttcatagtttgaggtcttaagtctttaatccattttgatttgattcttgtatatggtgagagatatgggtctagtttcattcttttgtctatggatatccagttctcccagtaccatttattgaagaaactggcatttcctcagtgtatgttccttgcatctttgtcaaaaatgtgttcactctagatatatggatttatttctgggttctctattctgtttttatgccagtatgcttttctttttcttttccttttttttttaattcaggatgggtttggctatcctagatcttttatggttctatataaattttaggatttttttttctatttttgagaagaatgtcattgatattttgacaaggattgcattgaatttgtagattaatttggatattctggatattttgacaatgttgattcttccaatccatgaacatggaatatctttctattttttgttgttctcttcagttcattgcatcagtgttttatagttttcattgtagagatctttcacttcttgggttaattcctaggtattttattttatttgtagctattgtaaatgggataactttcttgatttttttcatgttgttccctgttagcatatagaaatgctattgatttttgtatcctgcaatttttctgagttttactgaatttactatttatcagttcagatagtttttttggtggagtctttaggtttttccaaatataagatcatatcatctgcaaacagagttaatttgacttcttcctttccagtttggatgccctttatttctttttgttgtctgattgctctagccaggaattccagtactgtgttgaataacagtggtgaaagtgggcatccttgttgtgttctagatcttagaggaaaggctttcagtttttcctcattccataggatactagctgtggatctgtcatatatagcttttattgtatttagatatgttccttctatacctggttttttgaggattttgatcatcaggagatgttaaatgtcatcaaatgcttttacaatatcaacggaaggcttttgtccttcagtctgatggtatgatttatcacattgattgatttgcacatgttgaactatctttagttacctggggtaaataccagtgagtcatgacaaatgatctttttaatgtgttgtttaattcagtttgctggtactttgttgaggatttttgcaccaatgttcatcagggatattggcctatagttttctgttttcttcatatgtcttgtctttttttttttttttttaatcaggataatactggtcttgtagaatgagtttgaaagcattttctcctcttctatttctcagaatagttttagtaggatcagtattagttcttttttaaatgtttggtggaactcagcagtgaagtcatcaggtcctgagcttttctttgctgggagacgttttttaaattaaaaaaaaattttttttttttttgagatgtaatctcgctctgttgcccaggctggagtgcagtgacgcaatctctgctcactacaacctctgcctcccgggttcaagcgattctcctttctcagcctcccaagtagctgggattataggcatgtgctaccacgtctggctaatttttatatttttagtagagactgggtttcaccatgttggtcaggctagtcttgaactcctgacctcgtgatccgcccacctcagcctcccaaagtgttgggattacaggcgtgagccacctcgcccagccgggacactttttattatggcttggatctcgttattgttattggtctgttcaggttttggatttctttatggttcagtctccgttggttgtatgtgtttagtcatttgttcatttcttccagattttccaacttattggcatagagttgctcatagtggcctctaatgatcctttgagtttctgttatcagttgtagtatcttctttttttcatttctgattatatttatttgagtcttccctctttttttcattagttagtctggctaaaagtttgttgattttgtttatcttttcaaaacaccaactttgtgtttcattaatcttttatattttttttgtttcagtttcatttatttctactgtgatctttatgaatttctaatatgaattttgtgtttggtttgctcatgcttatctgattctttcatatgcattattaggttgtttattttgtttttctacttttttaatgtaggcacttacaggtataaactttcctcttagtgctccttttgctgtatcacataggttttggatatgttgtgtttccattgtaatttgtttcaagagttttaaaaaatttcctttttaatctcttcttagacccactggtcattcaggaacatatttctatttgttggtatagtttccaaaattcctcttgttatcaatttgtggttttattccattatggtcagagaagatacatatatatttaggattgttgtatctcttgcttaattgattcctttattattatgtaattatcttcttgtctttttttttaaactgtttttgatttgaagatgtatgtatagctactcctgcttgcttttggtagtgtggaataccttttcccactcttttgtttttagcctatgtgtgtcttttagggcttgatacgtttctcatagtcaggatatagttggattatgttgttgttgtttttttaaaatcttctgctaatatgtatcttttaagtgaatatttcaattcatttacattacattcacagttaataatgatatgtgaagctttgttcctgtcattttgttagttgtttttaagttgtataaattatgtttctttctttttctctgtctttttatctttatgttttgatgaaattctttcatgttggtatttgattattttgtcctcttcctttgtgattgttctataagaactgtgagtttaatatttttatgcgtttttgtgatactgtatatccacctttaatttctatgttgaagacccctttgaacatttactttaggaatggcctagtggtgacacattccctcagcatttgcttgtcctggaaatactttatttctccttcatttatgaatcttatcctgtcagggtataaaattcgtggctgacaatttttttgttttgttttgttttttggttttttccttagcacttcgaaaatgacttcctattctcttttttatttgttgttgttttttttaatttccactgaaaggtctgcttttattctgataggattgtctttgtaggtgactagatacttttctcttattaattttaaaattctttccttcgcattgacttcagacattctgataatatgctgtggtgagggcattgcaaaaatgactttttctttgcagtgacttcacctatttaatatttgcatttttgaaaatagtagtgcttgtagtaaaacatacaaacaatggagaagtatcagagttccttcctattgtaggtataaccactatcaactgtatcttctagactttttaatgtatttataaacacacacacatacatacacagtttgtatgactttggactgttccaaaatcaagatagtactgtatacattgttatttttctcatctatttctttcagcaatatattatgaatatgtggccaagtgaatacatatacatccacttcattatttttaatgtgtacagttttaatttatatgttcttctctatactttgacctggtgaatggaaaacaaaaagtagcataattagttgagtaggtctcacagttatgcttgcataaagccaaagaagaaattattcagaacatttaccaggaagagatataacattgtcttctaaagatcactcgggttaacccttaactcattttatttgaatttgtagttgacagtcttcctgtgtccaacacattctctagaattagtactattcctggcccctatgctcaaaataattcccaagtaattcattaggggataaactgacatcttttcaaggggtggttgtgattcttaacaaggcaatggggagacatttaatccagggtaaccgggtttctaggactgatttggtcagttgactttttagggtttggttcattctttctactcttcctgaagagggtggatgccaagggatatggtattcccattttatgtctagcacctgtgctaactctctaatgacatgtgccatgaaatgggtttcattgtctgaatcaatgttttctattagtctaaacctgggtatgatgttttcaattaatgcctttataactgcattactagcagttgcgcttgagaaggagatagtctctacacagtgagtaaagtgattcactattatcaataaatacttcaggcaaccgatggggggcattttagtgtagttaattttaacactttggaatggtcttagccctggatctcttcccctgaggagtgattttcttagagcttgcttattagttttttttatatattaagcaactctctgtgacctgtttggctagggtgtaaattctgatacacccataaactctgaaaaccacatcgcacatagcttggggtctccagtgggctccttgatgtacttgagacaagacctccctcatgagaggtttggataacatctctctttgatctggtaatatccattttccttctgtgttttctttagctcctatttttattaatttttctttttcagtggaagagaaaatggggactgtggtaggggaaggaaggcaaggagttaagtgaaagacaggtgtttcagaagaaatggcggcttgtttggctatttgatctgcaaggttatttccttgacttgggaaggaaaagtcattttgatgccctgggacatgtacaatagctatctcttctggcagctggagattgtttaagacatggacaattagttctttttggaccaagtcttggcctttactattatgaccattctccgtccagttttttttcaatgtatgagccactccaaaggtgtacttagaatcagtatagatagttccttcttggttctgcaaatgtttcaaagcttggctgagtgcaaacagtttacaagtttgggcagaccaattattgggcaatctttctgactctacttcttcaagagtttttccatcagttactgaatacccattatgtcttttctcttcaattacccaggaggacccatctataaataagtgtcaccctgtcttgaagggagtttctcttaagtctggccagacctttgtatggtaatcaattagatctaaacatgtgtgctccctttttaggtttagatcccctgttaagaaactagctagtttgagtgaattatcagtagttaatgttaaatcatctttttttttaacagaatggtcttatactttaaaattcttgagtcagtgattcacctctctattttttggtttaagatagttctaacttggtggggcgtgcttactgtctattttcctccgaagtttaactttttactttcttcaaccaacactgctctagctgcaatggactggatgcattgaggccatccacaggtgactgggtctaaaacttttgacaggaaggccacgggctgccggttgcctccatgcttttgggtaagcactcctaaagctaccctgtcattcacattaacaaaaacgtgaaatggcttttctagggaagatagggctagaacaggggcagttatgaacatctgtttcagctcttcaatctgatgaattttatcgaagtccacaagagacggtcaggcttccactgggtaagtttttcatacaaaaatttactttttagtgagtatgagtcaatccatacacagcaatatccaattaatcctaaaaatttttttggttcttgcttagtttgaggcaggggtaaggacacaattcactcaatccattcgggccttattctttgcttgcctgcacttattaggtggcttaaatatttaacttcgggctctgtatattgaagctttccttttgagacccataacccctcaaactgttggtggttaagaatatgtatagagaagtcacccactttttttatatcttcaccagatatgagaatatcatccacatactgaagcaggcatatttgctttgggacaagaactttttctgatactcgttctagaatttgaccaaagacgttaggggagtctgtaaacccttggggtaagactgtccatcaatattgttgtttttgcccagaatggggatcttctcactcaaagacaaatatgtctcggctatcctcagccaaggggcatgcgcagaaagcatccttcaaatctattactgtgaaccactgatgatcataaggaatttggctgagaatggtgtaacggttggggacaacaggttgagtggtctggactatctggttaatagctctgaagtcttgtactaatcagtatgacccatctgatttcttgacaggcaggattggggtattatagggagacatacagggtttaaggagtccatctttaatgagactctcaattacaggctttaaccctatcctgccttcgaagggaatggggtattgctttctccttactatgtccccaggagtttttagtttgatgtctattgggggaacttgaagtttttctcgattcccttctcttgaccagacatcaggatgaatgtatttttcgtccacagtggtgagtagatttaatgaggtgaggaatcccttagggccagcttgaaggcctattcctaattttagcattaagtctttttctaatagattagttcccacctcagggatcaacaaaaattgaatgtgagttaatagatcttgatgtttgacttttgtattttccaagatttttgccttaaatccttctccttctccttttaccccagttcttctgaagagccagcaagattagatggagtgagacaaacagaggagtgagacactcctgaatcaattaaaaaggtgataagttcacatttaggtcccacctccaaatttatcaagagctcctggtgggactcaaattaaaagagacagagaccctgactcccctattcttccttgaaagtcatgagtggaaggacttctttttccctttttaatttgggacattgtctcttgaagtggcctgttccacatttgtaacatttatcttgtccttcctccctttcaattctgggattctttgactttgctcccccacactctttagagggcctaggaaatgaaggcccagatcctctaattggaggcttggttcctttgaacgggggttttttggatcctttatagttcttggctccctggaagtcttgttgagaagcatatgggtttggagccacctgttgaaaggtggatagcataagttttgctctttgtttttgcttttctgcgtctctccttacatacactttttgagctttcctgagaagtttacttagcggtcggtcttcccaattttccaatttttgtaacttttttgaaatatctagtcaattcttagtgacaaaatggagcttaaacatacccggcccaaggggatcttccaaatttaggcctgcatactgtttcatttgctcctttagcctgtctaagaattttataggcccctcatctttttttgttgttgtatatcaaatgctttagagaggttttgagtttggggtattgattccttaattccttttattatcatttcccttagatcttccatgttttcctggtgagctgcattattattgtcccacctgaggtcttaagcgggaaatttttggtccgcggtagggacattctgaccaggagagtattcacgtttccaaattgccatagcagccctacggttatgctttttttctcctccgaaaagaggatgcctgggatggatattaactcgacccaggtatataattgaggtcctaagaattgatcaacttaatcagccaccccataagggtcatccaacaggagctgaagctcttttttcaaactttgcacctctgaactggtcaagggaatatttacaaagccaatggctccccctccttgtggaacctcttttaaggggaagagagtcggggctgactccttaggtgtggagggaaatgggaaattttggatatcctttttacattgttctatctcacgttgaagtcctttcagggaggggtacttaataggctgggaggggacaggctcatgggatgataattcccaaagtcagggttataaggaggaggaataacgtgagcagggaaaggatctggaatgagacctgaggcggcagcagctgcctgagggggagggtcaggggcactgagcagaggaagatgatccagaggatcccatgtgttggtgggtgtgggttgtttaggaacagggactctttctcttttagaggagttggtttctggcttgttccctctggtttttaaagggtaaaggaggacaggttcttgcctccaaaaaagagcatagtctgtttccttttgggagacagggcttttgtcattaacatgttcgattaagagctgacaaatccactcttcattggaaccaaattttggccggaaaactgagggtttgaggatgggccttcagtccaaataaaacaacaatattgtatcatttgctcttttcttttatgtttagttctttcattatctttccaatattttaacataagtcccaagggactatcaggaggaatttcatcacgcgcttggctgtttatttttcctgtcttacgtgaaacatttcccatcttggaggtttgggatggtgtctaactgaaataggcctttccctggagcttctcaacctctcctactagagatttctcgccctccgtcctttcagaagctcactgaggctctgaggctcaatccctcatattagagatttcttgcctatcgatttccataggcattgttaaggctcagtccctcgtattagagatttcttgcctatcctttagccccacctgttggaggctccttgcatccttctttcgctttttccactctggctgcttcccttgtgggaaatggcaggatctgccacatgaggtgaccacgggaccgtgcagataggacccactcaatccacacagcagtagtgttaacatcatctacatacacttttatcctccaagataccctgaccacctaggaaatactttgttgttcttgtaccgtttttcaccttggtctgtgcacagagttacttggtcgccgcggtgttgtaagcctctcctttccccattgctgagagcttggatttgtttgtcacaatgggtgggtctcagtctcccatccctgaggccactgcaatgcgacagtgggacacgtctccccctgggtggggtgactgaagacctcttcttgaaggagaatgggaatccccgacaagcccccagaattgttagaaagaaagcttgaagtcgtaaagaaagacgagtactcaaacaaaggatttctcagcaaagcaaatttacttttgcgcagtagggtgcttcttacagggctgcttgtcatgagagcacactgaagaaagtagagtagaagcttttattcctaatgtgactcctgccctcgtgccctttccccattggctggggtcggactgcacaatctaaactagacccaattggctaaacatttaaactttcttagataaggtgggcgcatgatgggagagaggggagaggaggaaggggtcatctacagaggactagagagccagtcttttcctaaataaggaaaggaatgtgagctggggctgtggcatgcctgggcatgtagtaaaatcagaaagaagaaaaaaggagaagaaaggcagggggtacctggaattagagaataagtagctgagcaggctatttgaagagaaaccttgccatatctcacatcttttatatcttctcatgcctgtatgtattatatgaactgacataaagggagtcttttggcctttcctgaggtcgtatagtgttatgttggattttgcatacctgaagtagagaatcttgttgagtaataatatgaatgcttgtttaacaatgtaagccctttagtacttacatggtcatcttaggatggatttatatccatttgtttttacaagattaaagttttcttattttttcctgatttttaagggtaatagatactcattgcaataaggcggaaaataccaaattgtataaaggagaaaataaaaatcaactataatatcattatcgatcatcattactattttttcacatagtttttaaaatttttatttttgtctatattttttgtttttttaaaagacggtctctctatgttctccaggctggcctcgaactcctgggttttaaataatcttctcatctcagactgccaagtagctgggcctgttggtgcatgccaccatgcccaaacttccagcctttttttgttttaaaaaagtagagttttgaaccaggcacagtgattctcacctgtaatcccagctacttggatagctgaggcagaaggatctcttcaggccagtagttcaagaccagcctgaataacatagtgagcccttgtctctaaaacaaacaaaaacggaattataaataccatcttgtaaactgccttttaatttttattttatttacttattttgagactgagtctcactctatcgcccaagctagagtgcagtggcatgatctcggctcactgcggccttgacctcccagattcaagcgactctcatggcttagcctctcaagtagccgggattacagacgtgtgccaccacgcctggataacttttgtatttttagtagtgatggggttttgccatgttgtccaggctggttttgaactcctgacctcacatgatccacctgccttggcctcacaaagtgctgggattacaggcgtgagccaccacacccaacttaaactgccctttttatatactgcagcttatttaaccattttctgctgtggacatttaactcctttccagttttgaggtattataaataatgtctacatatagaatttaaaattttcctgaaatgtatttttaaatagtcatagaacattaaatgttaaagaaatatgttaataaattgaacaacagtatttaataattcagacatttaaaaaataaggaaatttttacaaatcaagtagaattttgtttttttaaaaaattgtctttgcagttttacaataaaagatgtacagtgttttttctggtttactaaaaatgaaatcttgtttgtcatttagatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtacctattttaagataagtatgacacttgggcctgtgttttgtaagaaataaataactgtgaacaatttaaaaaagtaaaagttgagtatattttgaacaataagtattacagtaccatttttttaaatcaggattatagcatgtaagaattattacatgtaattatggcatgtaatcagaattatggcatctaatcgttattctttgattcacaaaattattgtgatggttaaacaacagagtgaatatgaaaatacagtttgaattagaaagctatatacagatatgagctatttcagtcttcatttttctgacatggagctgtagtacaacttgaagaactttgaaatagtcttggagaaaagttcaagattgaaaattagatttttggtactatatagaaatactctgaaatagtttagatagttcctatattaaaatgacacttaaaatacttgtgtatttatgagaagtgagtcaagaaatgttactttttttctgataattagcatctgttctaatacttatgtaaggaaatgaggctaatttcctcatttatattaatctaatttcctagatttatattaaatctctcattatgcttctgcatatgtatttagagaagcataagaatatactatatattagagtttaaaatttagatctgtggtatatataaaccaaactatggtaaactcctttttcttttctttttatcataggcagtggtcagtagcctgtggtgagctgtttcagagtttttcgttttctgtatttttgacagatgatctatcaggaatgaagatatactgctagtacaaaattaattatatcatacatgctactttctataatacagtatatcatccctttcaagagacttaaattttttttttttgagacttaaattttttcatctacattctaataacatctaaatcactaaatattaaaaatgaattgattatttagaaatgtttgcttaatgattatcagtaccatgaaaaaatatttcaaaattacatagtcatttaactagccttttgaaagtggatgcacagaaatatttatatgtttaatagtattttaaaacatcgagggtaaaaacatattaaaattctatagtaaatttatcaaatgtttatttctgtattaatttatccttcaaaacagaaccaatataatttaagattgttagtctctacaagtatacttcaaagccttttaagagagaattcggaacattaccactacacagaactgtctactgtgactttcattcttaccttctctagtgccccatttcccagtataataagatactacctctacttctcagcatagaccttatagttaatacacctagttttacctctcatactttgcagggcacttcatctcttacaaggtttgagacatttaacctaggaacactttctttttttttttttttttttttttttttgagatggggtctttctctgtcgcccaggctggagtgcagtgatgtgatcttggctcactgcaacctccgcatcccagattcaagcaattctcctgcctcagcctcctgagtagctgggcttacaggcacatgccacaatgcccagctaatttttttgtatttttagtagagatggggtttcaccatattggccaggctggtcttgaacttctgacctcaagggatcctcccacctcagcctcccaaagtgctgggattacaggtgtgagccaccgtgcccggccaggaatactttcttagttctactgaaatgtaagaccatttcttaaaaagtctctgagacaaatgataaaaaatcatagtcactttctcacattgagtaatgtctgcagtgtccagtatgacagccagtagtcagaaatttaaattagttccccagtagcaccagccaaattttaagtgcttctgtagtccctctgtccactttattggacagtgttaatttagaatatttctgtcactgcagaaagttactctggacagctctgttccagattcccttagactcaattttcattccatcgtcctgttctgtagagtctactgtcttttaacagccccacctctagtcccatcttcgtagttttaattgaagcttcccttatgttgtgattctaaggtattagttctcttttcagtttcagtgattcttcttgattcattggggcattcatgaagactgtcttgagaattgtggagtgtaattctgattgtgctttggatttgctattctggtggcatttcgaactgaacactaacacttaaaacatttttttttaggtccccagaggcaaattttagacaaatcttactatcttgggcttcttaggtatgttaaacatatcttttcatccgtatgttttactcgaaatattgtgtaccttctgtcaaaatagagtatataactttaatatgaagttttagctaggcacttattaggataattaggtatctattgatttctaaaaattattttgtattctaacaatttctggttaatttggctatgctgtaaaataaatgtgatagtataattagtctgagatttatagttttatgaatttgcatgtacatgagctatattttccctcagtttgtttgtgctgctataataaaatacctgagattgggtaacttataggaatttatttcttactgttccggagacgcagaagtccaagatcaaggtgccagcagcttcagtgtctggtgggcacctgtttctcacagatagtgccgtcaaggtgtcctcatggcagaagagtggaagggcaaaaggtgctgagctagtttccttcaacccttttctaaggcactaatcccatccatgagggcagagtcgtcatgtcctgattacttcttaaagtccctacctcttaatactattgcattagagattaagttttgatatgaatttcagagggactcaaacattcaaaccatagcaaacttattttattttatttatattttagagacagagtctcactctgttgcccaggctggagtgcagtggcatgatcacagctcactgcaaccttgaactcctgggttgaagtgatcctcctgcctcagcttcccaaagtgctgggattataggcataagctaccaccacacctggcctcatagcattttttttttgagacagagtcttgttctgtggctcaggctggagtgcagtggcatgatctcggttgactgcaacctctgtctcccaggtttaagcaattctcctgcatcagcttcccaagtagctgggattacaggcgtttgccaccacacccacctaattttgtgtgtgtgtttttagtagaggtggcatttcaccatgtcagccaggcttgtctcgaactcctgacctcaaatgatctgcccatctcggccttccaaagtgctgggattacaggcatgagccaccgcgcccaaccccttgtagcattttaaaagttcacttttttcatctaatgataagaataatttttttttttttttttgagatagagtctcactctgtcgcccaggctggagtgcagtggtgtgatctcagctcactgcaacccctgccttccgggtttaagctattctcctgcctcagcctcgtgagtagctgggactgcaggtatgcgccaccatgcctggctaatttttgtattttttagtagaggtgggctttcaccatattggccaggctggtcttaaactcctgacctcaggtgatgcacctgcctcagcctcccaaagtgctgaaattataggctgagccaccgcacctggccaagaataatcttctatgttttttttcagtaattaatctgaaacgtgttactcatatcattaaaatgttaccagctacatctaataagaaagggaaaatatgtatacttatttatgttatattaatcagtaagttttacataagtatgtatttggtcagttgctaccaatgtggcctaattttaattaattcataagctttttttcttttttttttgagacggagttttgcttgtcacccaagctggagtgcaatgatgggatctcacgtcactgcaacttccaccgcctggattcaagtgattctcttgcctcagcctcgtgcctgtaatctgcaagtagctgggattacgggtgcctgccaccacacttggctaatttttgtattttttttttttttttttttttgagacagagttttgctcttgttgcccaggctggagtgcaatggcctgatctctggcaccgcaacctccgcctcccgggttcaagtgattctcctgcctcagcctcccgagtagctgggattacaggtgtgcaccaccatgcccagctaattttgtatttttagttcagacgaggtttctcaatgttggtcaggctggtctcgaactcccaacctcaggtgatctgcccaccttggcctcttagagtgctgggattacaggtgtgagccactgcacctggcctaatttttgtatttttagtagagatgggggtttcaccattttggccaggctagtcttgaactcctgacctcaggtaatgcacctgcctatgcctttcaaagtgctgggattacaggcgtgagctgccgcactcggcctcataaacttttgttatatgtctctggggatgcatctctaaatcaatgactttttcttattcttactattttcccacttacttgttctactgtcctatctccatcttcccattttacttcattttctttttggcacattatttgtatcttctttctcttttatttcgcttttgtttaatccaccctcccatcatgccctgaaagccctgttttcttttatttctcagttacctggatcctattgagtctcaaactcctagaaggcaataaagaaaagtatggtttccccccatctgttctcaaagctaagagtagtaagaaagatagtaaggccatcagttgtttagtatctctgacattcagccactttttaatcaaaagaaggaaaggaaatatagttattcctaatgattgcattgcctttctcccccaggatttgtgcttccacatcaaagaatagttctagctatttgtgtaattgtctggctctagagcagtggttctcaactggtggtgattttgcccccagggaacatttggcaatttctatacatgtttctggttgtcacaagtgaggttggaggaagtgctactgatactcagatccaggatgctggtaaacatcctgcagtgtacaagatagtgctcaacacgaggtgctaatcactgacccaaaatgtcattagtgctactgttgagaaactgtgctctagagggtagtagcagctgtgatgatgacagttaagcacctacatctgcctgtggcttgtactagtttgaccaggctttcattctggttctatttcatctttcttcatgaatctatgtcagtttctcctcagtttctcatcagttgagtagaataggatgggatatacctcattctttttttttttttttttttttttctgagatggtgtctccctctgtctcccaggctggagtgtagtggcacgatcttggctcactacagtctccacctcccagatttaagctattctcctgcctcagcctccctagtagctgggactacaggcgtgtgccaccatgcccagctaatttttgtattttgaatagagatggggtttcaccatgttggccaggcttgtcttgagctcctgacctcacgtgatgcgcctgcctcggcctcccaaagtgttgggattacaggcttgacccaccgcacccagccagaatatacctcattcttaatgaaataagccacctaaactttctgcattcttttagtgaatttcacaaaactatttatattattattacgtattaatggaaagtttaaattttgcttaactagagttttctggattaaaagtattgctgacattcttatttcttttctaatagaagtaaaataagtgaacttacaactgaagttaataaacttcagaagggaatagaaatgtacaatcaagagaattcagtatatttgtcatatgaaaagaggtgagtaataagtattcagtattcattcagtattttgtgcttataatactaactttgtagctatccatattgtttgtaatgttcattttcttatgtatatttttatgtacatatttatgaatgtatttattttatgctttcagggctgagactttagctgttgagataaaagagcttcaaggacaactagcagactacaacatggtattttatcttttctaagagaatttactgttaatattttcattagtttttactactgctttaaaaatacattagtaggcaaaggacatgcacagatacttttcaaaagaagacaaacatgcagccaacaagcatatgaaaagaagctcatcatcactgatgatgattagggaaatgcaaatcaaaagaataatgagataccatctcacaccagttagaatggctgttactaagaagtcaaaaataacagatgctggtgaaattgcagagaaaagggaatgcttatacactgttggtgagagtgtaaattagttcaaccactgtgaaagcagtgtggcgattcctcaaaaagctgaaaacagaactaccattcagcccgtcaatcccattactggatgtatacccaaaggaatataaatcattttaccataaagacacatgcacatgtgtgttcattggagcacggtttacagtagcaaagacatggaatcaacctaaatgcccatcagtggcagattggttaaagaaaatgtggtacctataccatgaaatactatgcagtcataaaaaagaaaaagatcatgtcccttgcaggaacatggatggagctggaggtcattatccttagcaaactaacacaggaaaagaaaaccaaatactgcatgttctctcttaccagtgggagctaaatgataacacatagatgggaacaacagataatgggatctacttgagtttggaggctggaaggagggaaaggatcagaaaaaataactaatgggtattagcttagttacctaggtgattaaataatctgcacaacaaacccccatgacagtttatctgtaaaacaaacctgcacatgtacccctgaacctaaaataaaaatttcaaaaatttcaaaaacaataaaacatttgatgaaaaaatatatttattaatttattatttaaaataccaaatagtacatgaatacatacttattgggaaagatgaaaccataaaaattacaacaaataaagtatccctttactttctgcttcatttccctccccagaaataacttggcttaacagattaatatatattcttccattgttttttgtaaaatacgtttactgacacatacacaaatgcacacatgcttttctccctaaaatatgttaaaataataatttaaataattttaaaagtggctaaaatgtattggtcctatcagtgatcattgctttaaaaacacattttttatcaagtgttgtcatcttgaaaattttgaaatttaattattaaacatacagatttccaccatcttgatgttttactcgaaatattgtgtacattgtcaaaatagagtatataacatgatatagttccactaaagatgcttctacctgtggactttcagaagaaacagtccccctggcaatattgataactgctcagtccttgggtgatattggccccatgaaaatttctagtgtcagaattttcttttttctaactctttagttgctttaggagcagtgatgtctggatttaatgaaaaagtcaaatttttatctcactacccttattaagaaatagtgttacaagaaataaacattctatcataatggttaggataagataagttatgatatacctacttgatagtgttaccttgtgcttatcaaaaattttgctaattatagtataactttttatttttgtttttgttgttgttactggtggtggtggtgggttttgttttttgtttttttgttgtttttttttttcaagacagtcttgctctgttgcccaagctggaatgcagtggctcaatcatggctcgctgcagcctagactttctgagctcaattgatcctcccacctaagcctcccaagcagctgggactacaggcacatgccatcacaccaggctaattttttgtattttttgttgagatgagatttggccttgttgcccatactggtctcaaactcatgggctcaagtgatctgcccaccttggtctcccaaagtgctgggattacaggcttgagtcattgtgcctggactatttttattttttaatttttttagagatagggtcttgctctgttgctctggctgaagtgcagtagcatgattgtagttcactgcagcctcaaactcctgggcacaagtggtcttcctgcatcagcctcccaagtagctgggactacaggtgcatgccagcatgcctggctaatttttaaattttttggagagatggggacttgctgtgttgcccacaatggtcttgaactcctgggctcaagtgatcctcctgcttcagcttcccaaagtgctgggattataagcatgagccattgcacccagccctcttataattcttaaatttcctggactacacaattcatcacaaacattttgtagagcccattattcactgggattttctttagtaaatgatgttctgttttaaatgtgagcaaaatagtttttttttgtttttttgttcttcttgagatggagtctcgctctgtcatccaggccggagtgcagtggcgtgatcttggctcactgtaacctccgcctcttgggttcaagtgattatcctgcttcagcctcctgagtagctgggattacaggcgcttgccaccagctgggattacaggtgcggtcctgagtagctgggattacaggtgcctgggtaatatttgtatttttagtagagaaggggtttcaccatgttggccaggctgatctcaaactcctgacctcgtgatccacccgcctcagcctcccaaagtgtggggattgcaggcatgagccaccgcgcccggccgagaaaagtagtttttaaaggtatgaaatgacatgagatgaaagggagttttagttatgctggaacaaattaggcatattcatataaaaatactaccatataaaatatgctatttatagatttaatgagctaatatctgatacagagcagttagctgtgtatctgacatatagttagcactcaataaatgttaggccttattagcacttattatttatatcataaatgaaaaatgtgatataccttacacccaaatagtttgcttttagtagaccttctgttcacattctggctctatcgcttgctaaatttctttttctgtaaaatgtgtacaatcatatctacttcatacagtaattgtaaaaattgagttaacacatatgtaatagtgtttgacactaggtaaatatcctatgttgacaactgatatccttgcctaactttttgaagtagacttactactgttccatctgtgcaagccctgttgatttttttttaattattagaagataaagaatatctttttatgtttttactagtgtaaatttgttttttgttgttgttgttgttgttgttttttgagacggaatttcacttttgttgcccaggctggagtgcagtggtgccatctcggctcaccgcaacctctgcttcccgggttcaagcgattctcctgcctcagtctctctagtagctgggattacaggcatgtgccaccacacccggctaattttgtatttttagtagagacagggtttctccatgttggtcaggctgttcttgaactcctgacctcaggtgatccgcccgcgtcagcctcccaaagtgctgggattacaggcctgagccaccgagcccggcttactagtgtaaatttgtaaatctactaacattcctctctccttggggatgttggcaggggaagagagggtgatagatctttccaaaactctcgtctgttccaaacccttatttataagctcagccatcttttcagagcaggcaaagctccacaagatataatattcaggaagagttgtttattactgctcatttatccatgttaaaaatgtgatttgtttattggccaggtgcataatatatgcttacttaggtagctcaatatttgtttttatcttaaaatagaaaatattcaaaagtattaatacttaagttactactcattatttgtaagactgaatacctatattattaattatagagaacatgtgtaaagactaacaaaatggtgtttgtttgtttgtatttttgtttttagttggtagataaacttaataccaacactgaaatggaagaagtaatgaatgattacaatatggtaagaaaatttataaaagcaaattgatctatgtaagtcatatcctacaaaacaaagcatttatatctagaaatagtttgataaaaccttaagtgctatagaggtgaatattactctgattgtaaataccactattaggtattccttgagctcccttagttgctcttttaaattttcttcctgttgattggctttcctaagtgggtgtttagtgactgtctactgtgtttgaactggtgtcacgtgcaacattagttagggagtgccatctccatttccttatatatattagtttacagtatttctggcttagtttaagcacaaatgttgatgaatactcaatgtgacaaatgataactttacatagtttttgtcaccagtggagaaaaatgaatagatatgactccagacataaaatattaatttttgattggtaaatgagaatctgtgtttaacatggacataacactggggactccaaaaagggggatggtaggagggcaataagggtggaaaaattacctagcaggtacagtgttcattatttgggtgatgggttcactagaagcccaaaccttaccgttatacaatatatccatgcaacaaacctgcacatgtacctctgattctaaaataaaaacaaatttgtattcaatgttcttagattaattgtttggtagaaaacaataaaatatgttaatagctagcttattttgattataagcatttggatgaaaataacatacaatttataatttatatagtttataatttatttacatgagtaaagactgttctatgaagacataggattgataaaatgactcttctaaatttggggttctcaaaccatgataatttagttacttttagctttagaacacaagagaattcactaattaagaatcttatttcaatgccagatataaaaagtaaaaaccttatgtgttttgtcagttgtttgggatggggggtctgttttctaggctgggtgtgcacaggtagagttaattaggtgtactcagataatatcctgaatggttcaggaataaaacttgtggtggttctaaatttaacatattactaatcaaatatttattgaacactcaatatattctttgaatgctgtttacataaattgaatttacattgaattatttgacagatcactgaagaacaatgaatatttttggtataagattacaatgcttcttaaaaagactttttaaaaatctgatattgtttgttaaatgaggcaattactttatttttcttcttaaactttgtatgtggcactaggataattatagtaatttctcatttagttcctagccaaaataacctacaaagaaaaaatttggtttaatatttatttcttactaacttatgtgttaactttattcagcttaaagctcaaaatgatcgagaaacacaaagtttggatgtcatatttactgaaagacaagcgtaagtatagctaatttaaaaattagattcataagtaagctttattaggtagtttaagttgtgatccagttatttccttgtaaattttcttaacaatttccccattgcctttttcatttaaaaatatttacaacacaaattttgttgcttatacttgttatcttcatttaccattaaatacctaaattctgtataaagactattgctacatagcttatataaataggatttatgctgctagcagctgaacacttatgatggataagaacatctttatatctactatttttggttttaacctgggcttttaactaatttgaattttggtgtttcatccccaatctagtgaaagacacattattcattaggaagctatttacattatttcattagcattgatatttaatagttatattagcaatctacgtcatatatagattgtatgtgtgtctttatatataacctatctaaagactaaataccaactaacgctggaaataacgtaattgtggcagtgggagtaatgcctacaaagataataatagatgtgatgtagttaacttatttgtgttttgtcagttgtttgggatgggtccatattctaggctgggtatgcacaggttgagttaactagggatactcagataaaatcctgaatgattcaagaataaaacttgtgttggttctaaggtcaaaaagttgatgaagaataattaatttagaaccaacacaaattttattcctgaattatttattctaaggcaacacaaacacaatgagctatgttgtgtaaacacacatacaagcacattctctcccagaaatttgttaatattagtctctttgagagcaaagacaataataaacccaaattaccatattcaattaccaaaattcagtaacagcaaatacactctcttgttacctctgcataaaacagtaaatatttgatgatggatagatgttaaaatatactgataaaacatttgaaagataaatgtaattcttctattgattaaaaacaagaatctcttttcccctgcctttaagtagagttttgctctgttgcccttgctgaattgaagtgacatgctcatggctcactgcagccttgaacacctgggttcaagcgatgttgcctcagccctccaagtagctgagactacaggtgcatgccactatgcccagctaattttttgtttcttggggagacagggtcttattacgttgctcaggctagtctcaaactcctggtctcaagcagtcctcctaccttggcctcctcaagtgttgggattacaggagtgaaccattatacccggccaccatctatcatttgctgctgctgtaaagtggtatcttataaactcaaaatactagcagtctttttccttttacaaggaaaattttgttcatggtaaccacgctcttacttgaaaacgttccttttttttttgttatcctggttttaatccatttagcaaatatttatcatttactatatataagatactctcttaggtacttcaaagaataagaaatatataagctataggccagtgtggtggttcacacatgtaatcccagcactttgggaggccgaggcgggtggatcatgaggtcaggagatcaagaccatcctggccaacacggtaaaaccatatctctactaaaaatacaaaaattagctgggcatggtggcacgggcttgtagtcccagctactcgggagactgaagcaggagaatcacttgaacctgggaggcagaggttgcagttagctgaggtcgcgccatcgtgccactgcactccagcctggtgacagagcgagactccgtctcaaaaaaaaaaaatagagaaatatataagctataatcccctgaaggccttaaagagtttagaacatttaagttctcatttatttcatcatttatctcaaagttatataatacctaggtcaggttttaaatattatatttacatattttacagatatttcatctgaaaacataatttcaagaataaaagttaaagaatgtcatagatttttacatctatttggttttttttatttaggaaaatcttcaaatatggtaatttgtcctgaagatacatccaaaccatttaaaaactctgtctgtaatttgtaattgaggctgagtgaaattggttctcttgtctgttttaggcagaaattgaaattaagaacaacaattggccaggtgcagtggctcatgcctgtaatcccagcacttttggaggctgaagtgggtggatcacctgaggtcaggagttcaagaccagcctgggcaatgtggcgaaactctgtctctactaaaaatataaaaattagctgggtgaggtggcaggtgcctgtaatcccagctactcaggaggctgaggcacgcgaatcacttgaacccaggaggcggagggttcagtaagccgagattgcgccactacactccagcctgggtgacagggcgagactttgtctcaaaaaaaaaaaaataacaaaaagtattgttacgaaggttacttttctatacagcagtagaatagatttatttcttgtgttaaccagatggccaacgtctcaataacacaaagatctatcttgactctacacagagtgaccaagaaatgccatacctcgagaaggcaggtgtaaaaagcttctgttttcattctcttctctttcaatacaaccatttagtgtggtctgaccatctggtttattatggaaaactcatctataaaaagttggttataataaacagcctcaatatattacaacaacaatatgtaagacacctggcattaattcagtttcacagtcttgcttgaactaatgattctcttctaatcctgcactttctagttaatattagtcaagatcagttgtcctgtaaaaatatatgtaattataattttatacccatttatttttctttgtgtagtcagatatttattgaataccccatattcaacagaggcccttgaatataaaagcttaagtgtagtctttgctcatttgcaattatatttcattttgctacatttctcaaatattaatatttgcatcttataattaggaaataatttagcagaatgatacattgtttagaaaaagatattttatgttcctataatcatctcattcttataattaaggtttaaaacaaagtataattgatatataaagaaacattagccataatatacttatatcctttgttgaaaacatgtgtctgtaaacacaagcaaatatgtattataaattagtaagttcttctattttacaggtatatcatcctagtttttattttctctcagtagacatttgtattgaatttactaattatgtaacttttaaaatgactattctatagattatgacatagatctattttattttagcctcttttttctaaggaattgtcaagtacatacaaatttttaaaactttattatatacataaacaatttgaacatacacagaaatagcatactataccatacacaacatacacagaagtagcatattatacccttatttagctcccagctccatcagctcatatttgaccttgctccatccatacctctagccactgttccattccacgtgttataatgaagaaaataccagaaatattatttcacccatcaatatatttcattatttcagagatatacatatttgtaaaagatgtaaattcttaatttctctgcatatgaaggtaaaaattatagattgtgctacagtttttaatgtactgtttgcattgataaattattaaattgtgattatagccaattgattatgaggactcagcaaataattttctttagacccttcctattacagccgataggccagtgttttccaaactacgttctttggaatgttattgaactacgagctcttagtagatgtaactgaaagaatgggttttgttgtcaagtaagtttgagaaatttttaatactttgctcttgaataatcagagagcagtttagcttagtaaagttttacataaatcctattgtaaagaatcttggccaggcacggtgctccatgcctgtaatcccagcactttgggaggccgaggcgggtagatcatgaggtcaggcgttcgagaccagcctggccaacatggtgaaaccctgtctctactaaaaatacagaaattagccaggcatggtggtgtgcacctgtactcccagctactcgggaggctgagtcagaagaattgcttgaacccaggaggcggaggttgcagtgatctgagactgcgctgctgcagtccagcctgggagacagtgcgagactttgtctcaaaaaaaaaaaaaaaaaaaagaaaaagaatcttgtttcaccttgtttaaactactagtttttcctgtagtaatttgaccatgtacctccttcttcttctgtaaatacttgtgaatgtctctctggaaattagtattctagaaaaacaatttgggaaacattgctctatctactgaatagatagaaatagctgtccatggaccacatgaagattccttagtgtcagcacagaccaatttgaataaaaatctcccagagagaggtggaaatatgtatttttaaaacaagatttatagataattgtgatgcccactttggaagccagtatgacattaaactgtagtgatcctgcattatggtgacagcctttctttataaccagaatcaatagtgacttattagggattatgcctgaacattgtgcttgtgctttaaattgctatgaaattttaaggaaatttattgtgctatttcaggaagcatttcaaaaaaatattttccaactctatgattttattctgggagcataaaatcaatcttagtgtattatttaagctatctctgttcctcactttgacttccatatattaataaatcctaaacttttatttctttactgattgaaacattagtataacttaatacatattatgtcaaatacctgtgttaatatgagaatccattcattttaattcatgaataatttagacctttttactagttcgtatggtcacccaagcactgctaagaatagtagtgctagtattgtagactatgtaactgtcaactaccgaggagtgtcagttactgtatttgaacctgcttgctcaatataatgcaaagaacataattttatgatattcatgtatgttgtcattaatatgaatgcctgccagctgtattttgttatgtcacatagcaaaatctccatatctaaactgagtgagctgataactttgctttaaaaagcaaactttgaaagaaattaattttcttcacataattcatggatatctatatatttgtcttcaataaatccatcatcatctaccacaaatgaatgtaattgttcaaatattactgtagtttcttcagagtttgtttctggtatctgtgaaagagagcttggatttccagtaaaaccatcttcataggtttctgcttcatgctcttccaggcgatgatgattataactaagcagaatattgtaccatattgggcatttgatagcaataaaaatgagaagtgaagtcgtcagtacagtgacaacaacaccaacaagaaaagcccaactttttccaagaggttcatgttctttaatggaataccaagagaggagagagaaagaaaatttgttaagttggcaaaataatcataattatatatcctaattctcctcaatattggtattaaaaataaacatacattgtagttttctttagattttgtttggtggatgaattctctttgttcaaaatagctgtgtttgcaattttgttacccttttacctaagaccattattgatttatactcgttaagatttgtgactagactagttaaaacaaaggctcagagaagttaaataatttgcacgatggcatttggcttgtaactagcagagcctagtttggaagagcaatattttgtaaatctttagttgagatgaggaatctttcttttacattttttatacaaatttaaaataaagataactacctcagtttatttagtatgatacattcagcagtgttaatatatagaaccagtatattacctgaatttcttgttaagttgttcgaagagctattaaatattgaattgctgatgggctgaaaatgaatataaagatcttcagttactgatgaaggaaattttgagtggcattcagccttatgaggtactgttttgatattgtagctctgcaggctgttggggtagctacacatggtgatgttctcattttctagtaaatcagaaagaataagatttagtatagagaaaaataatagttaacaacattttataattgttttatctagaatttttgacatatttgtcattcttaaaggcattataagaaattcctgttgtatttgtctagcaacataatgaaagaatgatgcacatttctgtttattattttataaatatggcttaaatgcagtatctttgttatttagtttatctgtattagtgtagattttattattaatattgtggttacatggttacaatctggatctcaggcacagtatggtttgcagttaaaatacgtcacttgttttcacttagtctaggaagcacttttaaaaaattagtctgacatattgactttgctaacaatacatgaaatgacattatcatctcacatgtatagaacatttacatttctggccgggcgcagaggctcatgcctgtaatcccagcactttgggaggccgaggcgggtggatcacctgaggtcgggagtttgagaccagcctgacaaacatggaggaagcccatctctactaaaaatacaaaaaattagccaggcgtggtggctcatgactgtaatcccagctactggggaggctgaggcaggagaatcacttgaacctgggaggcggaggttgtggtgagctgagatcacgccaatgcattccagcctgggtaataataacaaaactctgtctcaaaaaaaaaaaaaatttcttaatttttccccctggtaatggggaaggagagcatctatgcagctgttactttttagtgtttcttcctgttttgcttaaacagaaattgtttcctttcctttttttttttttttttttttgagacagagtctcactctgttgcccaggctggagtgcagtggcacgatctcggctcactgtaacatctgcctcccaggttcaagcaattctcccacctcagcctcctgagtacctggtactacaggcatgcgccaccatacccagctaatttttgtatttttagcagagatggggtttcaccatgttggccaggctggtctcaaactcctgacctcaggtgatccccctgccttggcctcccatagtgatgggattacaggcatgagccactgcgcctggctgcttccttttctttaaaacgtgatatgagagatttttctgtggtggaacattgagttaatcacattttggttttgcttaattatgatagcttacctaatgtcacatttgatgtgttcaaccagttctgcaaattaaatagactgcaagagcagttccataggtttccatataaagttattaattccagatgaaatagtggtggtacatccaaatagctaatcaaattgccttgcagattcagaagttttaggcttcttagaggcacaaatacatcagcattcagttgttctattttgttttggcagagatataactgttttagtttatttaagcctaaaaatgcaccctgttgaattacatagatggagtttctacagatatttaaaatttctagactggagaggttaccaaaaccgttattatgtaagatagtaaccttgttctcaatcaaatagagctctgtgagtaaaaagtatgtctgtagaactcttgtgtctgtaccattaagagtaatttggttataactgagatcaagtatagtaacatctttcttgatatctgctggaatcaaggtataatttttttcagtaaaattacattggacttcctagaaaaacaaaaaaaagaaaggcattaatcagaaaaaaaattaatagaatttcaccaaatttcatatttaagcacttagacattagaaggacgttattttgggaaaaaaacctactatctaatattttggtgttacagtagagcaaatctttttctttattgggatgaaatactaaaaattaaggatattctgatacatacaattgaacaaagagattccaatttgtcatacgggtattttccaactgttattacatgatcattacagaaagtaatgctactggaatattcccatttatatatgtggaaatgtatggtaaataataattctgttaacatttaatattccagtgtgcacaattgctttatagtgaggaaattattttaaactatatgtgtttttaaaatcagcagagctaacaacattatacctagggctgttcaataattaataaatgggctgggcatggtggctcacgcctgtaatcccagcactttgggaggctgaggcaggcgggttacctgaggtcaggagttcaagaccagcctgtccaacacagtgaaaccctgtctctactgaaaatacaaaaaaaaaaaaaagtcagccgggcatggtggcaagcacctgtaatcccagctacttgggaggctgaggcaggataatcgcttcaacccaggaggcggaggttgcagtgagctgagatcatgccattacactccagcctgggcgacagagcgagattccgtctcaaaagcaagcaatcaatcaatcagtctgaataaactctctggtttaactctcttaaactctctgggtttaacagctcaaagtttggtgttttaaaaggaaatatttatcttttatcagaaatggagccaggtattgaatttaaagagccacacaatctgaaattctttatgtggatatagatggaaagaaagaaatagttcttgtttttactgaacagtaaactaagaataaatagaactaagaatagttctggtttattactgtttttgcagttagattttttcaccaataataattcaatagcagtttctctcataaatatgtgctttttaaaaaaaagtttcctacattttaaacaagattttactcttaaaactaatttctgattttatagtgaaaattttcagatctctccctttaatcaacttttaaagaactcagtttttataaatgaaggctgcttttgtcaaattggaatttggatatacagagctaaataaactcttaattttagtaggtcagattttctttgctttcttattgcccttttatattttactaaatatacagaaaatgtacctttgaaaatatttttactattttgattgtaaaaacttactcttttagaagactggattttgtctgataataatatcatggagaggggccaaaagaggattgtgatgcctgtgactttcatgttgcagacctgatagaaaagagagtattttcattaaggacatttttatttttccctcttttgaatctgtttattctttttttttttttttttttttggctgagacagggtctcactctgtcacacagacctggtggcatggtcacagctcactgcagccttgatctcccaggcttaagcagtcctcccaactcagcttcctaagtagctgaaacacaagcatgcactaccatgcctggctaattttaaaaatttttgtagagatggggtcaccatgtgttactcagcctggtatcaaactcctgggtgcgagccatttccccccagccactggcgtggccttgaaaagtgctgggattatagatatgagccacttaccctggcctttcaaatctactttttcttgaaatacataaaatgtgaaacaagtgcatggccattcaccatccttgcactctgatcttaataaactagaaagcccctttgaagaatgagactgatttctattttttctttttagagaaaattaatatttttaagtgtgtctcattagtttctagatctcatgaaaggagctttaaagcaatttaagtggttgtaaattttaaaaatttaatatagaagtgcacaaaagaaattcaggaaaacgtatatttatgcatgtttaagtatatgcttatattgatggtcttgattttttcaattttaggcattatctattggcattatctatctattattcttgacttaaaactgtgggagatgagaatctttagcactctttttccccccatggtaacttttaaaaattttattgaggcgtggtagatatacatagttttggggtacatgtgataaagtagtgcattcatataatttttaaagatcaaattaatgtacttgggatatccaacacgttaaatatttgtcttttctttataatggaaacattcaaattctcttctagctgtttttaaatgtacagtaaattagacgagagggagagcatcagaaaatagctaatggatgctgggcttaatacctaggtgacgggttgatctgtgcagcaaaccaccgtggcacatgtttacctatgtaacaaacctgcataacctgcacatgtaccccggaacttaaaaataaaagttgaaggaaaaaaattactgtaaactataattaccctactgatctaacactaggccttctttttttaagcaaactgtatgtttgtatgcattaataaacttttctgcattcctccctccctaccaccctttccagcctctggtaaccactagtctactcttaatctatatgaggtccacttttttagctcccacatgccggtgagaatgtgtgatatttgtctttctgtgcttggcttatttcacttgacataatgacctccggttccgtttttgttgccgcaaatgacaggatttcatttgtttttatggctgaataatattccattgtatatatatgctacttttttttaatccattcatctgttgatgggcacttaggttgattccatagttttgctcttgtgaatagtcctccaatacacatgggagtgcagctatctctttaatatattcatctcttttttttaaatgtatacccagtggaattactggatcaaatgtaaatgtaagtgttatatttttagttttttaaggaaccttcatactgctctccagagtggctatactaatttacattcccaagagtgtatgagggttcccctttctccacatcgtcaccagcatccgttattgcctgtcatattgatagaagctactttaatgggggtgagattatatatcattgtagttttgatttgcatttccctgagtgattactgatgttgagcattttttccacatacttgtttgtcttttgtgtgttttttgagaaatatctattcagttcttttgccatgtttacttggattatttgttttttatcggtttgtttttggctagtgagctgtttgagctctttatatcttctgattattaacccctttttagatgggtagtttgcaaatattttctcattccgtgggttgtctcttcacttttttgatcattttctttgctgtgcacaagcttttttgcttggcgaaaccccatttgtacatttttgctttggtttcctgtgcttttgaggtcttagagacacaaaaaaatctttgtccaggccagtgttctagagcaattctccaacgttttctttttttctcttttttttttttaaataaagaaaagaggtttaattgactcagttccacaggctgtacaggatgcacgtctggggggtcctcaggaaacttacaatcatggtggaaggtgaaggggaagcaggcatgtcttacatggctagagaaggaggaagaaagagcagagggaggagctacacacttttaaacaaccagatctttttttcttttgagacagagtctggctctgttgcccaggctggagtgcagtgatgccattttggctcactgcaacctctgcctcctgggttcaagtgattctcatgcctcagcctcctgagtagctgggactacaggcatgtgccactttcatgcgggtccatgtgaagagaccaccaaacaggctttgtgtgagcaacatggctgtttatttcacctgggtgaaggtgggctgagtccgaaaagagagtcagccctccagtgttttcttgaaacagttttatagtttgaggtcttattaaagtctttaatccatttttattcctggatatggcaagagataggggtctggtttcatttttccatatatagttatgcagtttttctagcaccatttattgaaacaactattatttctccattttatgttcttggcacctttgttgaagatgagttgatgtaaatgtgtgtatttatatctgagttctctattccattccattggtctatggatctgtcttgatgccagtaccatgctgatttggttactatagctttgtagaaaattttgaagtcaggtagtgtgatgcctccagctttgttcctttttgctgagggttgttttagctatttgggatcttttatggttccatatgaattttaggatttttttttctacttctatgaagagcgtcactgtattttgataggaattgcattgaatcagtaaattgctttggttagtattgatattttagcaatgttcttccactccatgaacatggattatatttccatttttttttgtatcctcttcagtttctttcatcagtgttttacagtttttgttatatagatatttcacttcattggttaaattgattccaaggtattttatattctttgtagctatcgtaaacaggcttgctttcttgatttctttttcagattcttcactgttggcatatctaaattctaccaatttttatatgatgattttatatcttgcaactttactgaattcagttgtcagtttttacagattttttgtggagtatttagggtttgttttttttttaattttttaagtgtaagatcatgtctgccaggtgcagtggctcacgcctgtaatcccagcactttgggaggccgaggcgggcagatcacctgaggtcaggagtttgagaccagcctggccaacatggcgaaacctcatctctactacaattacaaaaattagccgggtgcagtggcaggcacctgtaatcccagctacttgggaggctgaggcagcagaattgtttgaacctgggaggcagaagttgcagtgagccgtgatcatgccactgtgctccagcctgggtgacagagtgagactctgtctcagaaaaaaaaaagaaaaactaatcagagtaggcaagaatccatgcagcatactaaagtctctcgcctcgttagcaataaggaatttactgctattttagtgctagtctgttctagtcaacttcctcattgcctttgatttgttgatccatttatgcacattccccttctaccttttctctttccatagttaaatgaaatttgttaggaaaagctactctgcctcctatattttataaaatttggatgtagatcataatagaatcccttttagagccagaagtgcatttaaactatcacttattcaagatgattgcccatagaagagggatgcctaaatcatttacaaaaggtagtttacctatgtttaatgatttataggaataggtgttcagctccttcaatggcttgtttcagtatttctcaatgatgtggtgaaattcttactgatgtctctagtaggctgcagaggtgactgaggagaggtgggtaagggaagtgctgttttttttccagaaacaaataggatggggatagtgaaagaaagcaaataggctacaaagaaaatgaactagatttaagttaaaagttgatatgaaatagaagcaggtgaaaaaagtaatggaggcaagacaggactgtgagcttatgtggaaatggagacggagtatggttttatatttattatctgtatctgctatttaatgctaataattgttttctcaagtgcgctaaaagaaaaaaatcataaggattagaaaaggattttttttcctttccattggatagatcttggaagcagtgtatactcagctcaaggtagattctgtacaagaaagcattcaacaaatctaaagcatcgttaggtctgaagctgtgaaatacattgattgatccatactatctgtgagagttttcacatatttgtgtgccttttcagaggagaaagattgaaagagggggtgatgtcgattatcatgacactgagtaagtccccagacaaagcatttgctagcattattgggtgtctttaaaaaaagaaaatcagatacgcagaatagctggccaagtagattatgcagaaattatccatcagtcagtttagcctgtttcaacagttggtttaaaaggaagtcagtcattgttgctttctttctccttttggaatattttctaatttggattttttttgaaatgatagttgagtttcatatagtgattacttaggagctaatataaaatagaaaactggaatagaagatggaatatcagtttcttttgttatttcacaaaattacgtgcatttttacctagcatatgatctacgttactgaaaaaaaaagagctttactcaaaggaaatggtagatactgaaaaagaagcattgttcttaataaagtttcaagtacatgtttcttaagttatttactttatatgattattatatgctatgaaataaagagatgctgtaattattttggttttgttaaaatctaaatgtagtttttccattaagtattttagatatttatgccagaattcaatgtatttagagaatgatgttaataatacacaattaactttgtttccttatttaactattgtgtagatttttttcagatttaaaacctttttgtaatggaaaatttcaaggaaaaaacctaagtaagaagaatagttatcagcctgcttcaataatcatcaactcatggccagtcttttttttatcttgccaattggcttttagattagtgtcacttcagaatgctctgtgattaacatattttaaaataaaaattcttataaatttgattggctagatgaaaccatttccccccccgccccccgcaaaacaattacttagtattgtattctaactttatttaggaaagaccctttggccatgtctcaggtatatagtatttttgaggtagaccatgtgaaaatataatcatattttcttatttttcatcacttcttaaaggcaaagatggttgtacagacttaacaaacttaaatatgattaaaaaaaatacaacaataaccaaagctataaatatacatatcttacctttttttcttttgtctctaagacttgtgtgctaaaggaaattaactctgtttcaacggcattaaaaaaagtacatcgtatgattacatttcactttgttttaacctttgtacccagtgaacaggtgatttaaaaaaaaaaactagacttccttagcaaaagattgactagaagaataatttcttaaagtcatcttttccttttttagtataacaagtaaggctgtttgcctaacctttgtgtttctttcttttttttctttttttgagatgaagtctcgctctgtcattcaggctggagtgcagtggcatgatctcggctcaatgcaacctccacctcctgggttcaagcagttctcctccctgcctcagcctcctgagtagctgggattacaggctcccggcactgcacctggctaatttttgtatttttagtagagatgcggtttcaccatgttggccaggctggtctcaaactcctgacctcaggtgatacccctgcctcagcctcccaaagtgctgggattacaagtgtgagccactgcacccagcctacctttgtgtttcttaattactctttgaaaattttattaaagtattaacaattttacttactgatttagagtttacaatattgaaaatgcatacttttgaaagatatactgttgctaaattaatttatgtttgtcctgatggtattttgtgcttagaagcattcaaactgaggtcaggtgcagagtctgacacctgtaatcccagcactttgagaagctaagatgagagaataatttgaactcaggaatttgagaccagcccggccaacttagcaagaccttgtctctactcaaaataaaaagtaaaaacattagcagggcatggtgttgtgtgcctttagtcccagttacctgggtggctgaggtggggggatggcttgagtttgagcatgcagtgagccatgattgtgctaccacagtctagtctgggtgacaagtggtacctgtcaagaaagaaagacagaaagagggagagggaaagagagagagagagagaagagaagagagaggagggggaggggaaggaggaggaggaggaagggaaggaggcagggagggaggaaaaggaaggaaggaaaggagagagagagaaaagaaaggaggtagggagggattcaaattgtaaagataccaccaagttttgtattctattgagtttcaacgtttttgtttacttattattgtgtgtttttttttttttttttttttttgagatggagtctcgctctgtcacccaggctggagtgtagtggcgcagtctcggctcactgcaagctctgcctcccgggttgacgccattctcctgcctcagcctcccaagtagctgggactacaggcgcccaccatcacgcccagctaatttttttgtatttttagtagagacggggtttcaccatgttagcaaggatggtctcgatctcctgacctcgtgatctgcccgcctcggcctcctaaagtgctgggattacaggcatgagccaccatgcccagcctgtttacttacttttatgacaccatcatcagtggttttactgccaagttataacaggagcaaagtactcaaagcatcaaaaagaccttacacctggacatcatatggcctttagaaagtcagttacttttcttatgctgtaatttctcctctgtaaaatggaatactttataacattagttctcatcttcctacattgaaagaagaaacactgttggtagtcagtaatcaaatttagaatgaattccttccaaaagattaattccactgggcttcagtatccttaatttatgaaaatagatactttcctttcaatttctttgagctcatatacctatacaaattgtagcagcaggaaacacatttgttttactgttgtaattgaagctccaagtgaagataccacttcttctccaacagtgaaacaaaaataaattgaaattccaggttgctttactatgttcatcttttatttggttattttgagattttttttggtagggaaatttctgagtttaggttgtttattctagtagtaggatatgaatgtgtagaaggtgtgtaggggatatgtggatccacaagcttagctggtgattgtgaaaactatagaagttggtatctatgagcgaaagagagtaaatagtgataggttaatcagattttgaaactcaaaatagaaattaatgatcttgggagtgaaaatgtgtgttcaatccagctttttataaaatgtaaatcttgaaagtatttagataagtggcatcttacctattcttttttcagagtttttctctaccctatcaataattgaccttgcctaggcaacaagtgacatgtcattggtatttcttttgattacgtgataaaaatggttattgcttctaattaatttcactattactacttttataggattatgtttgtaatgtttattgtgtttttagagaaatgagcttaatattttacaatgctaaaaaatagcaaaaatttgtgaaatagcaatgttaactaaagcagtaagtaaaagagaacttaagcaaagcatattattaatctaaagccataactaaaaaatcaaattgcactgcaggcctctctactccctagttctgtcagagccacactggatgatttacacgggaaacttctatacagtatttaatttagtcagaaaaacttatggctaaaggatgctttaaaaccacaattctaaaacttatttgtcttttttttttttgagatggagttttgctcttttgcccaggctagagtgaagtggcgcgatctcagcccactgcaacctcttccccactgggttcaagcgattctcctgcctcagcctcccaagtagctgggattacaggtgcccgccaccacgtgtggctaatttttgtacttttagtagagatgggtgttttgtcgtgttgcccaggctggtctcgacctccagacctcaggtgatccacctgcctcagccttccaaagtgctgggattacagacgtgagccaccgagcgcagcctcttatttgtcttttgaaggtataactttaaaaaagtataaatgcatcctcatatatataagtcattaaggattttttggtaatctttgtgatttcttagtaaaataaaatggagagtaaggaaatagaggaatttagggatggagaagagaaagatgtaaaaataagtttgtgctaatggggccaaattttatataggtcaaatagcattttttagtacaaatataaagacttttcagtcacacactgtggttgaatgtctttaagtatcctattaaattaggaccatgacttgtataaaataattggatattttttcctcaatatagtatcaggaatattacgtgcttctgattttaggaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggtaatacaaattactgctgtgtgccaagcatgtatcattcttgctactaaaagtatagtttgaatatcagcagcatcagcatcccctgagaacttgactatactttgagatcagttttcattttaacaaggtccccatctgattcatacgtatattcacatttcagaagaatttatttagaaaacttcattttcatctgctgtttgatgacctagcttttactcttattatttttggtttacttctatttattcattttgcatttcataaagacatgaaaatactcgcatttataaaaatacttgtctataaatatttgcatttataaaagtacttttctataaatgtttgcattgataaaaatacttgtctgtaaattaaaaagtctgtaaatacttgcagttacagacttttaatgcaaacattaaaaggcctcataggtggaggttgcagtagtgagctgagattgcaccactgcattccagcctgggcaacagagcgagactctgtctcaaaaaaaaaaaggcctcatagaccagatccatatatatatttactttccttttccttcctgcttaataaacagctaacctttttacctgttagcattatgatttgaatggctattgtcctgtaattatattgcctaaatttccatttttaaaaattaatttttttattgatacacaattgtacatatttatggggtacatgtgatatttccatgcacgtatgcaatgtataatgatcaaatcgggataattaggatattcatcacctcaaacatttggcattttttttgtgctggaaacatttttttttttttaatttaaaaaaaattttttttttgagacggagtctcgctctgtcgcccaggctggagtgcagtgcccatctcggctcactgcaagctacgcctcccgggttcatgccattctcctgcctcagcctcccaagtagttggcactacaggcgcccgccaccacgcccggctgattttttgtatttttttagtagggacggggtttcaccgtgttagtcaggatggtcttgatcgcctgacctcgtgatccgcctgcctcggcctcccaaagtgctggtattacaggcatgagccaccgcgcccggccttatgctagaaacattttgaatctccttttctggctattttgaaacatacaattaattactgataactatagccaccctagtgttctatcaaacatgagaatttattccttctctcccccacaccaccccatgcccccaactgggcaccaccttctcagcctctggtaaccatcattctactacccccttttttttgtttttttttttttgttttttttgagacggagtttcgctctgtcgcccgggctggagtgcagtggcgcgatctcggctcactggaagctccgcctcccaggttcatgccatgctcctgcctcagcctcctgagtagctgggaccacaggtgcccgccaccacgcctggccaattttttatgtgtttttagtagagacagtgtttcaccgtgttagccaggtgatccgcccccctcggcttcccaaagtgctggtattacaggcgtgagccactgtgcccggccgagatccacttttttaggctcctacagatgagtgagaacatgcaatattaaataagcaatttaagtccctgttgagggcatattgagaatcctctcaatactcagtcatggtggttccctttcatgcccagatggcccttaactaaagattaagcaaagaattaggccccataaatgccaataatgattatagttttagtttcttagacattcctttgctgacaatttagtaacctttttattttagagaagatttctaagatactgtgaagcgttgaagaaaaagtatggcctggccaagatggtgaaaccctgtctctactaaaaacacaaaaattagccaggcatggtagcaggcccctgtaatcccagctactcgggaggctgaggcaggtacttggttgatcccgggaggcggaggttgcagtgagccgagatcatgccactgcactccagcctgggcaacagagcgagactctgtctcaaaaagaaaaaagaaagagtatgatagaaatgccaaaatagtaccaaaatatagttaatcttgtatgggataatgaatgagtaaacagtttaaggatcttatcttaggagtgaaccatatttatatttacatatacgtgtatgtatgtgtacatgtgaaccatatttatatttacatatatgtgtatgtatgtgtgcatgtgttatatgtgtgtgtacacagtatagagaaattaggcaaaagatgtgaaaacacggttacaaatcaaaattttaaataataatcttaaacaatgacataatttgaaagcttctgatatttgatgtctcagaacatagtgatgattcagtgtgaaaaggtctaaggtctagctacttttgagaaactcatgaagttttttttttttttttttgaaggcacacagcaagtttttaagaataatgaaagaagttgggaaaaatagaaataatgaagtgttaataaattctagtcaaaatgtaagatgccagtgaagatatttagaaaatttacttagtcactttgaaatgttgagaaacagagaaataaattttttttcccagctccctccccccactacaacaaattattcttaatgtaatttggatttatgtttgcttttttttttccacttaggaattagatacacttcaacaacaattggattcacagaacatgaaaaaagagagcctggaagcagtaagtataaaatcaaataagggttctcatactactcagctaaaaaagttaattcagccaagtatattaatataactaattcaactacatattgatctggcagcttactaataggagtttaatactttttcttcctattctggacccacaaagatcctagtatggtaagaaattagattcagttattgagtacctactatgtataaaacaaatcattccgccctacctaggacatgcaaaatccaatagcaattaaaaaaattatttttttagagacagagtctttctttgtcactcaggctagagtgcggtgacatgatcgtagctcactgtaaattcaagctcctgggctcaagcgatcctccctcctcaggttcccaagtagctaggacttcaggcaggaaccaccacacctggctaattttttttttactttttgtaaagacagggtctcgttatggctgatgtacagctcctggcctcaagcaatgctcctgccttggcttcccaatgtgctgggattacaggcatgaggcattgtgctcagcctctaatggcaatttaaagacacatacacaagagattataaaaacaaagaaagagggagagacatgagttcatctctttaaggatgtaaaaacttactttttttattcatttatttaaaacgctttatttcacaaaacaaaatgtgcatatggtttaaaaatagttgaacaagaggaaagtaaaaatgtctgtttttttttttttttttttttttttttagacagagtatcgctctgttgcccaggctggagtgcagtggtgcgatctcggctcactgcaagctccgcctcccaggttcacgccattctcctgcctcagcctccagagtagctgggactacaggcacccgccaccacacccagctaatttttttgtatttttagtagagatgggatttcactgtattagccaggatggtctcgatctcctgaccttgtgatccgcccacctcggcctcccaaagtgctgggattataggcgtgagccactgcgcccagccaaaatgtctgttttgtgtccttctttccagatagaactactggaaagacatttatcaagtgcttactgtatgcttttttgagctgtaaacacatatcagcatcatcttcatgtaatccccacaagagtcctaaatcccatcttggttttacagttgtggaaaacctcaagtggggttcctacgtgctatgctagctgcagctttcttttttcaccctaacattgtatctacagtgtctatttatatcagttcctagagaacctcctcattattttaaattgctacaatgtattatgttgtataattataacacagccttgtaaatgaacaggttgtttatagttttccgggattataaacaatactcctgtgaaagcatacattttatgcgaagttatatcataagattgaattctcacaatgggtcaaaaggtatacagtttaaaaatgttgtcagattgccaaattgccttcaaaaaggttgttccaacttttacttctagatgtaatgtatgtgaatgcttatttcccctgcattcactgacagcaaatattatctgacttttccagttttagctattttgataggtaaaaattactaccttatttgaattttcatttatttatgaataaagttgagtatctatttatatcatttttggccaatgaatttctttttctttgaactcctttttcatatttttggcgtttcagtatactgtctgtatctcaaatcttgcctccctttcctgatttcctgtggattcaggtagacatcatgatgacagtattaggaactgttgtagactgatagattgctgacaccctagcttgcaaaagaaatgagtattttgtaattaattcttttgagaatttgctattgaaaaagttatttaattaaaaatagtaaggtagttggctgggcgtggtggctcacgcctgtaatcccagcactttgggaggccaaggcaggcagatcacaaggtcaggagatcgagaccatccttgctaacgtggtgaaaacccgtctttactaaaaatacaaaaaattagtcgggcatggtggcaagcacctgtagtcccagctgctcgggaggctgaggcagaagaatggcatgaacccaggaggcagagcttgcagtgagccaagatcacgccactgcactccagcctgggcgacggagcaagattctgtctaaaaaaagtaaaaaaaaagcaggtagttttctgtgtctggttgtccatctataaagacacttaatttttatttccttggatctctggtgatggaaatacgcttaaagaaagaaggaccacatttagtattaatacaaccagcttgcagaattcctcatggttcttttttggagtgggtttgagagagtcaagtcttacttcacttggtgaatttggtttccataggaaaaatcataagctataaccttagatttactttttgtactgatgccgttcttctctgatgtcagtacatttatgcctaaaataacaagagttttaaaaatacacaatatgtgcaaattaagataacatgtcactaattctatttaacttttgccagatttctttctttttaaaaaaaaaaatttttttgagacagagtcttgctctgttgcccaggctaaagtgcagtggcacagtcttggctcactgcaacctccgccttctgagttcaagcaattctcctgcctcagcctcccgagtagtgggattacaagcgtgcatcaccatgcccggctaatttttgtatttttagtagagacagggtttcactgtgttggccaggctggtcttgaactcctgaccttgtgatccacccgccttggcctcccaaagtgctgagattacaggcgtgagctatcacgcccagcccagatttcttttatttatttgtttaggacttgttcttcaagaaaatacctgtcagatagtggtcaatcaactagtattttttgaatactttatgttcactgctgtacaacgtattaggtcatgcttattcagttcacaagagtggaaaaaatcaggtgaaggattaacatgagcttaagtcttccagaacaattttatcaagatgaaattcaaacaaatctataggattgttaggcaaaaaggagacgatactatgaaaaaggatagcataaaatatctgcatttcttctatgtctttttagcatggctttttttaatcttatctgatgcctaatctgttacttgaactgtatatataatccattgcttatggactttgaaaaattatctcgtctactcgttccttttttggaggttccttctttcatacttttagaagagaagaggttggccaggcacagtggctcacacctgtaatcccagcactttgggaggctgagatgggcggatcacgaggtcaggagttttgagaccagcatggccaacatggtgaaaccccatctctactaaaaatacaaaaattagctgggcgtggtggcaggcgcctataatcccagctacttgggaggctgaggcaggagaatcgcttgaacctgggaggcggagtttgcagtgagccaagatcgcaccactgcactccagcctgggtgaaagagcgaaattccatctcaaaaaagaaaaaaaaatgaggtcttcccttctaagaattttattttgttcaagttgtaggtccggtttcaaatgtcactgttaactcttatgtctttgttaactttgaaaagttatttacatgtcagatccttagttttctcatctgtaaaatagagatgatagtactatcttgtagagtatcactttggatagtagagatagcatataaataacatgtagtatagtgcctggcacagaacagatgctcagtaaacaagagtctcaaatgtcattttaatcatcaccaacaccattcctaccttttttttggtgttgttagctaataacatttttgtcacatccttatttttttctttgtgaaaggtgggatagtggtgagtacacagtaactgttatttcatgtgttcatttcctagtgctgctataatagaatatcacaaactgggtggcttaaaagaaacacaaattttctcacagttccagagcctggaagtctgaaatcacggtgtcagcagagccatgcttcctctgagactctagacagaatcttgctctgcttcttcctagcttctagtggtatccattagctcttgatattgcttgacttgcagctgcatcactccagtctttgcctgagtcataacatggtattctccctgtgtgtctctgttgtgtctgtactcttcttataaagggcaccatcatattggattagggcccacccctaatgaccatatcttaacttgactaaatatgcaaagagcttatttccaaataaaggtcaaattgacaggtttatgatgttaagactccagcttacctttttgagcagacacaattcaacccacaaaattgtgggaaaatatatgttatgacctatttagggaaaaatatcttctctccaaagatcacttctatggactttgaatcagacattgtgtttaaagttgtacatatgttttgacattgtctttatcctcccattggtagagttgtcctatacttattcaggtcttatatgtagaaaataaaataaactaaggctatcaacttcttgtgaatcttagactgaaaatagcaggatttatttttattcttccaatttaggaatgtgctttgtagcattattgagtactaatgatatttgctgtctgtatttaaagatgctagtagtttaaatttacccccattcttataaactgaaacctattttagaataattattgataaaatactaattaaaactttcccttcttattttcctttaggaaatagctcactcccaggtgaaacaggaggcggtattgctgcatgaaaaactttatgagttggagtcccatcgagatcaaatgattgcagaagacaaaagcataggatctccaatggaagagagagagaaattacttaagcaggtgggcaaaacaaacatacttattttaagatgtctggttttggtacatgtattgatttgttttttttaaagggatattaatgcaagtagtaaagctagtaagtgtattgtctaaaaatagtttatgtgaagaaatgactttttaatctagattttcttcctcttttattattattattattattatttttgatgtaggatcttgctctgtaacccaggctggagcacagtggtgcaatcatagctcactgtagccctgagctgctggcctcaagtgatcctccacctcagcctcccgagtagctgggactgcaggcatgtgccaacacaccaattttttatttttattttttgtagagatagggttttactgtgttgcctgggctggtctccagctcctggcctcaagcagtcctcccatttcagcctctccaagtgttgggactataggcacccagcctagattttcttaatcaagtatttcatagtaacttaggtgaagctaacttttccttattaggaatacttgaaactcttctttattggtcattaaatatttagataatctttttgaagatatgtttcattattgttttgggccttgtatttagaaaatggagtatcccaaggctaatgactttttgtggttgttattatcagtgcctccatgaagagaatggaattaaaatgtcctgtgaaattatcgtatgtcctaaagtcatgacacatgtaacatgtatttagtagctttcttactaccccaggggtggatttagtttagctccaaattataattagcatgttgtttatcctgacacatcctaactataagggccttaggagaacttcatatgtatatgggcacagctccagtcagggactcctttgcccttagacttagatcaagcccagtgcatttagaagaaatgtaggtatcaattcagggactatttaattattagaatcatttcaaaaaggtattaaatctagaacctgtgtagttccttggagagaaatcattgaaagatggggaggagtgatcttgaggtacgcctaccacataaaatatagaatggctgcttaaatttgaatttcagataagcaataaataatctttcagatatatatatgtatatggaaaaattatttattgcttgtcaatgatatggatattccaaatattacatggtacatatatcctctcaaaggtattcactatttatctgaaattcagatttaactgggcttgctcaatctagcaaccctaccttgtgggaaactgaggggaatctcagaaatcctagatgtttatatcaacttatccaggcctgaagatgagctatcctcatggtgcctggagggtagctgtgagtatatcagttactacccttactttgaggaaaaaggatggaatctgtgaatggttccttggtgctgttccctttaacttcaaaggttgaaatctaaaaaatagatttcaagaaagagagtagatttgacactttagtacaattgtactctagaaggaaattatctttaagatagccttacaatgagttatttttttaaatactactttctttttatgcctttgtagattaaagatgataatcaggaaatagccagcatggaaagacagtaagtatctttatactaggacattttacatccatttctcactttaaaaattacattctaaaggtacaggagtggctttcattctttcaattttacttatagctttaaatatttctttgagtgtttaagagccattgcatagtataatttttttataagtatctttattaagatatactttataccatataatagacatatttaatgtaaacaatttaaaacattttagtatattcacagaagtgtgcagccatcacctagatcacctttatttttcaatttttatttatttttatctttttgagaccaggtctcattctgctgcccagactggagtgcaagtggcatgatatagctcactgtaacctcaaactcctgggctcaaacctcccaagtagccaggactacaggcacacaccaccatatctggctaatttatttttatttttagtagagtcgagatcttgctatgtggcccaggctagtctccagctcctagcctcaagtgatcctcccatctcagcttcccaaagagctgggattaaagatgtgagccagtatgccatgcccccagtcaattttagaactattcagtcagcccaataaaaccctgcaccctttaaccatcacctcccttatccctctcccagctctagccatgcccattctggacatttcatatatatggaatcattcaatatgtgcttctgtgtgtcaggatgctttcacttagcacagtgagccttgctttctcgaagatcagctgactattggtatttggctttatttctgggttctctgttctgttccaaggctcataggtgagccttgaaaactaagacaaatggaatattatttggaaataaaaattaataaaatactaagcatgtattagtttttattaatactaatacatgcttagtattttattaatttttatttccaaatagtattccattgtatggatataccatattttatttatttatcaattaatggatgtatgggctgttaccatttttttattatcatgagtcatgctcctataaacatccatgtacaagtttttgtgtgggcatatgttttcacttctcttgtatatatacctaggagtggaattgctgactcatgactatgtttaactttttgaagaactaccagactgttttccaaaacagctttaccattttacatttcatttatttgtatttgaatacatttatttgaaatttgtaaaacaatcattttactaccagtcaccagaaagcataccaattgttttaatttaatttttttttttttttctgatacagagtcccagtttgtcgcccaggctggaatgcagtggtgcaatcttggctcactgcaacctccacatcctgggttcaagggattctcatgcctcagcctcccgagtagctgggactacaggcacacagcaccatacccggctaagattgttttaattttaatcaactaagttgtaaattaataagtagtcaacaatgacgaaattgccttttaatgtctctcatattctattgtaatgtttttgttgctgattacaacttatgaaattaaattttggaatcacagtctctagtatcagctgaattgcagcccgtgtcaagtgttttgcaatactggctaaggtactaagaaactaattttttttttctgttttttgtaactgtaagcaaatttctatattcttatggctaagagaatatttttttcttttaggaacatttaaagcagctttattttatcttttttatttcttttttttttttttctttttttttgagacagagtctccctctgttgcccaggctggggtgcagcagcccaatctcggctcactgcaagctcctcctcccaggttcatgccattctcctgcctcagcctccccagtagctgggactacaggcgcccgccactgcgcctggctaattttttgtatttttagtagagacggggtttcactgtgttagccaggatggtctcgatctcctgacctcgtgatctgcccgcctcggcctcccaaagtgctgggtttacaggcgtgacctaccgcgcctggcctatcttttttacttcagtagtttttggggaacaggtggtatttggttacatggataatttcttgagtggtgatttctgagattttgatgcatccatcaaccaagcagtgtccactctacccactgtgtagtgttttatccctcacccacctctcactcttcccaccaagtccccggagtccattgtatcattcttatgcctttacgtcctcatagcttagctcccacttataaatgagaacatacaatgtttggttttccattcctgagtttcttcacttagaataactgtctccaactctgtctaggttgctgtgaatgccattattttgttcctttttatggctgagtagaataaacatatatatatgtatgtatatgtataaatatatatgtatgtatatgtataaatatatacgcacacacacatacataccacattttctttattcacttgttgattgttggctttttggctgtttccatatttttccagttgcaaattgtactgctgtcaacatgcgtgtgcaagtgtcttttcatataatgacttctatttcctctggatagatacctcgtagtgggatcgctagatcaaatggtagacctacttttagttctttaaggaatctccatactgttttccatagtggttgtactactttatatttccacaagcagtgtaaaagtgttcccttttcaccacatccacaccaacatctatttttaaaaattttttaattatggccattcttgcaggagtaaggtggtattgcattgtggttttgatttgcatttccctgataatgatgttgagcatcatttcctatgattgttgaccatttgtatatcttcttttgagagtcatctattcatgtccttagcccacttttcacttttttatgggatttttttttcttgctgatttgtttgaacttgttgtagattctagatattagccctttgtcagatgcacagtttaggaaagttttctccaactctgtgggttgtctattaactctgctgattcttttgtggtgcagaagttttttagtttaattaagtcccatctatttatctttgtttttgttgcatttgcttttaggttctttcagttcatgaagtctttgcttatgccgatgtctagaagagtttttctgatgttatcttctagaatttgtatgggtttaggtcttagatttaagtctctgattcaccttgaattgatttttgtataagatgagagatgaggatccagtttcattctcctacttgtggcttgccaattatcccagcaccatttgttgaatagggtgtcctttccccaccttatgttttttttgctttttcgaagatcagctgactgtcagtatttggttttatttctgggttctctattctgtgccattggtccatgtacatgtttttatgccaatacaatactgttttggtgacctcatagtccttatagtgtagtttgaagttggttaatgtgatgtctccagctttgttctttttgcttagtcttgctttggctatgcaggctcgctttgggttccatatgaattttggatttttttttctagttctgtgaagaatgatgatggtgaaatgggaattgcattgaacttgtagattgcttttggcagtatggtcattttcacaatattgattctagccatccatgagcatggaatatgtttccatttgtttttgtcatctatgatttctttcggcagtgttttgtagttttccttgtagaggtctttcaccttttgggttaggcatattcccaagtattgtattgtattatattttgttttattttattttattttcacagctgttgtgaaaggagttgagttcttgatttcttttttttttttttgagacagcgtcttgctctgtcgcccaggctggtgtgtagtggcgcaatcttggctcactgcaacctccgcctcccgggttcaagcaattcttctgcctcagcctcccgagtagctgggactaaaggcacgtgccaccacaccggctacttttttgtatttttagtagagacggggtttcactgtgttagccaggatggtcttgacctgaccttgtgatctgcctacctcggcctcccaaagtgctgggattacaggcatgagccaccgcgcccgaccgagttcttgatttcttttcagcttggttgctgttggtatatagcggtgctactgatttgtgtacattgattttgtgtcctgaaactactgaatttatttataagatctaggagttttctggttgagtcttcagggtttcctagttatatgatcatatcaagagcagacagtgacagtttgacttcctctttactgatgtagatgccctttattcatttcttttttctgattgctctagctaggacttctagtgctgtgttgaatagaagtggtgagagtgggcatccttgtcttgttccagttcttagggggaatgctttcaactttcccctgttcagtataatgttggctgtgggtttgtcatagatagcttttattaccttaagatatgtctcttctgtgctgattttgctgagggttttaatcataaaaggatgctggattttgtcaaatgctttttctgcatctattgagatgatcatatgagttttgtttttaattccgtttatgtggtgtatcacgtttattgacttgtgtatgttcactcatccctgcatctctgctataaaacccacttgatcatggaggatctttttgatatgctgctggatttggttggctaatttttttttgaggatttttgcctctaagttcattagggatgttggtccatagttttcttttttttgttatgttcattcctggttttggtattagggtgatactggcttcatagaatgatttaaggaagattccctctttctctatcttttggaatagtttcagtaagatcagcagcagaggctgccatctcccccattgaacataacttctttggcctgaaaccaccccttccatcacccacattggccatagccagccccatacaagaggagtctgagctgagacacgcctaaccctgccccgacctgatggtctttctctacccgcctcgtagccaaagacaaaagacataaacttgtggcaggcctatggcctcaccaatcacctgagaaacccaaatatttattcaggtgaccttagggcaagcttgtatccccccatactactgcagctgatgccctcttgaaagtgccacctcctagctggaggccaaccaacacaaaccattacagcaattcataacagaacaatcctgctccaagggaaggagaaaacaacagctaattccactgcctgtaacatccacactaaccagaggccctgactctgttcacatgacagcttcactgccagcataaccagcattcaagaaaaccagtgcacgaaacaaaactacaaccaagaactctcacagaatccacttcactcttcagctacctccaccagagcaggtgctggtatccacagctgagaccctaaagacagatcacttcgcaggactcttcgcagaccctcccaagtacaagcccagagcccggtagctctggtgggtggctagacccagaacagcaataacaatcactgcagtctggctctcaggaagccccatctctagggaaagggagagagcaccacatcaagggatcacctcatgggacaaacgaatctgaacagcagtccttgagtctcagatctttcttctgtcatagtctacccaaatgagaaggaaccagtaaaacaattctggtaatatgagaagacaaggttctgtaacatccccagaagatcacactagtaccagcagtggatccaaaccaagaagaaatctctgaattgacagaaaaagaattcagaaggtcagttattaagttactgaaggagccagcagagaaaggtgaaaaccaacttaaagaaatttaaaatacaggatatggatgaaaaaaatctccagagaaatatgtagcataaataaaaaaacagtcacaacttctggaaatgaaagacacactttgagaaatgcaaaatacattggaaagtttcaacgatagaatcaaacaagcagaagaaagaacttcagagctctaagacaaggctttcagaataacccaatccaacaaagaccaaaaaagaattaaaaaaaaaaaaaagcacaaaggctccaaacagtttgagattctgttaaatggccaaacctaagaataatgggtgttcctgaggaagaagacaaacctgtaagtttggaaaatgtatttgagggaataatcaaggaaaacttccctggccttgctagagatgtagacatccaaatataagaatgtcatggctgagcacggtggctcacacctgtaatcccagcactttgggaggccgaggtgggcggaacatgaggtcaggagttcaagagcagcctggccaataaggtaaaaccttgtctctactaaaaatacaaaaatccgctgggcatggtggcacgcacctgtagtcccagcaacttgggaggctaaggcagaaaaatcacttgaacctgggaggtggaggttgcagtgagctaagatcatgccactgcattccatcctgggtgacagagtgagactccatctccaaaaaaaaaaaaaaaaaaaagaaaagaaaagaaagaatgtcaaagattacaactgggaaatgcatcacaaaaagatcatcacttaggcatagtcataagattatctaaagtcaagacagaggaaagaatcttaagagctatgaggcaaaagcatcaggtaacctataaaggaaaacctatcagatcaatagcagatttcttagcagaaaccctacaagctagaaggaattggagtcctacctttagactccttaaaataattatcagccaagaattttgtatccattgaaactaagcttcataaatgaagcaaagataaagtcattttcagagaaatgctgagagaattcaccactaccaaggcagcactacaagagcagttaaagggagttctaaatcttgaaacaaaacctcaaaatacaccaaagtagaaactccttaaatcataaatctcacagggcctataaaacaacacaatggaaatgaaaaactaaggtattcaggcaataactagcacaatgaatagaacaataccacatatctcaatactaacattgaatataaacagcccaaatgctccacttaaatatacagaataacggaatggataagaattcaccaaccaagtatctcccatcttcaagtgactcacctaatgcataaggtctcacataaacttaaggtaaaagggtggaaaaagttattccatgcaaatggtcccaaaagcaagtaggagtagctattcttatattagacaaaacagactttaacaacaattgaaaaagacaaagaaggacattatgtaatgataaaaggactaatcaaacaggaaaatatcacagtactaaatctatatgcacctaacactagagctcccaaatgtaaaaaacaattaccactagacctaacaaatgagatagacagcaatacaattaatagtgggggacttcaatactccattgacagcactagacgggtcagaaagtcaacaaagaaacaatggatttaaattataccctagaacaaatggactcaacagatatttatagaacattctacccaacaactgcagaatatacattctgttcatcagcacatgggacgtcctgcaagacagaccatatgataggccacaaaacaagtctcaataaatttaagaaaatcaaaattatatcaagtattctcagaccacagtggaataaaactggaaatcaactccaaaaggaaccttaaaaaccatgcagatacatggaaattaaataatttgctcctgaatgatctttaggtcaacaatgaaatcaagatggaaatttaaaaattctttgaactgaacaataataatgacacaacctattaaaacctctgggatacagcaaaagcagtgcctagaggaacattcagagcattaagtgcctacatcaaaaagtctgaaagaacacaaatagacaatctaacgttacacctcaaggaactagagcaacaagcacaaacaaaacccaaacccaccaaaagaaaaggaaattacaaacatcagagcagaactaaattaaattgaaacaaaaaattgaaagataaatgaagcaaaaagctggttctttgaaaagataaacaaaattgatagaccaatagcaagattaatcaagaaaagaagagaaaagatccaaataagctcaattagaaacaaaatgggagatactacaaccaataccacagaaatacaaaagaccaagcttacagtgagcacctttacacgcacaaactagaaaacttagaggagacggatagattcctggaaatatacaatcctagattaaagtaggaagaaatagaaactctgaacagaccattaacgagcagtgagattgaaatggttaaaaaaaaaaaattgccaacaaaaagtccaggaccagatggagccacagctgaattctatcagactttcaaagaattggtactgttttacatttctatgtaatataataagagcagcatatgagcagcatgtgagggttccagtttttcacatcctcacttgttattatctctttttctattatagccattcctaatgggtatgaagcggtgtctcactatggttttgatttgtatttgtttgatggctaatgatgttgaggttcctttcatatgcttattggccatattctttgggggaaatgtttacttagttcatttgctcattttttaaactagattgtttttgattactgagttgtaacatttccttatatatgctagatagaggtgtcatcagatacatgatttgtaaaaattttcccttgttctatgaattctatgaattatcttttcattttcttggtgtctttggaagcataaaagtttccaattttgattttgtccagtttttctatttttcttttgttgctcttgcttttagtgtcatatctaagaaaccaatgcctaatccaaggtcataaagactatgtctatgttttcttctaagagtttggtaatttagttcttacattgagatctttgatccatttcaagttaattctgtgtatgatgtgaggtaggagtcccttagcttctgcatatgcacttttcccagcaccatttattgaaaatactcttctttccccatttaattaccttagcacccttatcaaaaatcggttagctatagatatatggtcatatttctggactcacaattttagtccattgatatatatgtctatccctatgcctatactacattgttttgttatggtagctttagagtaagtataactgctttatgttaaaatattaacctatataatcttctgccagtggtaggttttcccttattttctcatttttgagactaattttccaacttaatttggcttatagaaacctacaaaaagtattgttaaatatttttcattttcttaatactgcaaatcaaactcaaaggaaagttgggagggggtgtgctgtttaactcaggcaactagtgttctcagaatatacctgggctccaaatatgaatcagtaaaaaagatctatgcttggcgcagtggctcgcgcctgtaatcccagcactttgggaggctgaggcaggtggatctcgaggtcaagagatcgagaccatcatggccaacatggtgaaaccccgtctctactaaaaatacaaaaattagctgggcatggaggcgcgtgcctctagtcccagctattcgggaggctgaggcaggagaatcgctttttcccgggaggcagagattgcagtgagccgagatcgcaccactgaacttcagcctggtggcagagcgagaccccgtctcaaagaaaaaaaaaaaaagatctagacaagattcttcctctctaaatttatagtattgtcctcataataggatatgctatttttcgatatttatgcaatttgtaaaagatatcctaatgtcatcgtcagttatagtattgtccttagaataagacatattatttttagatattgtttatgcaacttggaaaagatatctaacctccccatcaattgtttttattgaatgtctatatttccttcataaattcattaaaaatattttcaacaggttaacagatacaaaagaaaagataaatcagtttattgaagaaattagacaacttgacatggatttagaggaacaccaaggtatgcttctggtatttttataatgtagattaacagatgtttagcagtattaatatagtgttaactggtgtctcagagactgttcaactacctgggatttattatttaattctctatgatattactaactttactaaaatatatactgtatgagtaatattaaagcaatgatttaaactgaccacttatgagttaaaatgattgcataaaatttatttagctttgccaagcagtttgtttttttttttacaaaaacagaagtaaaatgtttaaagttgttagagattcctaagttatacttcctcctaagttacacttccttcctagtaatagtcaatagtttactataaacaatatagtcggccgggtgtggtggctcacgcctgtaatcccagcattttgggaagctgaggcgggcagatcatcggaggtcgggagttcgagaccagcctgaccaacatggagaaaccacatctctactaaaaatacaaaaattagccgggcgtggtggcacaggcctgtaatcccagctattcggaaaggctgaggcaggagaatcacttgaactcggaggcagaggttgcggtgagtcaagatcgcaccactgcactccatcctgggccacaagagtgaaactcggtctcaataaataaataaattaattaaataataataatatagtcaactactaatggcagtaactggtagcgttagaggggatgaaaatcaaatcacaaataccacacaaataatccagacagaattaattccccacccaggtctagtaatgaagtagcaaagactgattaaccttatcctccccaactttccccaggagtggaatttgaagaactaatgcaggtaccagaacacctgagggagcttggggtttgactatgtagaaatactgtggtgggggtttgggtgtgggggctacattgttatttatggttaaaggaggaggttgagcatcagtttcctaacaagcttctccctaataagaaagataaaagtagattctccatagcattttaatcatagtttaactgcaaaccagttactatgctcttggattatcaagaattgattgtatattcttatgagttaggtatggtataaacagtgtgcacatgtacatgtattcttgttatggctaaggaaacattcatagcggtgcagtggctcaatcacagctcactgcaacctcagactcttgggttcaagtgatcctcctgtctcagcctcctgagtagctgggaatatataacgtctgccactacatccagctaagttttaaatttttagtagtggcgcatgcctgtaatctcagctacttgggaggctgaggcaggagaatggcttgaacccaggaggcggaggttgcagtgagccaagatcacaccactgcactccagcctgggtgacagagcaagactccgtctcaaaaaaaaaaaaaaaaaagggtacactgttctatattttagcagggaaggaatttgtgtatgtgtgtgctaactagaaacaatgagaaatagctctaatgaaagttatatggtcagaatttggctacaagctctgcatcattagtaaagcggagtattattggcagatgtcatgctactttccaaaaagcctgaacccatcctgatttctcctttcttagttgaaatgccaacaattgcatatttgcttaattattgctttttaaaatattggctctgtataagcaagggaaagtaatagaaaaagtattgttcttccaagtaaagcagaacacaccaagtggacaatagcagcttatattttcactcaacatgggatactatttttaataaggatgtttttatcctcaaggcttacttctaacatatagccaagtgacttttttgtttttaaatggagatgaatcttgctgtgttggccaggctagagtgcagtgactatttacaggcatgatcatagcttactgtggccttgaactcctgggctcaagcagtcctactgcctcagccttccaagtagccgggactacaggtccatgttactgtgcccagcttgtttttgttaaggaatctgttaagaaattcttttaggtcgtgtgcggtggctcacgcctgtagtcccagcactttgggatgccgaggtgggcggatcaccaggtcaggagatcgagaccacggtgaaaccctgtctctactaaaaaatacaaaaaattagccgggcctggtggtgggcgcctgtagtcccagctactcaggaggctgaggcaggagaatggtgtgaacccaggaggcggaacttgcagtgagccaagatcgcgcctctatgctccagcctgggtgacagagcgagactccgtcttaaaaaaaaaaaagaaattcttttattcttactacagattaatacttgagagtttatatcttatattgaagtccttcagagtaaatagtttcttcgaccacttagctgaaatcaggcccttaactttactcatttttttttttttttttaatgagatagggtctttctgtcacccaggctggagtacagtggtgtgacaacatagctcactgcagcctcaaactcctgggctcaagtgatcctcttgccttagctaaataaaataataaataaaataaaataaaataaaataaaataaaataaaataaaataaaataaataaaataaaatgtaaaataaaataaaataaaatgtaaaataaactcctgagtagctaggactacaggtgcacaccaccatgcccagctaattgttgaaaactttttttgtagggacagggttttgctctgttgcccaggctgatctcaacgtgcttggctctagcagtctttctgccttggcctcctaaagtgtggggattacaggtgtgagccactgtgcctggtgttttactctttactagtgtattcccttacattgaataaattctataaagaacagcattactattataagacatgtcaaagccttacacaaatcacaaaaaaagtgatcagttttctatgcaaaaatactgagccttttgaaatcagggtagttctcagcttcacccaatgctggcttagatttcaactttctcaagtctgctaggtcagttaccagttctccatctcctttcagcttccaaaatgttattgctgttgtctcctatttctatatgctgggggtttctacctttaaaaattctttttgctatagttttagtggggtttgcgggaggatcaaaattagatgtgcatgttcaacgtgccattcataccaggaaatgacaattataagccttaattacctagaatttctgaaactttaagcaccttgaaggtagatcattttacttatttttaaaaagattttttttgtgtgttttgccttaaatgaccatcctcatgctttcattaactgggcaattagcctcagcttataggaggtcatccttttcagcttaaaaaaaaagtgtcctggccgggtgcagtggctcacgcctgtaatcccagcactttgggaggctgaggcaggcggatcatgaggtcaggagttcgagaccagcctgaccaacatggtgaaaccccatctctattaaaaatacaaaaattagctaggcatggtggtgtgtacctgtaatcccagctactcaggaggctgaagtaggagaatcgcttgaactcgggaggcagaggttgcagtaagccaagatcgcgccactgcactccagccttgggcgacagagcaagactccatctcaagaaaaaaaagaaaaaaaaaagtcttttaaactacttaaaattattttaaagattcagattaattttttaaaattgtaattttaaatatgaatctggcatgtatttaacatgaaaaatgcaagcagaaaagtatataaagtaaaatgtcatctcctttctcctcatccaagtcttcagaggtaatcatggtttacagtttaatgtttaggcttttagacttttaatacattgataaacatatttttaaatggagtaatactaatatacagttcttctgagcttgagtcttttcatttaactgtataatatacattcttccctatgaggatgtatacttcattctgagaaatggtatagcatagtggtcaatgttagggctctaaagtcagacttaagaatggtgcctggtacaggtgtggtggctcatgcctataatcctagcactttgggaggctgaggggggtggattgcttgagctcagaagttcgagaccagcctgggcaacagggcgaaaacctgtctctacaaaaaaatacaaaaattagccaggcatggtgatgtgtgtttgacttgtagtcccagctatttgctaaggtaggatgattacttgaacctcggaagtcgaggctgcagtaagccgaaatcactccaaccaaaatcatgccactgcacttcagcctggataacaaagtgagaccctgtctcaaaaaaaaaaaaaaaaaaaaatggtgcctggtgcacattaagcgcttctgacaaccattagctacccctatgattgttgttacataggattcattgtatccacattgatatttaggctgtttctaattttttactcccaagaacagtgctgcactagtacattcatgtttataacttgtctgtttatttccacagaataaatttctagaagtgaaattttgaatggaatattatttatatttacaactggtttgcaaatttcttcccagaaaaggttgtattatgttatacaaccaaaagcagtatgtgaaggtggttccttaccaatgctagccataagttttttagtttttgtcagtcaagataaggtacacatcactgacagttccgaagttttgactgttaggcctgaatttgtagtaccaccgcgatccacaagatggggctaattttctgagcatctattaatatatacacagtaggattgacaaatagagttaacaaatgttgtacggtcactgtcatatgtctctccaggagggattattgggcattattactcaccaaaaatgattactttccagattcaagtattttcccaaatgtggagttgattgtaaaaccaaatatatgattattaaaataccataatacatataaataactagttgctacaatgtggtaaatatgtcataatagaaatatatgcaaagtgctataggaatattgaattactgtcttaaattctgaatgaattcattgtaactttctgcataatatatatgtgtcattcaaagtagtaaaataacaaaatataatactttggtttgtctatagtatactttttcatactcagagttctaaagccttggttaggaccattgtttctttaattatggagggtaaaataaacaatgttaaagacagaatacttttatttattatttatttgtttatttatttatgtattttgagacggagtttttctcttgtggcccaggctggagtaaaatggtgtgatcttgacttaccgcaacctccacctctcaggttcaaacaattctcctacctcagcctcccaagtagctgggattacaggcatgcgccaccacacctggctaattttttgtatttttagtagagatggggtttctccatgttggtcaggctggtctcaaactcctgacctcaggtgatctgcctgccttggcctcccaaagtgttgggattacaggcgtgagccaccacgcctggccagaatcattttattttaagcacatgtcctgttactagaatgcctggattcaaatccaggctgtgctgtttgatcttggacatgctatttatgctatttaatcttactttatcttagttttttttctttaaaatggaggtaattacagtacctacctcttagggttattgtgagaattagattagataattaaataaacttaattattaatagtctaatgttggctggaagccttaccaataacataaatggtaaacatatataaacacaaaacacattcataatagcagtcaatttaaaatatgctcataaatattaattagtgacttattgttaatgctgttactttataaaagcaaaattgaataactttactgcagttattttcccaaagcatacattagaaagtattttcccgtcagtatttccttcaggatgtacaaaataacctatttagtttcaaagtggtttatcttctggtatctgagatttcaaatggcatctatccattactattctgtggttttccaacatatatctgctgaagaagaatgaattattattgttcaatctagaaattgtttaaactatacattgaatctttcattaaaatggtggtattacatctacaccaggatcatcaccaccatctgaaacttgttagaaatgcaaattcttgggctctaccccagacctattgaatttgaaaccctaaggagagggctcagcaatttgtgtttcagtaagtcctcctggtgattctgattcatgttaaagttttataaccactactttcgaaaatgattaaggaccatatgtttagtatatgctgcttactaccaattatactgtatgattttatatacagtactctgttggaacaaacttctacatagtccttttgttttacataattagataataaaaattatacaatttatacaatatgtaaaaattataattacagtttttaaagtgcctcctgtctttagaaatagaattatctgatcttgtttgcatacctgtaatttaaaatttaaaatgtagttgacccttcaagacagcattgggattaggggcactgagtgtgccatgcagtcaaaaatccatgtataacttttgactccataaaaacttaattatcaaaggtctactgttggctggaagccttaccaataacataaacagttaacactattttgtatgtattatatactgtattcttacaataaagtaagctagagaaaagaaaatgttattaagagaactataaagatttttattattttccacttactaatgaaatggaagtaggtcattataaaggtcttcatcctcattgtcttcacattgagtagactgaggaagaggaggaagagtttggtcttgctatctcaggggtagcagaggcagaagaaaatctgcatgtaagtagacccaccaagttcaaacctctgtttttcaagggtcaactgtatttcccagagaatgtatatttagaaaattgggtgaaacctaatgccaaagttagtttaaaacattaagcttatatgtactctttttaccacagcaattttgtaatatagtcaattctttgtacccacgggttcttcatctgcagatcctaccaactatggatggaaaatacttgaaaaaaatacaggaagtttcaaaaagcaagtttgaacctgccatgtgctaagcactatgctgaatccatttgaactgaagaataccctgctatagcctcccattgtttcacagatcttcagtctctctctagcacccactgtttgagcagtgttcatctggcattttattcattggctacttgtgttcactctttgcttctgtgaaaaaaaaaagactcctaaaaatcaattatatggtgaaagaaatcccttacagactaagagagagcgtaaagtgctgtctctcaacaagaaaataaaattcttagatcttttgaaaagtggcgtgtgatttaccaaagtgacacaataaaacagaaggaagctgaagctgacatttgtggaagttttagtgctgcccctacaatggcaaaaaaaattattgctgtgattcatgataaaatgcttgcagagactggtcgggcacagtggctcacgcctgtaatcccagcactttgggaggctgaggcgggtgaattacctgaggtcaggattcaggaccagcctggcccaaatggtgaaaccccgtctctactaaaaaatacaaaaacttagccggtagtggtggtgggcacctgtaatcccagctactagggaggctgagacaggagaattgattgaacctgggaggcagaggttgcagtgagccaagatcgtgccattgcactccagcctgggcagcaagagtgaaatcccatctcaaaaaaaaaaaaaaaaaaagcttgcagagactaagaaaacatcaaatgtatgagtagacaaaatatcacagaagcatgtccctgttgatggcaaaattatgtatgaaaaagcatttagcctttgtgagcattcctatgaggaagttgaagagagtgagaggaaggaatttaaggatagtaagggatgactagctagctgtggaaagtagtacagccacacgaacttaaagatcacaggagaatcagcattagctgatgaccaggcagtatcagcattcccagaagagctcaagaaactcagaagacaaaggatacctttcatagcaagtcttcagttgtgttgaaagaaacttgttatagaagaagaggcctaatacctacatccgtaagagtgtcaagcaggctttggggttcaaagcctggaaagatcgttttactctggtgctatgtggcaacacagcaggttacatggtcaagccaggtcttgtgtaccaagcaaacagtccctgggtccttaagaacaaaatcaaaaattgcctacctgtgttctggcaacacaataggaaggcttgggtgatggccatcttgttcctggaattcagttttattcctaaaatgaagaaatacctggaagagaacagggtgccattcaaggtcatcctcataattgacattactcacagccatccctgatctctctacttcactaatgacaatgttgcagtgatgttcttgcctaaggcaagtactacctcactgttttagccatttgatcgaggcatcagcaagtgcattaaatgacttacacccacctcacctttgggaggatttgtgctgtccttgatgctaaccttgactacagtgtcatggatttatggaagagctttacaattgcaaatgtagttgtgctttttacagaggctgtagatgccccaaagcccaagacagtcagtgcatgttggaagccattatggaatgaggtagtcagtgatttcaggagcttccccattattggtgcagaagtcaggaatatggttttgtttttgtttttgttttttttgagttagagtctcactctgtcacccaggctggagtgcaatggcgcgattttagctcactgcaacctctgcctcctgggttcaagcagttctcacgcctcagcctcctgagtagctggaattacaggcacatgccaccacgcctggctaatttttgtatttttagtagagatgggtttcaccatattgcccaggctgctctcttggccaggctggtctcaaactcctgacctcgtggtccgcctgtcttggcctcccaaagtgctgggattacaggcgtgagcccaccgcgcccggcccaggaatatcttgaatgttgcaaaggaagttgatgaggaatgcttctctgacatgatcaagggtgacttcgaggaacacatagaagagcatagagaaacccttaccaacaaggaactcaaggttctgctgaaattctctacaggagatgatgacagtgataacagatttagcagaaacagagtcctcaatttggatacttgaaaaatttgcagcagtttttcaacaggtgcaagtgttaaagggtatgatccttcagtggaacaaagcctccgtgtcacctgagggatagcaacatgcctacaagcactgcaagagttgtttgatgcttcaagaaaaaaggagaaacagcttcctagaacaatgttcccaactaaagccgtctgtattatgaagcctcgaccttaaacgcttgaagattcttccagcataaatgatctttccgatgtcctgttagaaggttcaagttagccttgtgtttcaccacttacctacagtgctgcgcatctcaccacctcaccatatgggcaccatgggcaccaaatagaaattataatcgtcatcatcgtcaaatgagggttatcaagagagaaaagcgacagtttatgcttctttttttttaatttttaaattttttgtaaagacaggattcactattttgcccaggctcgtctcgaactcgcagcctcaagcagtcctcttatcttggcctcccaaagtattgggatcataggtgtgagccactgtgctcagccagaagagccagagttttgatgcgtcttaatgtactctttcaggtcattaaatgaaagtcatctgcaagtgttgatagaaaatgtggctgggcgtggtggctcatgcctgtaattccaacactgtgggaggctgaggcaggaggatttcttgaggtcaggagcttgaaatcagcctggacaacatagaccccatttctatttttaaaataaaaataaaacaaaaagtgttacattgttgctgatgtatactgtgtagtttgccctacagtggttgcatctgtactgaacatgtacagtcttattttccttgtcattattccctagacaacacagtgtaacaaccatttacaatatattaggtatcataagtaatctagggatgatttaaagtatgtagcaggagggtatatgtaggttatatgcaaatactgtgccattttatgtaaaagacttgaacatcctcaggttttgttatctacagaggggtgggggtactgaaaccagtccccatcagataccaaggaatgactattttatatactaacttgctgcttactgtaataatggtatgtgaaaagtagatgggagagatagactgaatgcaaaaagatggaattttataggcccccacaactaattaaaattgaaataggagtcagggaggagaaagtgttctggctcactaaaatatgtgaaaatgttagaaggggtttagataactcaatatgaattaatgtgatacagccttgaaaacggctgaaatcctagattgcataacaaaaaatggttatgtagactatggagagtgacatcttcttggaatcttaagtttcttggcataatatgttaaaagggttagagaaaaactagagctcgttcatagcagagtgaccagaatggtaatagggatagaaaccatgccatatagaagatattgaggccaggtgcagtggctcacgcctgtaatcccagcactctgggaggctgaagtggggggatcacttgaggtcagaagttcaagaccatcctggccaacatagtgaaaccctgtctctgctaaaaacaaaaattagctgggcatggtggcgtgtgcctgtagcctcagctagctgggaggctgaggtaggagaatcgcttgaacctgggaggcggaggttgcagctgagattgcaccattgcactccagcctgggcaacagaacgagacactgtctcaaaaaaaaaaaaaaaaaaaaaaagaaggaaaggtactgggagactttgcgtgcttcagaagtattccaagtgctaagaaacagtctggctgtgcaaaagtcctgtggagttttttcttgccccgtctccctgattttgttttctgttgacctttcaactccaaaatcagtaggctttgctgagttggggaccttgagttcaggagagttactagtacatgccttgttgtgtattgatcaggagagaagattgggatagccacctatttggaaaatggtaatcagaccttcttaggggcagaactacttctcagagtataaaagcctataaagcctgagtcaggagaacgtcatttgatgccagagaagtaaaagtatggggtgaacttcccttgcagtgaggacagaggtagttttggtggtgctcagactattggcagtgcaagaagagcatatctcccttactgcactgctggctatagcagagactataaaaaagcaatggtgtcctttctacagtagccccagtcttttgttaacagcacatacgcatttcttctttcctacttgagggatgaaaaagcctgaatttatagtatacatttttgtatacttgtcttattagagtataaattcttcagaggaaaatattttacttttttctttaatccccatgttacccgataaagtaccttgctggtataattcctgtgtaaaatcctcctgaagtcttttcacgcatctggttaccacagcacttcatacattcctgtcagagcacttatgttgcattataaatttttggttttgtacacctaatggagtgtaagccctttgagaatagggtggaaactgtcttactcagtttgatatcccaaaacctattacagtatctggcacttagtatctgataatcagtaaatttatcggaaataaataaatgagtatagaagtatgcgcacatcaaatgctccgaattaaaggatatctccaaaattaccttccttttaccgttgtgtccctttccctctcccttggtctcctcattgttgattctactacattagacccttctgcttacttgctggtacctccattgtgatacactgatttgcttccgtctatctacaatctcatcctgtcctgtgatattgaatctaaggatatatttgctaaaaaccattatgttttaccctaccttaggactgcctacatttacactgcctttatgagcaactcagatactaatcctccactgagaaatcaccaaatagagaagttcactaatgctctgaccactctccttcttagcaatagtgatattggaggaagttttatgaagcttgggaatctgctgagatgtgtaggagctctgtcccatctaatccagctggccagctgtacagctgtaaatgttaaccagttacatcttccagctcaatctgttggcaactaggaggatgacttttaggagagaaggagggaggagtctcctctcaggtttctgacttgaatgatgaatggatggtaaggacagccaaatgtaatagggaataaagagagggaagactatgagtttaattatgagtatactgagttaggatgtcctgaaagggcttccaaatcaatatatatagtaagcatttagattaaagaatctaaaactcagagaatatattaaatttgacagttcttaaaccacaagaatgtatgaaattgccatggatatagcgttagaagttcattaagaacagaactctagaatataaatgaagaaggaagcagacccatgaagagaagacagaaaaataatgatctgagagtaagaaacgccagagaagccctcccatccccgcaaaaagcaaaaataaaacatagaggaaaacaaagaaaattgaaaagttgtaccaatagtgtcaaatattacagagtaagataactgactgccgtttgaatttgatcattaagcagttgtataatctcactgagaacaatttcattggaacaggaggaggaaaagcctcattgcagtgtcttggggtttaaaagcaagatgagaaactggaaacatcatgtgtaggaattctcttaagattaaaagaaaaaagataagatgatagttaaatccttgtaaagtctaggatccaggcctccctcctaatcccttaatgcctgaccagtctcccaagagtggaacttaaatagccagaacaagaaactaggactttcttggaaacatgggccatggcaggttcaggagatagtagcttttctgccacttcacatgggcaatgatatttatatgcacatcttcctcctataagggtatcccagatcatgtgtgctgcaaactccaactctttctgtttcccactcaaaaacctgtctgtagtatattttacaaatgtgtgtatatatataaacacacacacatatacagacaaagtttgtttaataacagagtacctctggcctcctcttcacagttaatcagggggcgtcagtgtattttgagaccatggttgatcatttgaactgagtagtagttgagtaaagttgctaatccatctagagccttatctgagtggatccagggtttcctattggtgctgggtgtagcctggctaggaatttgtgaccattaggtatttactgtccttaaacattagctttcacttgcagctttttactaccagtaatattttggaagccttaacataagattttctcagcatcagggttgtcgtcaatgaatttcagaaaactcttcagaccagaaggcagaaaagctgtttgctaatccacgtctctgactttgccatcacccttgtgttctcataattcacttaatgccaagcaagtatatgcacagatggaggttcatgtctctgtctgctttctctacagaaggcagctgccatgttccttcaaagctcagtttttcttacagtgaaatcctattgtcataaaataatcatgatccactcctactaatgggtccctctgtgaggcctaaatggcagaattcattcatttttctaggccttggatttttgtctctttagacatgcttttcatgtttgttaaactcaacatatccaaaactgctgtaagcaactctttctcacctttttccccatttaggttagttgtactaccatcttctcagatgcccaagccagaagcctgggaatcatacttgattcctccctgtttaaccctcaccaagccaatcactctggctcttaaatgtcacaaataataattcactactttccatcccaattaccaccgctctactcaaggcagctttcatctttcacccagattatcctgacaactttctaactggttttattgcctccaatcttacttctcttttattctccagactggaaatatttttcaaaattgcaaacggattatttcatctccctggttaaaattctttagtaattgtccttaggagaaagtccaaactctttaacatggatcttataaggtgcttcgtaagctgcctcatctttgtgctactttttcacttcattctctgcctcggccataccactccctcagttctttatgctaccatattcatcctcagtttgaaactttttactggtaatgctttgacatttgcagtttctgtattttgaccaggtaactcctactattctttataatacaacttaaatattacttgtttagggaaactttctctgtaaccctaacctagattagttgcccttgctgtgtgctcctatagcatcttttatttttcctatgatagcagttagtaccttttaattttaattaattgttcaatctttagagtataaactctgtgagtgaagttactctgctgtcttgctggtgatctttcaaagatggaatggactttcttgggaacttatgtttctcagcacccatagtgttcatgtataggttgaatagccccaggttgggaatggaaagcctttaagtcctttccaatcatattgtttgttccacatattcaagttacatgcatatgtctacttgaaaagtctctataagtcattgtaaaagaatttcacctaatcgaacacgtcgaatagtcaatgactaatggcatagagagaaccaaagagagatttttaatttagagccctgtatgtgcaatttttgaaattcatgttgtattttatatctctcataggtgaaatgaaccagaaatacaaggagctaaagaaaagggaggaacatatggacagtaagtgatattcttgtagatataaaaatataatattttcagattgctgttcatttataccaaatcagagacctcattttgggcagatataatggctaataaatgcagaagtgtggacattcaaagcattttgccttgaagaatagtttctagcataatttagagatgggtagaaaattctaaaaagatatgtgatgagtgtctatacgttggggctagattctaaagctagtacttacattcgtagtctgtacagaggaaacctatagaccaggggtccccaatccccaggctgcagaccggtaggaaccaggccgcacaccaggaggtgagccactggcaagcgagcattaccgtctgagctctgcctcctgttagatcagcagcagcattagattctcatatgagtgtgaaccctatcgcgtatgagggatctaggttgtactcttgttatgagaatctaacccctgatgatctcaggtagaacagtttcatcccaaaaccatcacccgcatctgcccccagccctggtccatagaaaaattgtcttccatggtccctggtgccaaaatggttggggactgctgctatagatcatttattgattgaatgttctcttttacatgcttcactatattcacctttagtatctttcacttttatatttagctttccataatacttatctcattgtttattagccctcacatcagatattgtcacttttttctatcaccagctataattttagttgccttttgttagttttgattcacttaaaaaaaatctcagcctgattttataaattggttttcacttaaacctatacatttataatttttttaaaaaattggcatgtattctcaattactggtttccttttaagttatcattttgctggaatctgaattctagcgaagtgctagaatttcatctaggtctgatgtcaatagttaccttcatggaggcatgcaataaaagagtaattgtcacctcttattttacaatgtaccaagttttctttaaaatgtcagtaaataccaaaaattatctcaaaaatatttttttaagtcttttggtaaaggagaaaggtgtaaaatcaaggaacaatgtgtcatgacaccacagtattggaaattactagatactacctagtgtggtatctggcacttaggtgtcaataagtgttcatttaatgaatgtttactgaatgaatggaaagaattcctatactacagaatcttaaaatagaaggtcacctagctcagatttctttccacatattaattatggtttgttttccttaaaaaataacccctgaaagacaatgttcatttatgcctttgtatatgtaaaaatctcatatgtccacttaatgtgtgatcaacagattatagaagcaggatattcacacataagacctgtgtgaatgctgaagcaggacattaaagaaaattcagttttataaaaaatgttgattgtggtcctctaccaccatattcaaataaaaaatgttttgttgaagactgttttactttaaaaaatatgctaaatataagaaaaaagtataatgggaatccattacagaaggcaagctattgatgttattcatgctaacagtaaaattatttttgactgaaagtttctattttttagatgctccatagaaatactcgaaaatgtaaataagagctgtttctatattaaacaagtaaaaagataatttcctagaatatttatttacaatctgaatacattattaaattcatttagttgaaatgaatccagcattgtaaataaaatacttattttcagataaaatgggtattcagcattggaaattatagaaataaagttagtagtcagggtgttaataattattgatgtatcaaaggagatctttataaaagcaaatttcttctgattgtcattttatcagctatttcttttgagcttatatttataactttctgatttacttatatcaaggtcacaggatttaggcagtttgaaagtatataaagttcttattgaataataattacctttgggttaataacaaattaaacagtggcagcttaaaatttctaaaaattgggccaggtgccgtggctcaagcttataatcccagcactttgggaggccgaggcgggtggatcacgtggttaagagatcgagaccatcctggccaacatggtgaaaccctgtctctggtaaaaatacaaaaattagctgggcgtgatggtgcatgcctgtagtcccagctactcaggaggctgaggcaggagaatcccttgaacccagaggtggaggttgcagtgagccgagatcgtgccactgcactccagcctggcaacagagtgagactctgtctcaaaaaaagaaaattctaaaaagcactcttaagaactgcaaatcagagtttatatagtgttaactctatcagcagtaatctctcttatgttttccaattgtcagcttttattgagacttttgaggaaacaaagaatcaggaactgaaacgaaaggcacagatagaagccaacattgttgcactcttggagcactgcagtcgagtgagtaccatgtgcctgtcttggtgtcctctttatttttgccgtgattaactttccaaatacaactcaaaaaatagaacggctcactattgtatcttctcatttaactgcttcctttcaattcccttacttgttactatttatttcagctattaacttttttatcactctagcaaaatgtcaggtaattagggcaatagagaaaaaggatgacatgtataatatcaatattcagcagtaaatgaagcactaattcagagtaattattatgatcttcttccattgttaatctatctgaacttttgaaagtaacatttgcacagataatttcaaaatctagacatgttagaaaatgttaatgtatttttatactgtaaatttattgtaaataaaaagattcttgtatgtatatgtaatgagtatctcaaattatcaaaaaatgtttattgggcatctattatgaaatgcatgcccccctttcaatattctagtgttttaagactccaaccagtttctaaaatagtgtagttgaattttttctgcagtgaaataaaggaaatgaaaaaaaacccacaattttgaatttatagtctgtctttattgagaaaacccaatttggaatctcattttctatacaatatataacttgaatggtgtatttcaaaaaaaatacctgatccaaacatctcatcctttgacagtgttttccaagagttttattgagaactaactaaatcagtggatttttttctatttttatttctctgcaaatgcagaatataaatcgtatagaacagatatcctctatcaccaatcaagagctaaagatgatgcaggatgacctcaattttaaatctactgaagtgcagaaatcacaaagtacagctcagaatttgacttcaggtgagaaaacaacctagattttaatattctttttttttaaaatatatcaatgttattctctgattattttaaagcctcattgacagaggctataatttatgattgcctattgccccagaattatgtgtggcttttttcatcagctggctagtattatgttgtatattgtcactgatttaacaacatttattgaatacttatttcaagcctgtgctatataattctggatattgttaaagataaacaaagctggatgcatgttaaagtgctaaggatagattttagtcagtaatacagcgtggcagtaaggcaggagggtccagcatgaattgaaatcaactttgatttgtacagaggtgattgagtgttttaaagggagaatgagggagtagtaagggaaatgaaaaattacagggttcatcaatgtacatgctggttaggccagctgtgtctgttagctggcaattatcaagttaggagtctatgtttatacacagactagcagacagaggccctaactttcctgataatcacgttttaatggaatggcttttaggtccttgaggaaaatactcctgagttgtgggaggtacatacagatatggtttggattttttgtcccctccaaattttatgttgaaatgtgacctctagtgtgggaggtgggcctagtgggaaatgtttgggtcatgggggcggatctctcgtgaatggctcagtgtcatccttgcagtaattagtatgttctctgtgagttcacgcaagatctggttgtttaaaagagcctggtacctcctccttctctctcttgccttgtaacatgcaggctcccctttgccttctgtcatgattgtaagcttcctgaggccctcaccagaagcagttgctggcaccatgtttcatgtacagcctgtagaaccattagccaaataaacttattttttaaaaataaattacccagtctcaggtatgcctttatagcaatgcaaatagactagtacacatatacatcttaaaggtacagaggaaagattcacaactggataccctaagaaagggtagtcaggggcctgttgaccagtacgggctagaataaatagtacattctttcggcggccttgagctttgtctggcaggcactttaagtggggatagggtcatcccagggatgcagacttgagctgttagaaactgtttgtttaaatcttctaatgtgggtagaaggtggtgcatgaaatcatttgtgctgagagtggaatttttataggcagaggttgaggcctagttgagaagagagctcagaggagcctagctagtttggtcaaggattgaatctttgtcagtataagaggcttaaaaaaatctaatctgtttcctcaagaaactttcaacttggtggagtgacagttatgatacaatgaaataatgctatgatagaagtaagcataaggagcaacggaagtacatagggcacatatccagcctagtcttggatagttaagaagagatgatgtttcactttaattagtttcagtcatgcttgctatcatgagactagagcagcactgtccaagagaaatttaatgacagtatatattatatttatataaagttttcgagtagccatgttgacaaagtaaaaagagacagattaattttaataatatattgtatttaaactgatatagccaagttattatttcaacatgtaagctatataaaaatgatcaaagagatattttatcttcacgacatttcaattaggactagccttatttatttatttatttatttatttatgagacagggtctcactctcattgcccaggctggagtgcagtggcgtgatcacagctcactgcagcatttacttcctgggctcaggtgattctctcacctcagcctcccaactagctgggactacaggcacacaccagcacgcctagctaatatttcgtatttttaatagagatggggtttcaccatgttttccaggcttgtctcaaactcctgggctaaagccatctgcccacctcggcctcccaaagtgttgggaatacaggcgtaagccactgcacctggcctggactagacatacttaaaagggctcaaaaatcacatgtggctaatggctgccattgggatggtgcaggtggagattagatacaaataaacaaagttgaggttaaagagactaggataaggtcatgtaaaaatttgtatgggatctttggtttatgaactaatggcttctgtgggtgttctttatgctggtgtgttgcagctttgaattagctatgtttttgtctacctggaattactacagttagtgagatagtgagaaatgaagacctaattaatatttgctaacttaagaatgttgaaagatttttgggtgggaattgaacaatgagaacacttggacacaggaagggggacatcacacaccggggcctgttttggggtggggggagggaggagggatagcattaggaggtatacctaatgtaaatgacgagttaatgggtgcagcacaccagcatggcacatgtatacatatgtaacaaacctgcacgttgtgcacatgtaccctagaacttaaagtataataatatatatatataaaagatttttgaaatgaaataatgatccataatacctttatctggattcccaaaatctaaaaagatattggcagcaaaacctgacctgacctgaactgacgtgaggctatttatagtttttaattatcctacctagtgtgactatttatgctttttgctatagaaatattcgtgtacttgatgacaaggtattccctcagactttgccatgggagttatgtaatcataagtatatgtgctgtattacttttctaaaatccaaagaattctgcattctgaaatagaactgcccaagggttttagataagggattatggacctataaatgcatactgaatgctattaattgcattagtagtggtgatataggtatataattgctatatttaagcctattttatatccagatttgttgagagtttgtttgccgtagtttttttttgtatgtctatatgccaagtaactggaggagttacattcttgatatataactactgttggtttgactgtgagtatatttttattgtggtaaaaaaacacataacaaaatttatcatcttaaccattttgaagtatacagtacagtagtgttaactatatgcacattgttgtgccacgaatctctagaactttttcatcttgcagaacaaaaacactttacctcctgaataacaactccatatttccctatcccctgacccctggagaccaccgttctacttctgtttctatgagtctgactactttaaattacctcatataaatgaagtcatacagtatttgtccttttgggactgacttagttcacttagcgtaatgtccttaaggttcatccatgttgtagcaaagaaggattttcttttttaaggttgaaacattctattgcatgtatatatcatattttaaagtctatctgtagacagacagattgcttccaccttttagctattgtgaataatgctgcagtgaacatgggtgtgtaagtatttcttcaggatcctattttcatttcttttggacatatatgaatatttaagaatattttctcttttctataaactaaataattttatagttttatttcatttagaaaacctctgtttcgtattttagaccttcatgcctaagtttttcatttatctaaagtcaatgtaaattcaacaagtttttccccctttaagctatctttctgtaacagctgtcaagaaatgtacattttttaaaaggcaaaaatcaataccaggaaacaaattcaataatcaagactttgtattcattccgtactttatactttgtgtttataattccttttaacaactagtcattatgggccaggggaggtggctcacgcctgtaatcccaccactttgggaggccaaggcgggcggatcatctgaggtcacgagttcaagagctgcctgaccaacatggtaaaaccccatctctactaaaaatacaaaattagcctgtgtggtggtgcaagcctgtaatcctagctactcaggaggctgaggccgaagaatcacttggacccgggaggtggaggttgcagtgagccgagatcgcgccattgcactccagcctgggcaacagagtgaaaatctatctcaaaaaaaaaaaaaaaaaaaaaaagtagtcattatgtgttctcctgagatgtacagtttgaaaaaaaattgaaaactggcttcaatggagataaaaatccagtttaatagtatgataaggattttgctggaaatttttctttgtaagggttaaattctttgatgcttataattaatttcatttactacattgttttcattttaacttcaaccaaccatataatttattctttctttccttccctaacaccatcccccacctcaagaaatttttttgtatcttcaaaacaccatgagaggtttataatattcttgttcgcctttcagatagaatggatttagtgtactccatgttgttgttgttgttgttgttgtttgagacggagtctcactgtcgcccaggctggagtgcagtggcgcgattttggctcactgcaggctccgcccccaggggttcacgccattctcctgcctcagcctcccgagtagctgggactacaggcacccaccacctcgcccggctaattttttgtatttttagtagagacggggtttcaccgtgttagccaggatggcctcgatctcctgacctcgtgatccgcccgcctcggcctcccaaaatgctgggattacaggcgtgagcaccgcgcctggccttttttttttttttttttttttttttaatggagcaatcacttcttgggggaagggtgaagaaaacttagatattataatggccctccagaggtcaccatacctaaatggctacacaccacatgggtgatgtaaaaatttcaggggagggaggtgattggggaaaaagagtctgtaatcgacttcttagggaatcaataatgtaagaaaaaggttgagaaacactggtgtactgcatgggcaaagaggcaagggatttatgagcaatattttttatttatatttttggaaaggaaactccagagagtaaacaaatgtgctgatgacagactatcttagaaacacttccccgggtcaaagtggttccttctgagattttgctcctatgtacacactgcttggtaaactttgcaacttcacggcatatcagaaggaactagactgcatcctcttcctgtctcttcccttggagtagcatttagcttttcattgcggacctgttgttaaaggaagataaactttaccctataccagccattttctccttttatcaagaaaaatcaatttgtatggttcttaaatgtatttccctagtatatattcaaattaaacttgcagttagatttatatcagtgtttactccaaatagtcaaaatatctacaggctaaaaacagttcctatttcgagcattaaaatagcataagccttagtcacttgttcagctctttgattctcataactatttctaaccgtggtagagataagaatccaacaaaacaaaactctttgcaacaacatttaagttttgctatatacatatttgtatttacgtgtacatacacatatatatttttaaatagtgtatgtcgctgtggttgacttttaaaactcttaaagggataaaaggaaacattcaagaaatactggcttaattatactaactttaaaaattttggttggataacagcctgttttctcaaatcagtgactttcgaagcattgttttttactcttcaaattcattcatattcatttactattcagtatgctgaacttgttactggctcaaaggtactagactttcttacctctagactttgcacatgctgattgtttttgctggaacacttttaccttcctctttgtgtgatattcataaaccttaagcctttaattgaaaggcatatctttagagagctctcttcatccctgctacatgcttttatggcaccctgtgctactcttttcatatttatccagtttattgtaaatacttatttaattgcctgcttctacctctaaaatacagctccctgagtgaaaaccatgtctctgttgattgctattatatcctcagcacctggcacatagtagatgcttgatatttttgaatggaagaatgagacacacacaggtatcctcattattcatatatttcatattgtgaatttgccctctcactaaagttactttgtaccccccaaatcaatccttgcagcattttcatgatcatttgtgggcatgtgcagactcgtgaaaaatttcaacagcctgacatgcacattgccaacagaagttgaaaaaggcaacactctgccttcttatgtcagttctcatactataaagaggtttcctttttgcagtatatttagtggcatgttttttgcatttttgtgctttctgttggtgatcatgccatttaaaatggccccaagcaaagtgctgatgtgctaagtgttcctaaggcacatcatagccttatggagaaaatgtgtgataggtaaacttaattcaggcataagttacagtgctgttggctgtgagttcaatgttagtgaatctacaacctatagtaaataaaatgtctttaaacaaacataaagcaagattatgtattggctaattgactaaaatgtgactaaaggctcacaggaacttaactctgtatttcctttgggagcaatagttcaatatttgctaactcattgttcacaataacttcataggacataactaccacagatagtaagagttgattatgtgtgcaattataaaattgtgctcaaatatatatataatgttttataacttggttttttccctacataactgtgtcatgcttctgttaaaaataatgtgtctttatctcataatatagattatattactaagcaagaaaaaaacttaaatgtttgttagcatggagacagctgtggctaatagacatcaggttaccttgattccctaatatattggttacctgaaattggttattgaggggatgagtatttttttttcttagtttatattatctcactggttacagtgaacatatatttcttttacagatattcttaaaaaacatgatttttaatagttgcattacatttccttatgtgaaaggaataaaattttgattaattatcaccttaaattcttatgtttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaaggtaaatgttaaccaagtcttacagaattacaattcagattgtttttttcttgatcaaatgtaatatatttgtggtttataggatttattattttaagttgattattttatatatataagtgagaaaaaataaaaatgtttacatatgtagttggaatttagagtgacttaaagttttaaagaaaagcaaaaattgaaaagcaaggtataagctgctacttaatacagagcatttcagcagatgtgagctttgttaaatgcagtttagattatgactctatcctacctgaaacttgtcagtggctttccattgccatttacattaatttagacttaatttggtagggtcgggagagatatggcagcattaatagagttattaatacagataatgttaacatagcttatagttcaaaggatatttttacaaacgggttttagagtagttatagccttgatataattttaccagaatatagttattgaaattaagttaaatatgatttatattggcttactacatattttctataacctgtcacttctatttggatctttctagaaattacatcaggagagaatgatattatcaacccacagaaatgcctttaagaaaataatggagaagcaaaacatagagtatgaggcactaaaaacacaattgcaagaaaatgagacacattctcaggtaaaaaatgttttaaatgactttgaaattgtcttagtctatattttcaccccaaaacaatcaattttttattttaaaatttgctttatataccttctagattttctgacttttaagacagccagattctgtacagtcttcattcagaatgaatggactcctgctttcttaccttccataaacctatattgaaagccaactctgttagatactgtcttgggcacaactgttaagatatatggggtagtatattttaaaaattttggaagtgaaacattactaatacagaaactaaaaatccataaaatcacaaataaaataaattctaatgattagtaccccaccacccagaagagagaatgcttattgttgctttagtgtgggttcttttagtcaatggatagatagatagatagatagatagatagatagatagatagatagatatgtgtatacacatatttatgcatatacttaggtacacatttatttctatgcatttatagaaattgtgccatattgtacatatcatttaggagcttgtttttcatgattaactatacatcataagtactttcccttgtcaatatatatattgacttttaaaaaatattaatagcttaatgatattctagtgcatggatgtcgcataatatattgaaccaattccctttcgttggatatttaggtaatttctagttttaaaaccattgaaataatgctataaagagcaatccaggtatccttgaacttcttaattcatatctccaattatttacataggatgcgtagatatatatacctgcagcccccttttcatatcactcatcttgctgataattacttgaacagtgtgtgaggtctagattgagagctctgacgggacagagacaatgtctgtctcgtttactttattccttgccctgtggtattggttggcacatagtaggtactcagcaattatttgttgaatgattgaatgaagcattatgtgtcatgtacaaagtcaataactacggtctgaaaaaaattgatcattcttatatctaattagtctatattagaaatttgcacacatggtttaaaaccctaaatgcattaaaaattccctcttttggccaggcacggtggttcacgcctgtaatcccagcactttgggaggctgaggtgggcggatcacgaggtcaggagatcaagaccatcctggctaacaacggtgaaaccccgtctctactaaaaatacaaaaaattagccaggagtggtggcgggtgcctgtagtcccagctactcgggaggctgaggcaggagaatggcttgaacctgagaggcggagcttgcagtaagctgagatcgcgccactgcactccagcctgggtgacagagcgagactctgtctcaaaaaaaaaacaaaactctctttttcttcatatggttatgtgatcatgatagagcaaaataaaaatgatgtcatttgattttccactacataggtacaaccgttgttaacattttggtgccatatccttgtagtattttcatcctttgcaatcatacatccatattgtttttacaaaaaataaaaccatgctattcatacagtctttcaacattttcttaacttttttcagccttctttttttttttttcaaacagagtctcactgtgttgcccagggtagagtgtagtgacataattgtagctcactgcaacctggagctcctggactcaaccgatcctcctgcctcagccactgagtagctaggactacaggcacagaccaccatgctcagccaatttttattattttttatagagacagggtcttgctgtattgccctggctagtcttgaactcctggcctcaaactgtcctcctgcctcagcctcccaaagtgctgggatcacaggcatgagccactgtgcttagccttttttttctttttgagacgaagttttgctcttgtcacccaggctggagtgcagtggtgtgatcttggcttactgcaacctccacctcctgggttcaagcaattctcctgcctcagcctcccaagtagctgggattgtaggcgccagccaccacgcctgtctaatttttttgtgtttttagtagagacagggtttcaccttgttggccaggctggtctcgaactcctgaccttaggtcatccacctgcctcggcctcccaaagtgctgggattgcaggtgtgagccaccacactcggcctttggtgacatttctatagcattagctatttcattgtatggatgtaccatttgaaaacaacatacaccttacattctttttgaaaagggtagaatctcatgaaagcttgctacaactactaaaagcttagaaatcactaatttacataattcaaatttaccagttattctgttctacttcatatggaaacctagatatagacttataattgacacaattttcttaggttgtttagagtgaggatgagtgctggggaagaaacaagacaaagtttgggaggtcattgtcttcagcaattcttggaaaaaaatactgatacttcttatggaatattagccctcctcattcactgaatagatgatttaaggtggaaagcacttgaaaaacaccatttcttagagccagtgagtggttaacttgtttatccccacattaattgctaattttaactccatgtattgataactggaaatcataacataagccacaatttcgaatccttctctgtgttatttgtcatcttttgtgaatcccaactgattaagtcaaatcctggtcttcctatctttcacaattatcttcttgaaaactggcttttggcatctctaaagaattttatgtaacagattatttaaactagttagggaaaaacagattttcaaaatgaatttttgcttcatgatgtccttggaggtttaaaggagtcaataatatagaggtataatgtaaaaggaatttgaccatctgacacagcattgcttttataccattcctgtagcacttaacaggtctgatgcattataagaaggccacctgtttgtatgaaacaatgacaaaaaagtctggtacttgactttgctgaaggttattagaaatttactgccagaaactgctgactgcttccttaagtccatcttaacttcaaggtcctgtctgggggagattgatgtgattagtaataccagctcacagcacatacagttcacataattaattagctatgattcattctaatatctagatttatctctttggaggaaacaatgagatggatctacatcaagcctgaatttacgccctgaaaattattttaacatgaggatagaaacatttccactgttgcttcaattattgtatttttaaaaataatcattacttctttgaaatgtccaggtggaacataattttagcatttcaattttcaaatggtcctttgctttggaaaaaactatgtgcatcttaaaaaagaaagaccataaccagagttacaaggttaattaaatcagaaaaacaatataattctataacagtaaaattgtcttctgaggaagcaaccatcaatataatatccacattagcttcctgttgatgcagaaattattgtaacagtgccagctttttaccagctctcttataatcttcacactgcagctctgctcttatcacagcttgtggaattacacaggaaatttagccctggaaataaggaagtttctcctatatggctgaacctttgacagtgtttgaatatgtattatatttgtggcattagacttccagattttaagaagagattcccatcatgtcccatttttcttttaaaagtttttttagggaaaggaaaatcataaattgtctttcagttggcatgttcattggtataataaacatttaaaatataattaaaataaatatatagagtaaaacatgttataggattcatcactgtattaatatatttactattatttaatctttttttttctaccgtggctttatctcaataaaatgtaagttgataagatttaaagttggagagattttttttgtcttatcctcttagaaaggcatttaattgttttaaatatgggtcctaattaatatttttcttttatgtttttagcttacaaatttggagagaaagtggcaacaccttgagcaaaataattttgcgatgaaagaatgtatcctttaaaaagctgaaaatggggccgggtgcggtggctcatgcctatagtcccaacactttgggaggccgaggcaggtgggccacaaggtcaggagattgagaccaccctggctaacacggtgaaaccccatctctactaaaaaatacaaaaaaaacatagccgggcgtggtggcgggtgcctgcaatcccacctacttgggaggctgaggcaggagaatggcgtgaaaccgggaggtggagctctcagtgagccgagatggcaccactgcactccagcctgggcgacagagcaagactccatctcaaaaaaaaaaaaaaaaaaaaaaaaaaaaaagctgaaaatgaaattgactgagttatttttttctaggaatttttttaaagactcaaatttagttcaacacctacttattaaataccagatatgtacaaaaccctgggccaaattaaatgaatatgactgtttcaattctacagtagttaagaggtgtgtgtgtgtgtgtgtgtgtgtgcgcacgcacgtgccctcaagtaactaatagaaagcagattttgggagttgccaaaaaaggagtacaaagacttaatgtggcatagtgattaagtgcccagattttggagttgggcgatccaattttaaatgtcaactctactgcttgtaagttacaaactggacaatttaatctgttcaagctagaactgtatcatctcttaagattcagttttccgggatcacagggcttgggtaaagttaaacattatcagtaaatcttctgataaacatggcaagaatttctcttttgtttagagacaggggtctcgccaacttagccaggctggtctcaaactcctaggctcaatcccacctcggcctgctcaagtgctgggattagagacatgagccactgctctcggccccagaattgtatcatctctaaaatctctaaaatatagttaatattaccttctcatagtgttgggagaattatatataaccatatagttatatatatccacaagtatatatatatatatatatgtacataatatataatatatagttgtttgttgtttatatggttctaccttgaatatctgggcagcaaagggaggtaaactaagtaagatcctgagaagtttgacttccaagctcatccatgttttagccatttcaactccattatatgtctacaaagatgatacttatgtctcatcttattgtttacttttagtttgattacaggaggcagcaagcagctgttgagaacatgtgttgtgaagttgtaacagatatttccttaaaagttgtttcctattcccttctttgacccattcaaggatgtctctgcctggagaactagatcctgactcagtggcagcataggttctcccccagggtggtgctgaacttcagctcagaagcagcctggaccccatcttacctccagataaggtgttttaggtactctgttgccagtgttagtgcaacttagtttaaaaatagaggacttgttcacagtatgctctaagtctcacactggagttttgtgcaacataaagtaggtgattttggagcagagcgaagtctagaaatttgccttaaattatttgtggtactctagagaacgtggtatgtgtatgtgtgtatgtgtgtttgaatataggaactagttcattgaacgttagattgttctaagaccagaattagattaaaaatgcataacatattaagtattaaaaagtgtttatattgtatatgaattttttgcggtaagtttagcttggcattttaggttttaattgatgcttaatctgttaaaatgatgtactgtattttaaagtattctaattgtgcttttttgtaccatcttcagtatgaaaaatgtcagtatttagttcctttctcaggcacaattagatttttattgacattgttttcccccttaactcatgtaattagtcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaagta

SEQ ID NO: 1877 - DNA, 44792 bp, Homo sapiens
aggggatgacgtaaaaaggccgcgctgtactgcggcttgtgccgcttccgcaagaaggtttcctggcctgttgcagccatggtgcattgcagttgcgtgttgttcagaaaggtccgtgcgggtcccctcagcctggtccccttagcgctgacagctctggttcttctttgctcccctgtctctccactactgtcttcgtggcggccttttccttgcttggttttcccatagacttctccgcccctcctgtagtggcgctttgtcagtaagcggtgacagtggtgtgtgtacctggcgtggtttggacggttgtttgggggcaggggcagggtttgaagttctttagagacatagtgtgcacgtggtatgaggaactgggatacctgcctgctgtggcccaaatgttgtggtggttttttttcctttaatgtccacagcctgtttttatatatttctccttgagtgcgctgtttaaggtttttctaatggatttttatgaagacacgaaagcgtgtaattgatgtgccttcctgcagaacatttaggtcgatttttgtgtggtgtcggtcttaagaatcgtttccgtaaaaatttacaactgctttgaatttttattttttaaatcttatcctatcagtaatgctttttgaaacgttgcctgcgtcatatttggccattactttatttctaacgaccagagtaaaatactccttttaagtaaggctcctaaacccctgaatctgattaatctagagcaggaaaaaagtgttacatatttaatggaactgtagaaactctcctcgagtatatcagaatggtcaatatttcaactttcttgaaaaaaaaatcccatttgttttttataatagctatcctaaatgactagagatgtggattatgaatttaagaaattactccttaagttattttgattttaatagcctaagaggttaatacgtaagtcctttacctacaagaagttcttgatttagtgaaggaaacaggtaaacactaaatgcagcgtgagatttataaaggtgtaataatagagatataatcaaattgctgggagagccagcaaagtcagagaattgattagaggaatttggaaagacgttagaaaatatgacgtttaggtggatttatgataggaaaaacaaatgacattctaagtagaggaaaagcatgagcagaatggcatgtagaaatggcggtatttcatgtagtacagagcaaagaggaagagaggaagggttgagcaagtgaaaaggatacaggaaggaactaggcatggtaggtgagcctattgttcttgctacttgggaggctgaggtgggaggatcccttaaggccaggagttcaagaccagtctgggcaacatagcaagaccccatctttaaaacagtcggggtggtgtggtgcctgtagtcccagccatttgggaggctgaagtgggagaattgcttgagcccaggagtttgaggctgcagcaatgatagtgctatgatagtgccacggcactcgagcccaggcaccagaaccagaccctgtttcaaaaaaaagaaaataaaagataccagaagggtattttagtagctttggatatacagttgacccttcaagaacatgggggttagagatgcccccgccacagctgaaaatcttcatgtaactttcaactccccccacaaaacaactactaataatctgttggctggaagcctcactgataacataagccgtcagttgacacatataaaatatatatatagtatatactgtattcttaaattaagctagagaaaagaaacagttactaagaaagtcagaaagaagggaaaatatatttactgttcattaaatggaagtgaattgtaaaggtcttcatccttatagtcttcatgttgaatagactgaggaggaagaggaggagttggtcttgctctcttgggtggcagaggcagaaggggtgggggtggaggaggtggaaggggaggcaagagaggcagacacactatgtgtaactttatggaagtacatcataatttctgtcatgcttttgcttttctctttcccccaaaaaaatgtttctatagggtaccaatacctcttccaccatttgctttggtttcagtgcctcttcacagaagggtccatgtcataaaagaagtcaaaagcagtcctgaacaataggagctcttctgccagattatctaatgttcgtttttctggtagtttattctgtgttttcttccttgttatctggcactggatctgaagcactcatcaagctgtcttctgttaattcctctggtttggtggctgttagctcttgagtttcttcaagatccatatcttgaagtcctttacccactttcccgccgtttttggcatattcacagcctctttcatgatttccttgattggctcttttgtaaatcctgtgaaattataacacaacacaacacctggacaaagttttctccagcacgaacttactgtttggggcttatggctttcatggctttttcaataataatggcatcttcaattatgtaaacttcagattttcctgaagttttctctattagtgttcttttccatggttgacaatccttttcgtagaaaatcatgtttaatgagccttaaaggtccttgcgaccccgtgatctagaggctgatttacagacattgtgtttgggggcaaggacaccacttcagtgcctttgatgttgaactcatggggttctgggtagcggggaggtggggcactgtccattagcagaggaactttacaagtcagtctcgtattgggaaggtacttcctgacttcagggagaaagcatccatggaaccaatccagagaaaaggtttttgttctctaggccttcttatccaacaaagactggcagctgatgtttatctttccctttcaagattgaggggttagcagctttatagataaggacagtcctgattacaaacacaactgcatttgcacaatacagtagggttagcctatcccttcctggcttaaatcctggtgctcccttctcttccttactaatgtcttttgtagcatgttttccagaatagggtactttcatcagcattaacaacctgatttgggagatattctttcgtctcagtgattttcttaatggcatctgggaactcatctgctgcctcttagttggcagaacctgcttcacctgttatcttgatatttctaaagccaaagccaaacctatttcttcttttttttttttaaattatactttaagttctagggtacatgtacacagcgtgcaggtttgttacataggtatacatgtgccatgttggtttgctgcacccattaacttgtcatttacattgggtatttctcctaatgttatctctcacccagcccccaaccccatgacaggtcccagtgtgtgatgttccccccgtgtcccaagtgttctcattgttcagttcccacctatgagtgagaacatgtggtgtttggttttctgtccttgtgatagtttggtcagaatgatggtttccagctgcatccatgtcactcatcctttttatggctgcatagtattccatcgtgtatatgtgccacattttcttaatccagtctatcattgatggacatttgggttggttccaagtctttgctgttgtgaatagtgccacaataaacatacgtgtgcatgtgtctttatagtggcatgatttttaatcctttgggtatatatccagtaatgggatggctgggtcaaatggtatttctagttctagattcttgaggaatctagaactgtcttccacagtcaaacctccttctaaaattatcaaatcatcctttgctggcaattaattctttagctttagatccttcacattccttttgcttttaagttgtcatatggtaaccttactttttcttttattgtattagtctatgtttttaaaataggaatcctgcatctacataaaagttgcctttttaatacaagataaaaagttaattcacaaaaagtgcaaggttttcacaccttttggcatagctgctgcagtggcttcatgaatttttgtctttttttacactgattcttattctggattcatttatcttgagatagcaggccatcgcagctacagattttaatctgtggtagatatcaagcaattcatctttttatcgtagtgtcatgactttacttcttgggagcactgccagcatcactagtggcactttgtatgggttccatggtggtgttcaaggtttacagtgtagcgctgaacatgatgaaaaatgcaagagaactgtgagagattactttttactgacttataaaatgtactggcaagatgaactgctcatggggagacgattagcatcacatggccttttaagtggcaacttgggacacttgagatcccgggatagttacaggaggtaactacgaaattattacagtattccacgatgtactacagttaattttatgcagttatgatttaatactgcatttttacatttgcttacatttctcttgactgcaaatgctgccatgtaagatctgtaagtgtgtgtgtaagttttgataaattttaagtttttataatagatgtgtggccaggtgcagtagctcatgcctgtaattccagcactttgggaggccaaggcaagaggattgtttgtggccaggagtttgagaccagcctgggcaacatagcaaaaccccatctctagtttttaaaaattaagatagatatgtgtatattttatggaagtaaatgacaaaatagattagcatctatatattttttgcactcataacacacagcttttcttaattttttcaatatttccaatctatttgctttgtaagttttttcaaattgttgcaaagctcaaaaaatttttctaatatatttattgaaaaatatctgtatataagtggacacacgcagctcaaaccagtgttgttcaagggtcaactgtagtactaagaattttttactttatttcataagcatttttttttttgagacggagtctcgctctgtcgcccaggctagagtgcagtggcttgatctcggcccactgcaagctctgcctcccaggttcatgccattctcctgcctcagcctgcagagtagctgggactacaggcgcccgccaccacgcctggctagtttttttgtatttttagtagagacagggtttctccatgttagccaggatggtctcgatctcctgaactcgtgatccgcccaccttggcctcccagagtgctgggattacaggcatgagccactgcacttggctcataagcatttttttaatgcatggtttttgagtaaaggagaaacatgattagagatcagatcaatttcagaaaaatagttcaggcaacaagttggagaatgcaataaggaaaaaatgcctaaacactgaaaggagctcatgtggtgcaggtactagggcagtggtactggagagaagagagtagggctttgggaaaagaagcaggtgtagtctgaaagacttccatttgtgtagtctcaatgaatatgtaaaccatggttctgttactttagagaacattggaggaacagattttacctggggaagagtttggttttgttatgttaacatttatttttgaggtggctattattcaactgatatgtaagaacaagtttcatattggggaatttcaaatataagttaaatacacattctgctcacatttgctttatactattaaaagctttcatcctggtggaaatgtctgacagattggacatagaaaatatctcacctaggtgatggttattggtacaagcagaaattacccaggggagaaagtctagaatgaaaacagggccaagtcagaaaccctcaggataggtgggacaataattgataactgaaaaaactaaaagggacttaagagagataatcaaatgggaaagggggtcagatcggagatgtggaggtgagctaagaaaatgttatagaattggcatgtgaaaagctattaacgacttttttagaagaagttttagtggaagaaagaactagaaaaaggttctaaggtgatacacttttggtatacaaatattctttctcttttttttttaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaagtaagtaattactgaatgacttaaattttagaaaatcaaacccttctggaaattttttttttagttacaaaataaaaacttaattgttaatttgaagtaaattatttcctgtatttataaccaagcaaaagcctaaaatgtctcaactcataaaagactgatactaaagaatatttcagagttttaaaactttctgtccgtttcttttcccaatgtctatctgtattctttttgcacttcccctgtagaaaccgataattatctgaattcccactgttttcttctaaaattatctttgacaaccttttagaaaactttcagtcttaaccatgctactctaccccaccaccattagaaggcaagataaccactattaaccttttcttgacttttctaagacttttctgtgtgtttacacaaatgcaattatgtgcctaaaagtttagaatacaaaaatgagagtacagtattttacaatctgctatttttactttttttcacatgtcaaaattattcagaatacctgcataataaataactattttgtcatttgtctatttaggttattgttgatttttttttccgattataaccacagtgcagcattctgtgtagatactattttacatgtttgttcaattattattttgataaattcccagaagtagaattactaaaacatttgtactaattttttcttttatgagcagtttaagagtagccagatttgccttctataatgtaagtactctcatttgaggttagttttttaaaagctttgctatttggtggattttctttttttttttatagattcattttttcttttttttttgagacagagtctcattctgttgcctaggttgagtgtagtgggcactatcatagctcactgcagcctctacctttcaggctgaagtgatcctcccacctctgcctcccaagtagctgagactacgggtatgtgccaccatgcccagctaatttttaaatttttctttttttgtagaaatggggtcgtgctatggtgttcaggcttgtcttgaactcctggactcaagagatcctcctgcctccgcctcccaaagtgctgagattacaggcgtgagccaccacgcctggctttttctaccctatttgtattgtagcaataatctcttcatttcatggttgcaatattttagtttcgggttaaaatgacctttggtggttagcttagtaacttaaatcattacttaatgccattttagtgggatataatagtctaaaatgcaaagaaataattagggataattttagtttttttaaaccccgtgtttgaccatttaacatctgcgttaaccagagaattgattgctactcttctttgtaaaccattttgtgtgtatgtgtgtgtgtgtatatatacacacacacatacatacatatatatactttttttttggtagaattagtgcactgaaaggctccaaaggaaaagactgtgaaatccctgtgcctgtgggtatttcagtaactgatgaaaatggtaaaattataggtgagtgtactataactccaaaagttgtaaaaatgtgcacgttttctaaaatgaaacaatggaatagcttctcttgagtttcagaagattttttaactaacaattttagctactattctataagagagcatttttaaaacttataaaagttaaattgactgctagatttaagattgttttaaagatgttacagttcttacttggtcttaaaatatataactaggctcttttcaattgtttactgaagtgtttttctggggtcaaacttttaatagatttgtaaattggaatttcctggactgtttttctgaaagaacaatattacattaatgattctacttattaattatagatttgtaattgagaatttcctggcatgtatttttgaaagtaaaatattacattaatgatttcacttactaatctatagatttgtaattttgcatttctttgcctgtatttctgaaagaaatatattgcattagtgatttcacttattaatctttgctgtaagtatttctctccctctttttaaggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtagggtaagtatcgttcatatttttattattatactttcagagagagagttcttgaatagaaaataaatgtaaatggtaatttggggccataattatttctaatttatggaatttgtgtgttgtgtatgtacttggaaaatatgctgctaaatattattttcaaattgccaacacagagtttcatagttattgcttatttataaaattaagaccagagcaattgaatagatcagtgggaatgttagagaatgcataaagaaagaaaaatcaatcaaatgcaatattacaagatggttaaataatgttaccagatattaataataaatccaaacaaaccgtattattattaaaaatatatagaaggaaataaacagggaaaaatggttgacataactcttttgggtcttaatagagacattaaagtatcgttaatcaaatggctaaagaccagtacagacaatctcaatcctcagacttacgcactgttgccgccaaattgaatcctgctatgactgtatatccttcttgcctctgcttaggatctatctagtctcagcaatgtaggcctcacaagagtgtcctcttccaccagcctccattctttcattaaataatgctgtttagctgtggggtttgcagtgcagctgcccactggaaggggatagatagtaagatacagaatacataaaggaagagaaaacttcaatttgcatttgctctctctcccccatcccccctccctcctatcctctccctctggccctatcacagtattacacagttattcagatggaaagcttaaggacaagataaggaaaactgccttattactgtcctactccaaattcctagttctattttttgcttccccatagcttctttctaagttcttttcatgttcctcttcagtcatctcactgcttctttaccagactcttaagtctgtatccctcgtcttttgccctgcctgaccagccactagagcttaccaccattggtttagggttcacagaggccccattcctgctaaaattataacaaggaaagatgtgatcctggcttgccatttacatttatttttttcaataaagcacagttacaagagttattagatgtaagttctataatcctctatatttttaggaacattatgggcttaatagggtcttatggacaagactggcagtccagccaatcacagttgcattttgcataaacatgtgtttcaagttctgaagagacaactttacagtctaagaggagcctagcacggcttagtcataaaagtggagtggcatggaggactcaggttagactatttaggttaggatctcaaatcctctggaggctggccagctggtcttgggtaaattacacagcctctctaagcctttgttttctcttctttttttcttttcttttctctcattcttccttcactatagttttttgcttttcaccacgtcatttgttttctcatctttaatagtgtatggagataagtctttccttaaaatgttggtgggtaagataatgcatttacagcagaatacatgctttgcatttttgtacgttcaatgaattgtagctgctatcttcatcatcattatattgccaacttactggaaaactgcatataatgaaatactaggcttttcagaagtaggtttgaaatttgtctgtaattaaagcatcaagattcttaagcatatcaaacaagaatgggggaaaaagatttttaagtggaatgtttaacatattttctagtgtttttaaattaggcaactattcttgaagagttactactatgaatactagcataagtagatatccttttagctggttttggaaatggactgaatcacagaagaaagttattgtacaactaacagatttgtgctgctgttgtcagatctgatctttgcataggttggattttagcctgtaaaattttcactgggtacttttcaagaaaaatttcaaatatctgttattcagtcattagcatcatctttctattcatactttgatcttcttggaaatagttgcttgcattatgtgctcaatcattatgaaaatatgaggatgttggaaacaagcaagtccagctagtgataattatggataaaaacagctgcaatttgcttttcaaaagctataagaacctggatgaaacagggtatgaaaaaactatatgttccaggagaaacaagtcattaagaaacctcacataattttattttaaattcatgacagaaagatttttttaatgagggaaattgttgaaatacctccagctaatacgcttttataaaattccaaattaatatttgcagaatattccaccattattccaaatgaaagtttggcagagtttttgaagtaccgtcttcaaatttgaataagaactctgtgaaggcgggaatcattttgtctcattgctcagtatgttgcctgatacgaagtcagtgctcaataaatatttgttggataaatttaatgaaaatatatgaatgagatttagcaatgaatgttttaagtaacccccattcctagtactgtctttcatacatggtgggcctttcttgagggaaatttagcagtataatcaaagcctttaaaatgagcatgtattttatctggtatttcttcatgtagacatttattccaagaaagaaatcaaagatgtgtgcaaagagaagtcttagccagaacaatcaggcaagagaaaaaaagggcattcaaattggaaagaaggaagtcaaactatctgtttgcccaccatatgatcttataccttgaaaaccctagagactccttcaaaagactcctagatttgataaatgaattcagtatactctcaggttacaaaatcagtatacacaaatcaatagcactgctatacaccaacaacaaccaagctgagaattaaatcaagaactcaatcccttttacaatagctacaaaaaataaaataccaaagaatatacgtaaccaaggtcgagaaagatctctacaaggagaactacagaacactgctgaaagaaatcatagatgacacaaacaaatggaaatacatccaaagcaatcctaagcaaaatgaacaaatctagaggaatcatattacctgacttcaaattatattacaaggttatagtaaccaaaacagcatggtattgacagagaagtaggtacttagaccaatggaacagaatagagaacccagaaataaaaccaaatacttaagaccaactgatcgtcaacaaagcacacaaaaacataaactggggaaaggataccctattcaaaaaatgatgctgagaaaattggatatccaaatgtagaataatgaaactgcattcatatctctcattatatacgaaaattaagatagattaaagattttaatctaagacctgaaattataaaaattctacaacacttaggaaaaacccttctggacattggcctagacaaagaatctgtgactaagatctcaaaccaaatgcaacaaaaatacataagtgggacctaattaaagtaaaagtcttgtgcacagcaaaagaaagaatcaacagagtaaacagcctacagaatgggagaaagtatttgcaaactacgcatctaacagaggactaatatactgagtctgcaaggaactcagatcagcaaggaaaaaacaattccgttaaaaagtggacaaatgacatggacatttctcaaaagaagatatgcatacaaatggccaatacgcatataagaaaatgttcaacatcactaatactcagggaaatgcatattaaaaccacaatgatttaccaacttagctagaatggtcattatggaaaagtcaaaaaacaatacgtgctgacatagatgtggggaaaagagaactcatactttttttttttctttaacttaaaaaaattttttttattatgctttaagttctagggtatgcacaacatgcagctttcttacataggtatacatgcgccatgtcggtttgctgcacccatcaactcgtcatttacattaggcatatctcctaatgctatccctcccccagacccccaccccctgacaggccctggtgtgatgttccccaccatgtgtccatgtgttccttgttcagctcccacttaagagtgagaacatgcaatgtttggttttctttccttatggtagtttgctgagaatgatggtttccagcttcatccatgtccctgcaaaggacatgaactcatctttttttatggctgcataccattccatgatgtatatgtgccacgttttcttaattcagtctatcattgatggacatttgggttggttccaagtctttgctattgtgaatagtgccacaataaacatacgtgtgcatctgtctttatagcagcatgatttataatcgttcgggtatgtacccagtaatgggatggctgggtcaaatggtatttctagttctagatccttgaggaatcgccacgctgtcttccacaatggttgaactagtttacagtcccaccaacaatgtagaagtgttaactatttctccacatcctctccagcacctgttgtttcctgactttttaaggatcgccattctaactggtgtgagatggtatctccttgtggttttgatttgcatttgacggccagtgatgatgagcattttttcatatgtttgttggatgcataaatgtcttcttttgagaagtgtctgttcatatccttcgcccactttttgatggggttgtttgtttttttcttgtaaatttgcttgagtactttgtagattctggatattagccctttatcagatgagtagattgcaaacattttctcccattctgtaggttgcctgttcactccgatggtagtttcttttgctgtgcagaagctctttagtttaattagatcccatttgtcaattttgtcttttgttgccattgcttttggtgttttagacatgaagtccttgcccatgcctatgtcctgaatggtgttgcctgggtttccttctagggtttttatggttttacgactatcatttaagtctttaatccatcttgaattaatttttatgtaaggtgtaaggaagggatccagtttcagctttctacatatggctagccagttttcccagcaccatttattatatagagaatcctatccccatttcttgtttttgtcaggtttgtcaaagatcagatggttgaagatgtgtgttattatttctgagggctctggtctgtcctattggtctatatctctgttttggtaccagtaccatgctgttttggttactgtagccttgtagtatagtttgaagtcaggtagcatgatgtctccagctttgctttttggcttaggattgacttggcaatgggggctcttttttgtttccatacgaactttaaagtagttttttccaattctgtaaagaaagtcattggtagcttgatggggctggcattgaatctataaattaccttgggcagtatggccattttcatgatactgattcttcctatcgatgagcatggaatgttcttccatttgtttgtgtcctcttttatttcgttgagcagtggtttgtggttcttgaagaggtccttcacatcccttgtaagttggattcctagctattttattctctttgaagcaattgtgaatgggcgttcactcatgatttggctctctgtttatctgttattggtgtataagaatgcttgtgatttttggacattgattttgtatcctgagactttgctgaagttgcttatcagcttgagattctgggctgagacgatggtgttttctaaatatacaatcttgtcatcttcaaacagggacaatttgacttcctcttttcctaattgaataccctttatttctttctccttcctgattgccctggccagaacttccaatactatgttgaatagaagtggcgagagagggcatccctgtgttgtgctggttttcaaagggagtgcttccagtttttgtccattcagtaatgatattggctgtgggtttgtcataaatagctctcattattttgagatacgttccatcaatgctgaatttattgagtttttagcatgaagagctgttgaattttgtcaaaggccttttctgcatctattgagataatcatgtggtttttgtcattggttctgtttatatgctggattacatttattgctttgcgtatgttgaaccagccttgcatcccagggatgaagcccacttgatcatggtggataagctttttgatgtgctgctggattcagtttgccagtattttattgaggatttttgcatcaatgttcatcagggatattggtctaaaattctcttttttgttgtgtctcacaggctctggtatcaggatgatgctggcctcataaaatgagttagggaggattccctctttttctattgattggaatggtttcagaaggaatggtaccagctcctccttgtacctctggtagaatttggctgtgaatccgtctggtcctggactttttttggttggtaggctattaattattgcctcaatttcagagcctgttattggtctattcaggaatgcaacttcttcctggtttagtcttgggagggtatatgtgtcgaggaatttatccgtttcttctagattttctagtttatttgcatagaggtgtttatagtattgtctgatggtagtttgtatttctgtgggatcagtggtgatatcccctttataactttttattgcgtctatttgattcttctctcttttcctctttattagtcttgctagcggtctatcaattttgttgatcttttcaaaaaaccagctcctggattcattgattttttttgaagggttttttgtgtctctatttccttcatttctgctctgatcttagttatttcttgctttctgctagcttttgaatgtgtttgttcttgcttctctagttcttttaactgtgatgttagggtgtcaattttagatctttcctgctttctcttgtgggcatttagtgctataaatttccctctacacactgcttgaaatgtgtccctgagatactggtatgttgtatgtttgttctcattggtttcaaagaacatctttatttctgccttcatttcgttatgtacccagtagtcattcaggagcaggttattcagtttccatgtagttgagtgattttgagtgagtttctgaatcctgagttccaatttgattgcactgtggtctgagagacagttccttgtaatttctgttcttttacatttgctaaggagtgctttacttccaactatgtggtcaattttggattaagtgcggtgtggtgctgagaagaatgtatattctgttgatttggggtggagagttctgtagatgtctattaggtcctcatggtgcagagctgagttcaattcctggatatcctggttaactttctgtcttgttgatctgtctaatgttgacagtggggtgttaaagtctcccattattattgttttggagtctaagtctctttgtaggtctctaaggacttgctttatgaatctggttgctcctgtattgtgtgcatatgtatttaggatagttagctcttcttgttgaattgatccctttaccattatgtaatggccttctttgtctcttttgatctttgttggtttaaagtctgttttatcacagactagggttgcaacccctgccttttttttgttttccatttgcttgataaatcttcctctatccctttattttgagcctatgtgtgtctctgcatgtgagatgggtctcctaaatacagcacactcttgggtcttgactctttatccaatttgccagtctgtgtcttttagttggagcatttagcccatttacatttaaggttaatattgttatgtgtgaatttggtcctgtcattatgatgttagctggttattttgctcgttagttgatgcggtttgttcctagcgttggtggtctttacaatttggcatgtttttacagtggctggtaccggttgttcctttccatgtttagtgcttccttcaggagctcttgtagggcagggctggtgttgacaaaatctctcagcatttgcttgtctataaaggattttatttctccttcacttatgaatcttagtttggctggatatgaaattctgggttgaaaattcttttctttaagaatgttgaatattggcccccactctcttctggcttttagagtttctgccgagagatcagctgttagtgtgatgagcttccctttgtgggtaacccgacctttctctctggctgcccttaacattttttccttcatttcaactttggtgaatctgacaattatgtgtctttgagttgctctttttgaagaatacctttgtggtggtctctgtatttcctgaatttgaatgttggcctgccttgctaggttgaggaagttctcctggataatatcctgcagagtgttttctgacttggttccattctccccatcactttcaggtacaccaatcagacgtagatttggtcttttcacatagtcccatatttcttggaggctttgttcatttcgttttactcttttttctctaaaattctcttcttgcttcatttcattcatttaatcttcagtcactgataccctttcttccagttgatcaaatcagctactgaagcttgtgcattcgtcacatagttctcatgccatggtttgcagctccatcaggtcatttaagaacttctctgcattggctattctagttagccattcgtctaatcttttgtcaaggtttttagcttctttgtgatgggttccaacttcctcctttagctcggagaattctgatcatctgaagccttcttctctcaactcatcaaagtcattctctgtccagctttgttccattgctggggaggagctgcattcctttggagggggagaggtgctctgatttttagaattttcagcttttctgctctgtttttttccccatctttgtggttttatctacctttggtctttgatgatggtgacgtacagatgggtttttggtgtggatgtcctttctgtttgttagttttccttctaacagtcaggaccctcagctgcaggtctgtaggagtttgctggaggtccactccagaccgtttgcctgggtatcagcagcagaggctgcagaacagtgaatattgctgaacagcaaatgttgctgcctgatcgttcctctggaagcttcatctcaggggtacctggctatgtaaggtgtcagcctgcccttactgggggttgcctcccagttaggctactcggggatcagggacccacttgaggaggcagtctgtccgttctcagttctcaaactccgtgctgggagaactgctactgtcttcaaagctatcagacagggacatttaagtctgcagagatttctgctgccttttgtttggctatgccctgcccccggaggtggattctagaggcaagcagtccttgagctgtggtggactccacctagtttgagcttccaggtggctttgttacctactcaagcctcagcaatggcgggcacccctcccccgccagcctcactgccgccttgcagttcgatctcagactgctgtgctagcaatgagtgaagctccgtgagcgtgggaccctccaagccaggtgcggaatataatctcatgttgtgccatttgctaaggccattggaaaagtgcagtattagggtgggagtgacccgattttccaggtgctgtttgtcacagattcccttggctaggaaagggaattccctgaccccttgcatttcccaagtgaggcaatgccttgccctgctttggctcacactcagtgggctgcacccactgtcctgcacccactatccaacaagccccagtgagatgaacccagtacctcagttggaaatgcagaaatcacccatcttctgcatcgctcgcactgggagctgtagactggagccatttctatttggccatcttggaaccccacccctgatttttgctcattgattttgtgtcctgagactttgctgaagttgcttatcagcttaaggagattttggactgagactttggggttttctttttttttttttttttttttttttgagacggagtctcgctctgtcacccaggctggagtgcagtggcgggatctcggctcactgcaagctccgcctcccaggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccacctcggcctcccaaagtgctgggattacaggcgtgagccaccgcgcccggccggggttttctaaatatacaatcatgtcatctgccaacaggacaatttgactttctcttttcctaattgaataccctttatttctctctcttgcctgacggccctggccaaaacttccaacactgtgttgaataggagtggtaagagagggcatccctgtcttgtgccagttttcaaagggaatgcttccagtttttcttattccgtatgagattggctgtgggtttgtcataaatagcccttaatattttgagatacattctgttgatacctagtgttttgagagtttttagcatgaagcgctgttgaattttctcgaaggccttttctgcatctattgagataatcatgtggtttttgtcgttgcttctgtttatgtgatggattaggtttattgatttgtgtacattgaaccagccttgcatcccaaggatgaagccaacttgatcatggtggataagctttttgatgtgctgctgggttcggtttgccagtattttattgaggattttcgcattgatgttcgtcagggatattggcctagaattctctttttgttgttgttgttgttgttgtatctctgccaggctttggtatcaggatgatgctagcatcatggaatgagttagagaggattccctctttttctattgaatggaattgtttcagaaggaatggtaccagctcctctttgtacctctggtagaattgagctgtgaatccacctcgtcctggactttttttggttggtaagcaattaattattgcctcattttcaggacctgttactggtctattcagagattcaaattcttcctgttttagtcttgggagcatgtatgtgtccaggaatttatccatttcttctagattttctagtttatttgcatagaattgtttatagtattgtctgatggtaatttgtatttctgtgggatcagtagtgatatcccctttagcatttttttattgcgtctatttgattcttccctcatttcttctttattggttttgctagcggtctatttatattgtagattctttcaaaaaaaaaaaaaccagctcctggattcattgatttttttgaagggtattttgtgtctctatctctgtcatttctgctctgatcttagttatttcttgccttgtgctagctcttgaatgtgtttgctcctggttctctagttctttttattgtgatgttagggtgtccattttagatccttcctgctttctcttgtgggcatttagtgctataaatttccctctccacactgttttaagtgtgtcccagagattctgatacattatgtctgtgttctcattggtttcaaagaacatctttatttctgccttcatttcgttatgtacccagtagtcattcaggagcaggtttttcagtttccatgtagttgtgtggttttgagcgagtttcttaatcctgaattctaatttgattgcactgtggtctgagagacagtttcttgtgttttctgttcttttgcatttgctgaggagtgttttacttctcattatatggtcaattttagaataagtacgatatgctgagaagaatatatattctgtcgatttggggtggagagttctgttgatgtctattaggtctggttggtccagagctgagttcaagtccttgatatccttgttaaccttctgtctcgttgatctaatattgacagtggggtgttaaagtctcccattattattgtgtgggagtctaagtctctttgtagctctctaaggacttgctttatgaatctgggtgcttttgtattgggtgcatacctatttaggatagttagctcttcttgttgaattgatccctttaccattatgtaatggccttctttgtctcttttgatctttgttggtttaaagtctattttatcagagactaggattgcaacccctgcctttttttgttttccatttgcttggtagatcttcctctatccctttattttgagcctgtgtgtgtctttgcacatgagatgggtctcctgagtacagtacaccaatgggtcttgactctttatccagtttggcaatctgtgtcttttaattggggcatttagcccatttacatttaaggttgatattgttatgtgtaaatttgatcctgccattatgacgttagctggttattttgcccgttaattgatgcagtttcttcatagcgtcaatggtgtttacaatttggtatgtttttgcagtgtctggtgctagttgttcctttccatgtttagtgcttcctttagaagctcttgtaaggcaggcctggtgttgacaaaatctctcagcatttgcttgtctataaaggattttatttctccttcacttacgaatcttaatttggctggatatgaaattctggattgaaaattcttttctttaggaatgttgaatattggcccccactctcttctggcttgtagggtttctgccaagagatccactgttagtctgatgggcttccctttgtgggtaaccgtacctttctctctggctgcccttaatatttttttcttcatttcaactttggtgaatctgacaattatgtgtcttgcggttgctcttctcgaggagtatctttgtggtgttctccgtatttcctgaatttgaatgttggccgtctttgctaggttggggaagttctcctcaataatatcctgaagagtgttttctaacttggatccattctcccagtcactttcaggtacagtacactaatcagacatagatttggtcttttcacatagtcccatatttcttggaggctttgttcatttcttttcagttttttttcctctaattttgtcttctcgctttatttcattaatttaatcttcaatcactgatatccttcctttcttccacttgatccagtcggctattgaagcttgtgcgtgcgtcacgaagttctcgtgctgtggttttgaactccatgaggtcatttaaggacttctctacactgtttattctaattagccattcgtctaaccttttttgaaggtttttagcttctttgcaatggattagaacattctccttagctcagtgaagttttttattaccaaccttctgaagtctacttctgttaatttgtcaaactcattctccatccagttttgttccattgctggcgaggagctgcagtcctttggaggagaataggcactctggtttttggaattttcagcttttctgctctggtttctccccatctttgtggttttatctacctttggtctttgatgttggtgacctacgatgaggttttggtgtgcatgtgctttttgttgatgttgatgctattcctttctgtttgttagttttccttctaacagtcgggcttcttcgctgcaggtcttttggaggttgctggaggtccacttcagaccctgtttgcctaggaatcaccagcggaggctgcagaacagcaaatattgctgcctgatttttgctctggaagctttgtcctaaaggggcaaccccctgtatgaggtgtctcttggcccctactgggaggtgtctcccagttaggctactcgggggtcagggacccacttgaggaggcagtctgtcccttctcagagcttgaacaccatgctgggagaacgactctctcttcagagctgtcagacagggacgttaaggtctgccaaagctgtctgctgccattttttctgatatgccctgcccagagaggttggatctagagaggcagtaggccttgctgagatgtggtggactccacccatttcgagcttccaggcctctttgtttacactgtcagcacaaaaccgcctcctcaagcctcagcaattgcggatacccctccacctgccaagctgcagctcatggcaggtcaatctcagactgctgcgctagcagtgagcaaggctccgttggcttgggacctgctcagccaggcacgggaggatatttcctggtctgccgattgcaaagacttggggaaaagcgcagtatttaggcaggagtgtaccactcctccaggtacagactgtcacgacttcccttggctaggaaaggaaaatcccccgatcccttgtgcttcccgggtgaagcaacgccccaccctgctttggtttgccctccatgcactgcacccactgcccaacccgccacattgagatgaaccaggtacctcagttggaaatgcagaaatcacccatcttctgtgtcgatcttgctgggagctgtagaccagagctgttcctatttggccatcttggaacttaactcttacaaagacgtacagagtgttataatgggcattggagactcagagggaggaaggataggagggcagtgagggatgcaaaactacctattgggtacaatgtacactgcttgggtgatgggtacactaaaattcactgttgagtgagaatgcaaattagtacaacctatatggaaacagtatggagatttctcaaagaactgaaagtagaaatatcatttcatccagcaatcccactacaggatatctacccaaaggaaaagaagtcattatattaaaaagatacctgcacacatgtttatcacagtatcattcagaattgcaaagacatggaatcaaccttagtgcccatcaaccaatgaatgaagaaaattgagtgtgtgtgtgtgtgtgtgtgtgtatctatatatacacacacaccatagaatactactcagccataaaaaagaatgaggacatcttcctaagtgaagtaactcaggaacggaaatccaagtgccacatattgtcacttataagtgggagctaagctgtgcgtacacagaggcatgcagagtggtataatggacattggagactcggagggaggacaggaggatggggagggatgaaaaactatctgttgggtacaatgtacactacttgggtgatgggtacactaaaatcctggacttcaccattacacaatgtatccatgtaacaacaacaacaaaaaaatcacttgtacccctaaagctattgaaataaaaacattaaaagaaataggtcggacatggtggctcacacctgtaatcccagcactctgggaggccaaggtgggcagatcacgaggtcaggagattgagaccatcctggctaatatggtgaaaccccatctctactgaaaatacaaaaaaaattagccaggcattgtggcgggcgcctgtagtcccatctacttgggaggctgaggcaggagaatggcgtgaaccgggaggtggagcttgcagtgagccaagatcacgccactgcactccagcctgggcaacagagcgagactccatctcaatagataaataaataaataaataaataaataaataaataaatagatatgagctattaagctatgaaaagatgaaaaaagttgcaaaagtttaaagatagtcattgcattgtttaaagttattttaaaaaaacaaataatacacacttgtttgcataaagaaaaagttgtctatgaattccaccacccagagatgactattaacagtgtctgtctacctgtatacacattttttacaatgttgtttagagtgaaaaattgtagacaacctgaaagtctgtcaataggaaattagttaagtaaattacacttcaccattgaaaagtgttcaccttatatgattcagtttaaagagtaggccaagcaactataaagtagttttcccctacttccttcaaaaaaatatgaaaacttgaacattaagactctataaaaactgccaattttttgcagacaatagagggaaaaagagcatgttaagtgtccatgtaggtgctagtagaaaaatgaagactttggaaaagaaactctgtaggacaactgacccagtttctttaaaaataaaattgcagataggaaacaagatggtagggggagcttgaaaatagatttgagacacaccgggtatttgtaacgtacagaccttacttggatttctattcaaaccaaattttaagaagtatattgccaatgtattaatatttgttgaagctaggtgatagctaaatggaattcattacacctctctacttttgtatatgtttgaaactgtctataaaatttttttttaaagcagtttacaaaacaaggtaatgttttgtcagtgtatagctggagttagaaagttacaggtgtttttcttttttttctttaatttctgttttttctatgacttccaatgggtttttatttttaaatcataattggaataattattatacactttaaatattgaaacatcttcagtgtccagcatgaatttatctttaccttttatgtaagtgtatgttctcaagtttttcaagattatttataatacatttatattctacttttaatcccaaatatattcatgaagtctacttgaattgttaggaattcagagataataatattgacatttgtgtataattttatattcttgtttcagattcccaaatgctggaaaatcctctttgctaagttgtgtttctcatgcaaaacctgcaattgcagattacgcatgtaagtgtaatttgattgtacattttaatgagtggaggtaaacttttaaagactaatatttctctgagaatgaataaaatgataactcggagggtatccttaactgaaaaatttttggcagatagactactgttgcacaggccaaagtgcagttgcatgatcatggctcactgcagcccaggctcaagccatccccctgcatcagcctcccatgtagatgggactacaggtatgtgccaccatgcttggctaactttttttttttttttgtggggacaggggtttcgccatgttgcccaggctggtcttgaactcctaggctcaagtgatctcccaccttggccttctaaattgctgggttataggtgtgagccaccctccccagccatattttccattaatctttgaaacctctatacccctcagcaaagttgcttaaacaggttagacacttactttattgcatttatttttctgtcacagaatcgtttatttggtttagttaggattttatgaaccacttaccttttatcaggcactgtgataagtaccaggaaggtacttatcattcatttagcagatacttatttttggagccacattaggttctgggattacaaagactgataaacagaaacagctcctgttttgacttgtattgagtttgtagactagtggagtaaggcgtacatatcactaataaatataagggaatatgaaagggtactatgaaagagtatagatgactgctctaggcttccttaaggatgtgtgatttttggactgggatatgaggaataattatgaggtaattagtaaaatagagtggagggtgaagggtctttaatcagaggaaatagtatgtacacaaagccttagtggtggcagggagtagatttgtgtgtctagagaacatgaaataagggaaagaatcgagatgagcctggagatgtaagagagcatgtcacatagaccatttaggctgtatttgatttttatatcttaagagcaattggaagcatttaagcaagggataaaatgcttaggtttgctcctcacagagatctcggcctgtaatgtagaaaatggattggtgtgggacatgaagggtctgagacaaccagttagtaggctcttgtggtagctagatgagatataaaagaagctttggttaaaagtagtgagtatgataagatctctgccatcattaaaaggacacagaatgccattaacttggaaaataaaatcaagccattctaaaattagactgtgacgaagtagagtgaagtttggactaagtgctataaatcacaaggccaatatttgttataatatatgtaggacttgagaaggaagagcaaaaagtcataggaaagaggctagcgtaggattgatgaggcttaaggataacaatgagaaggaactagaggataactgaatgagaaggaactagaaaaatttcagccacagatccagtgatagaaacttaatatctgaccctcctgaacatctatcactcaccttaaagtgcaatagaagaacgttgaggttcagtaattacattaggcctatacagattataaaaatctgtgtttgtctttttccaaatactatttattcatttattttagagacagggtctagctatgtcacccaggcaggagtacagtggcatgatcatacctcactgtaactttgaactcctgggctcaagcaatcctcccacctcagcctctggagtagctaggactacaggtgcactgccatgtctgcctagttttacattttttgtagaaacagggtctcactatgctgcccaggctcatcttgaactcctagcttcaaatgatcctcctgccttggcttcccaaagcattgggattacagacatgagccacaacatttggccctccaagtacatattaaatagcaaagataataatagtttccattttagcaaattagaacaaaatctgaattgaaatattgtttatgcataataccaagacagttttgagagtaccagccctaaaataaattctagccttaatttattgctgtgtttccttttagttacaacattaaagcctgaacttggaaagataatgtacagtgatttcaaacaggtaggtatttttaaagtaaaacactatattagaagtcaaaagtacttggttttggtacgtacttggatattatagtttttgcctgtttctgtggtgttaggggagaaaaagtaacaagattttgtttatgctaagtgaaactggtcaaattaattctgagcactatcataatatatttaatttcttcttccaaagattaggtccagtttatccctacaacattatgtcttcttcttagccttagtttcttcttattgcaagtctttcttttactactatattggattatttatcttcattttttaaaaatgctctctaaagttcatggtaatgattttattccaacttttctttttttgagaaagaaaatgttttaatggagttttggtctcaaccagctattaaaattcattttttccttcacaagtaacaacagtggatcttctgtataattagaaaaaaactaaaaaaaggaaagtaacaatatttaaaatataatgtacaatctagtagttgtgctccttagcatttacccatgtacattgaaaagttatgcacacacagaagtctgcacatggatgcttatagcagctttatttgtaattaccaaaccttggccaagatatctttcagtaggtgaatgggtaaataaactgtgatatatatttagacagtggattattattcagctctaaaaagaactgggctatcaagcctcaaaaagacctaggggaaccttaaatgcgtaatactaagtgagagaagccaatctgaaaagactgtgtgatactgtatgattctaactatatgacattctggataaggcaaagctgtggagacagtaaaaaaaaaaaatgaatgatttccagggttagggaggaaggagagatgaataagcagagtacagagaacttttagggtacactataaagtacaatacatatagtaaagtatgatactatataatattacagcaacattgtgttgctgtaatggtagacacagtatacatttgttaaaatccatagaatgtacagcaccaagaatgcaacaatgtaaagtatagactttgggtgctaacgatgcatcaatatgggttcatacagttttatgacataatttaaagaaacataaaaaagtatttggttataatagtgataataacagtaaaagataaaaccagttataatatagaatgttaactgtaagtaaaattgtattaaatataggataatatgaatatatagaacaatatttagaggaaaagagaacatcatttataccgaatttttaagggaaatcagtagaggaaatttcaggacatgagacttctgttgtgcatgctgctttgtcagcttcctttaagaccctgaattatttatctacactgggcaagggatgtcgagtactgcctctcattctttattgcacttcagaattatctgggtggtctaagaacagcaatgatgagtgatgcttaggccccagagatttgaaactaaatctcttgggggtagggcctgggcatttgtagcttctaagagttccctacgtgattatgatgcacagtgaggtttgaaaagcacaagtggccgggtgtggtggcttacacctgtaatcccagcactttgggaggccaaggcaggcagatcacgaggttaggagatcgagaccatcctggctaacatggtgaaaccctgtctctactaaaaatacaaaaaaaaaaaaaaattagatgggtgtggtggtgggtgcctgtagtcccagctactccagaggctgaggcgggagaatggcgtgaacctgggaggtggagcttgcagtaagccaagattgccccactccactccaggctgggcgacagagcgagactctctcaaaaaaagaaaagaaaagcacaagtgtaaaatgatggttaataatgattattccctctaaaaggagtctaggaaactgtattcttttattatgttggtacaaaagtaactgtggttttggccattaaaagtaatggccaaaagtaggagaaagtaggagagccacaactacaacttgggtttgtcgagtgctgtttcacctgactgatcttacttgaatactggcacaaaatgagatgatgacaaggtgacaaggaagcatgctcaggtgaatgaacttctagatgatagaactctgctcctcatgtaatgccatgagatttgcttaagtataaacaataatgacctacaaaaatgtgaagcattaacaaacatggcactgcaaagaacaggtgaggagaatcacacctctattaatgtagtaaagtctcttaaaagtaatgccaaaaccacagttacttttataccaacctaatactttgtaagaatggtcgataatcctgctagtataatatgaacagaaaaggaacaattggtgccaaataaataattacaaattgaatttaaaatacagagctgtacctggtaaatgtctgctgaattaataacctcatagatttttacgaatttggagtataaaggttgaaattctgtgaaaagttcatattggacaataccatttaggaaattataaataaattttaaactagggattagtgtggtggctcacgcctgtaatcccagcactttgggaggctaaggtgagaggatcacttgaggataggagtttgagagcagcctgtgcaagatagcgagaccctgtctctactaaaatttttttagttaactgggcatggcggtacgcacctggagtcttagctacttgggagactgaggtgggaacatagcttgagcccaggagtttgaggctacagtgatctatggtcacaccactgcactccagcctgggtgacagagcaagatcctgtctctaaaataataataataaataaataaacaaatgttaaactaatctgtaaaattcctagattattagattaatagtaaatatgggactctaatatctgataacaaaattttaattcttaatactgtacattaattttactcttatacttggcttttcaaagatgtagtggtaatcataagttaggaactgtttatatttgaaatatcttaaaaattttgggatgtaattgaacttgcggttttcatacattttcctttttcattaaccatttaactttgtattagatatcagtagctgatcttccgggtttaatagaaggagcacatatgaacaaaggaatgggccacaaattcctcaagcatatagaaagaactagacaactactttttgttgtaagtcatatgtatactaatgtgatattcaaataaattgaaaaccagtgaatttagtttttctagaatttttttataaataagaaagtggtagcatatgttactccactaagtcttttataatatggggatggaagtgacattgtttactatatcatatgtaagtttggccatacttgccaacatgtatttccttaagatttccagcatactaccatattatatagtatcatagtatctctttcattcttcactgatgatgctagagttatatatgagattgtcttcatacaaattgtcttatcctagttttttattttattaataactgtaattttatcagaataattaaagttatcttaacacctcgatttctgttacttattttgaattactaagtaacaagtagagtatagagaaattgtttttagcttgagagagtaaaacattttaaaacatagaaatgtatagctattcttcgtatgttaaaggctgtctctttccttctcttttttttaggttgatatttctggatttcagctttcttctcacactcaatacaggacagcttttgaaaccataatactgcttacaaaagtaggttttctgttttactgtgttctgtatttggtctaatacataggaatgtaagactatatgaaataacataattacagtctatacatactccacctttaaagctttgatgtcagttaaagaattacttaaacttgttgtctccatttcctctacattcatttgctcctcaaactactgcagtggataaaacactcctgggcttccaaatccccattacatacttcccaggtttttatcttgcttcagctttggcacattgtttaattcctcttgtttctcattcttagttttgtgaccggtaatcttctggttctatttctactcttacactatttctccgtctactttttaggctcttttttctcatcctttaagtaacattattcagagttctgtcctaaccttattttctatcttactcactcccgttgctttagttacaattaataatattgatgactgccagatctgtagctgatacctaaatcttttcattgttctttctttttttttgagacagagtcttgctctgtctgccaggctgtagtgcagtggcatgatctcggctctctctgtctcccgggctcaagtgattctcctgcctcagcctcccgagtagctgggattacaagcgtgtgccaccacgcccggctaatttttgtatttttagtagagacagggtttcaccatgttggccaggctggtctcaaacacctgaccacaggtaatccacccaccttggcctcccagagtgttgggattacaggtgtgggccattgcacctggcctttgttgttctttagaccagatgcccatcggacatcttctttgactagatgtcccattagtcacttaaacttaatatggataaaagtaaacttttaaaaaacttttcggccatccccataacttagtgaatgtgtaagctatgatatactgattcttctcaccacctacacaagccctgtcagttttttatcctaaatctctctgaaatccatcctcttgtctttatctacgctgttataatcatcagcccttcttattggaatattgaatctggtcctttccattctccctgtgtcctgccttgcttctctccagtccattttttatatggcagctagagtgatctttgtaaaagcaccaagctgatgctgatgttccctgcctaaaacactttgatagacccccatagctgttaggttaaagtctaacctgagcatgatttatgaaatctgcaagtttaggcccctacctagcagtcctcctctgtaaccctctcccctagatgctatatttcagccatgtgatttctctctaagacaacatggtattgccttacctccaggattttatagatcctatttcatttgccactttttgtctataatgaataatactgctgtgaacatttgtatgcaggtttttgtatagacatgttttcatttctcttggatgtatacttaggagtggaattgctggatcagataataatgctttgtttaacattttgaggaactgccaaactattctgaattggtagcaccattgtgccattttacagtcccaccatcaatgtatgttccaatttttccacatgaatgtcaacacttgttattgtctgtcgtttttactttagtcatcctagtgggagtgcagtggtattttgttatagttcttatttgcatttctcttaagactaatgatgctaagaatctttttatgtgcttattaggcatttctgtgtctttggagaaaagtctgttcagattctgtgtgcattactatttgtattatttgtcttttaattgttgagttataagcatgttttgtatttttggaaataagtcccttctcttttttttttttttttttttttgagatggagtctcactctgtcgcctgggctggagtgcggtggcacagtctcggcttaatgcaacccccacctcccaagttcaagtgattctccagcctcagcctccccagtagctgggattacaggcatgtgccaccacgcccatctaatttttgtatttttagtagaaacagggtttcaccatgttggccaggctggtcttgaactcctgacctcaggtgatccgcccacctggcttcccagagtgctgggattacagacgtgagccaccatgcccagctggaaattaagtcccttctaagatacataatttgaaaatattttctccccttctgtgacttgtcttttcactttttcagtgtattttttctgtattctttgtggcacaaaactattatttatttatttaattttccagttttattaaagtgtaattgacataaaaattgtgtgtacttaaagtgtacaagtgatatttggatatatgtttaccttgtgaaatgattgaatcaagctaattaacatgatccatcatcttacatactattttatgtgtgttgagaatatttaaaatctgttttagcaattttcaaatatataatacattaactatagtcatcatactgtaaaatagatcttcagggcttattcatcctatttaattgaatctttgttccatttgaccaacacccctccatcttcctcccccaagcaccctggcaaccaccattttctctgctactatgaattcaaccttttaagattccacatataagtgggattatgcagtatttttttttctgtgcttggcttatttcacttagcatagtgttctccaggttcatccatgttgttataaacgacaagattttctttttttaaggctgaataatattcagttgtgtgtgtgtataccacattttcgttattcatccattgatggacactgaggttgattccatgtctcggctattgtgaataatgtttcagtaaaaatgggaatgcagagatctctttgacatactgattttatttcctttggatatatacccagaagtgggattgccggatcatatggtagttctatttttaattttttgagaaatctttatactgctttttacaatggctgtactaatttacattcccactcaacggtgttcaagagttcctctttctccatatccttgacaacacttgttatcttttgtctttttgataatagccatccttccaagtgtgaggagctatctcattgtggtttttcttttcatttccctaatgatcagtgatgttgaacattttttcatacatatattggtcatttgtttgttgttgagaaatgtcaattcaggttctttatccatttttaaatcaggtttatattacccaaagtgatctacggattcagcacaatccatatcaaaattctaatggcatttttcacagaaatagaaaacaaatcttaaaatttgtatggaacatcaaaagaccctgaatagccaaagcaatcttatcttgagcaaaaggaacaaagctggaagcttcacactacctaatttcaaaacctactacaaagctatcataatcaaaacagcgtggtactggcataacagtagacacataaaccaatggaacagaatccagagctcagaattaaatccatgcatttacagttaattttcgacaaaggtacctagaacacacagtaaggaaaggacagttttcttcgtcaataagtgatactgagaaaactgaatatccacatgcagagaaatgaaattagatccttacttcacaccatataaaaaatcagttcaaagttgattaaagacttaaagcctgaaaccataaaaccactagaagaaaacagagaagttccatgacatttgtctgagcaatgatttttttttaatgtgaccccaaagcacaggcaacaaaaagaaaaatagacaagtaggattgcatcaaactaaaaagcttctgcacagcaaaaggaacagtcagcagagtgaagaggcaaccaagggaatgggagaaaatatttgtaaatcatatatctgataagtggttgatatccaaaacataaggaagcaaaacaactctcaatagcaagaaaacaactcaaaatttttaattttcatgaaattccatttgtttcattcttttctttccttttttaaaattaaactaaaattttgtatagagatggggtctcgttatgttgtcaaggcttgtcttgaactcctgggcccaagcaatgctcctacctcagcctcctaaagtgctgagattacaggcatgagccaccatgcccagtcttacatatttatttatttttattacaaacagggcttcgctctgtcatgtaggctagagtgcagacatgatcctagctcattgtagcctcaaactcctggtggccttaagcagtcttctgccttttatctattattttacttgtgcttttcatgttatatctaagaaacagttgtttaatccaaggtaacaaagatttattcctaagtgcatttactttttccaagaatactacaggtataacattcagtgatcattactgacttctgaattttatctgtgtgaagtccagatacccatatttgactctagacgcaaaattacaactgtctctaggatatcatttaagctaaaacatactaacacatgacttaaccagagtcattttctgaaattcttccttttgttttctgttgttgggatttattgcatttcggtgatgtgaatgggttttagatcacctgggtcattaattaccaaataagtagtttatacagaaaccagtactaaaattattgggttttctcttttgatttaaaggagttggaattgtacaaagaggaacttcagacaaaacctgcactcttggcagttaataaaatggacttgccagatgcccaagataagttccatgaattgatgagccagctccagaatcctaaaggtaaacctatttattcatttaattctaatttaaagaataattacaatgtacagagaatgctgttataatcagtggaaaactgacagtttctgctcttaaaagtcaagtttgaagaaagaatatacaaaacatgtaaataacattgtaacataataattaccaaattctagaatgtttgatatggacagtaaattaaaggagacaaaagaaagattaatttgaactaaaaaggtcaggctacatgaagaataaaacttaaattgggcccataaggcatatgtgggatttgaataaaaggaggaaaaagtcagcatctacctgtgaagtctttcactttcattaacatacttcacaagctcttcattcgtctagtactgtacatcataaaattaaagacagaactaagaagttctaaagaagtatgtttcttggcaaaagtaactctataggtttctgaagaggatgagtcttctgaaaagaacttcatttttcctgtgtatgtgtgacacaataatagaagctgtgactccaaaatgatttatttgtctggaatttacttcctggactatatgtaaagtaacttaaagggattctccacagttttgaatattgacatttgcagaacaccttctatcctatggcaatggtggtttcattcagagtctagtagagaacctcatgcacaaatgaggaaaagtagggtgtatggtatgtggctaacatgtttttcaatatgtctctgtttttattcttggtaacaattgttggaaaatagattataggtactaagactgtcaaacagcaccagaaggtcctttcctctcaaaaatctttcccctgtgtaatctacatgttggagctgtccttgagttaataaattactcatgggatataaatattctctgatactaaatagccttcattcctaatgacatttgctttgtatggtcattagttctttttgctagttgatcttgcagagaagggaattttcagaggaaataccgaaagtgagggtgactcaggagtctgtagctgttctgacctatcgtgaaataaaatataggccctttagtgataatcctgagttatcctctctggactttcttcggggcttttgaatctcagaaagtaagctccatgttgtcttctccaccaatctgtttcagtccagcctttctagttcatatcagttaatccatctaatcagtatgccatctccccagccaatcagtatgccatggtgacagggaagaggtaaaagtaatataacaattgttagcccttgtggggtgatagattggactcatctgaaattatcttcccttgaattctctataatccctcttcagtttttgtatggatcctagcatcattgatgataaacctatactttggggaagttaaaggtctccagtgtactgaggccaagtagaatgtctcaaatcataaatgatgttattatttttacagaaagtatctttcagagaatcaatgctgccttgccttatttaaccccccccacacacacaaaatttattacttccttaagtaagtcatttttgtgattcatcttctactcatacttagtttggtttaaaatatatttatctaacaagtatgttatgtgccaagaaccttaccataatcaatggtaaaatccaaaggctctgagaacttattagaaaaggtgaaaaaaggcatgaaaaatgctggtgttggttccctgcttcacaaatcaaaccattaacatggttttaactaactttcgaaaacaatggaaatcagctttgtttgtgctctttcttttagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggagagaatagaatggtggttatcaagggctggtggggcagtggaggattgaggagatattggtcaaaatttacaaaatttcagttagacaaggcaactgagttcaagagatctgttgtacagcttggtgactgtaattaacaacaatgtattttgaaagtcactgagtaaattttaagtggtttttccaaaaaagcacataaggtaatgcacgttaattagctatattgagccattccacaatgtatagatatttcaaaacatgttacacatgataaatccagtttttctacgtcattttttaaaattatatttaatttttttattttgaaagttttttcacagatcttttttttagtattattaccttctgatatatgtgtcattattgaagaaccataccttttaaagttattattttgtaattaagtatgtcaacagtaaaaaataaccagtggccaggcatggtggctcatgcctgtaatcccagcacttttcggaggccgaggagggcagatcacttgaggtcaggagttcaagaccagcctggccaacatggcgaaaccccgtctctactaaaaatataaaaaattagccaggcatagtggcgcatgcctgttgtagccccagctactcaagaggctgaggcaggagaattgcttgaacgcgggaggtggaggatacaatgaacccgaggtcgcgccactgcacttcagcctgggtgacagagctagactccatctcaaaaaaaaaaaagagctaaaaaattacattttacaagtttatggccagcccacctgtaataacattctctgatattcctttacttaggatgtccctattgagatcattttttaaatttatgtggaaggattctctagattattattagaatgagcaattcagttttgtttgtttttgagcctgtcttgtacctggttgcactaaatatataatagttatcttttgtggagaccttaaaaccctaaatttgaatacatgttcaatgatagtaaagatatgacagaaactagaagatagctgtttatgatttgagcttttggaaaattttcgtttcttgaatgtaatagtattttttcctgaattggaggagactgatctatattgtttcatttttcttttgtcctagtctatttcactttcttttgtcataatctatttaatttcccactttcttattttagtaaagagagaataaatagcaagtgcaggccaggcatggtggtgcaggccagacatagcggtacatgcctgtaatcctagcactttgggatgccaaggcgggaggattgcttgagcccaggagttcatgcctgagcaacatagcaagaccctggctctctataaaacagaaaacgcaaactttaatattatcaacaatcaatatattataagagattgcaatttctaagtttctacctgagtgtttcacaaatacaaactggacattttccctttaaatgagttttattataaaatgtacatattgattgtaaaaacaaaaaattcaaatagtacaaaagcatataagtaactaataaaagctccctttctgcattaggcccctcagttcttcccagggaaaatgattaatagtttacattcttgcagaaattttttatgtataaatttttacccaaatgaattcattatataaattttttccaacttagtgtttttttacataatagtagcaagttaaaaaattgtacttcaggccaggcacggtgggtcacgcctgttaatctcagcactttgggaggctgaggcaggaagaccacttgaggtcaggagttcaagaccagcctggccaacatggtgaaaacccatctctactaaaatacaaaaatcagctgggcatggtggcgcatgtctgtaatcccagctactcgggaggctgaggcaggagaatcgcttgaacccgggaggcggaggttgcagtgagctgagattgcgccattgcactccagcctggaggacaagagggagacttcctctcaaaaaacaaaatattgtacttcaaaaaattattcttcaatgctatttttaaattactagaaattattttggaatttaatgttgcatacagcctgagatatggctgttcaccctttggtaaagtattaaagaaaaataatgcattgttctcagcttaaatttttttctgatttgacaacatgagtgatgttttcccagtattatttcaattatatttgttttattttctgttcctcactcctacctctcattccagtccccaaactggcttttcttttatttcttttttcttcattgctgatgtatttattgagcaatgtcctgtatcaggcactgtccaaggtgctgtatgtgccatgttgaagagaacagacaggacctactgtccttgtatatcttgcctttgataacagaaactgcaggggattggaatagcctctttacaagaaaagaataagagtgaggaaaagcgtttggaatttatagtgatcacagtgaccaggttttgtattgggtatgttttacatttgtaacttcagtgctatttttttttaagctccattgttttctaaatgtaaacaagtatcaatgtaaggacagtttcatcaggtgaatatcagaagtactgacaccataatctcattttgcactgtggcaaagggtagtagatgtgtgttcaggattatttgctctgtcagtagtgcccagggtgccactccatgactaaccgaaacattttattatgtgactcactaagatgttcaattcattagtattttctggttactcaaagtgtactctatgtacctttttttgacctttgatttttattctgatggagaagatcagattccttttttatcttataaaaaataattttgaaacaaagacttattttgaagtaagtcttttaacattatctcagatgcattttattttgtccttaagtaagacttttcatttttacctttcaaaatgcaattttcaaaatatatgcttttttgaaacacttattatgttactgaataaccagagtattaaattcaatgtacagcaaatttttacaaagtcccagtagttcttgcagagctttctataatatcagatttatttaccatcatgaaatatgtttatacagtattaagtatattgtactatgaagttggacctgcacactgaaaaattccaaaatacctattatgttgtgctttttgtgatatatattcatattattatttgtcataacaaggtgaacttttttaaaatggtaaacatgtattagttacataatcaggaaaaaagtcatcttttataatgagaaaaattaggtcaaggatatttcaggttttatccaattagatttcttgtaaagttatgtgttttcttttatctcagtgcttatttgctttgcaaggatgaaggttagagattcctttcagtagttaatgaaagctacagacttgtcttgccgaaaaatgtacataaacacataaactattttccaagcagtttcacagtgtttgcaaagttcagattgaaaacccagttttacaaatcccatctacaaatttgcattgtcattaagatatattaaaaataatttttcaaagcaacagcacagatgcactttaaaactgtagcttaaaaataaaaattagtaatataacttgtgtaaacctacacaaaagataaaagatatcttattgcaaaaatagggcaacattttgttttaaagaccaaatagtgaattgaatttaatgcatatctttaaatccttaatagtatctcaaatctggtttaaatctgtctctccttaacggaatagaaagtgaaacaaatccagaaatcttgttcgagtacatggtctgtgctagtaatcatatctaaagtggtaatgttaccatatgctgggtactgggctgagtaaatcacatattttaacttatttaaacactgcactgtattgcctgctagcgatgtcatttttttaaagttggatggtgaatacatgagttgttttttaaactcttttgggagcctaaaaaatttgaatttttttttttccccccccagacggagtctcgctctcttgccaggctggagtgcagtgacattatcttggctcactgcagcctctgattccctggttcaagcaattctcctgcctcagcctcccgagtagctgggattacaggcatccaccaccacgtccagctaatttttgtatttttagtagagacggggtttcaccatgttggccaggatgggaaaattttttaaaagacatttattaaaaaaaaatgtctatgccttatcaaagtttataactcaagaattaatgagataaacagtggacaaaaagtgttggcagataacatgcataattttaattaaaagttaagcagtgaaaaataaacatctttttttcttaaagagatatttcatatctgttctatttgtttagttttatttattctttttagagacagggtctctctgtggagtgcagtggcatgattatagccctctgcggcctcaatcttcagggcttaagttatcctcctgcctcatcctcccaagtagctaggactacaagtgtgtgccaccatacctggctaatttttaaaaactattttgtagagacagggtcttactatgttgcccagagtggtcttgaactcccatcctcatggaatcctcccacttcagtctctgaaagtgctaggattataggcatgagccatttatgcccagccagttttcttttttctaattgaagcttggcaagcagagggaaatgtattagggaaatagctttagttttgagtgggtgtcagtagccagctgaagaaaaagcaaaatgaaataggtagtagaaatgagaaagggagagagggaagaagaaaaaaatggatgttggaaagttgttgcatgtctctctggatagctcagaagtatcagttgtggttattgcctcacttggcttttgtaagcatgaaaaagccagggacaatttcaactaccatttctgaccatcatcaaccacaaattttaggcaatttgttagaattttttttaaatgttcttaatagttgttgggtacctgggagatttcagagaaagtaatcacctttgtatatattattaatgtgtttataatagaaattaaattctttgggatgtacaggtaagataagctatgtgaagcatagctgttatccaagtcgtgtgcctttgaaatacttggaatttgaagaacaggacatgcagcttatgttataattaatttgcgagcaatatatggcatgatagtattttcttatctaaattctgagtgcattgaaagtttaaagcaaaggacaaaagcttcctttgttcatggcccatattccagtatatttttctgaaactgccaatattttctgatcggtactttcatttttctagttggttaccaaatactgttattggtattatttctatataaaaggctttaagaagactatagtataattttcttaagaaaaaagacatgattataagctaaaatatgccttcggttttgtgtgctacaaattgagggagattgagaatattttaaatcaagggcagacattgagtaaaagcttatgactttggatggatttgaaacatgattaaatgacagagtaaataaaagcccctagtcaagtgaattctaatgggggaaataagaggactatataaaaattgaacctctgttttgaaaacaaatctttccaggaagtggtaccactctggggtcaagagaaattgtaagaacaataaaatgagcacacatgaccttcctttcctataaaaatatgaagcagaaaactcccccatgatttcctcatgttgcttagaatagtgtgtatttcagaacttttccatttaatatttttggaccacagttgactgaaactgaggatgggaggaagggatgcttaaaaccttggatagtaccaaaccctatatatattatgtttttttctatatatacacagctatgataaagttcataaattaggcacagtaagagattaaaaatattaaattgggccaattaatatattgtaataaaagctatgttaatgtggtc

SEQ ID NO: 1878 - DNA, 44792 bp, Homo sapiens; identical to SEQ ID NO: 1877

SEQ ID NO: 1879 - DNA, 51227 bp, Homo sapiens
atcaaattccaagtaagcattttttattttttggcataaaattaaacttttgattacaaatagtgattatatattatgaacattagtgatttttaagcataattaattgatgttttatgtaattatttgtacagttgactaaaaattttataaaaatgataattattttctagatttctaattgttatatcctctaaatatgatctgttcaccttcaacatataacatagaactttctccttgaaataaaagagtcgattgattgatttattaaagacagtacccaaatcttccactacaggttatataagaatatatgttgaagaaaggcaggcaagttatgccgtgattttctagatatgcttaatgaaaattttgtagacatttaatagggacgcacgtcacacttaaaattcattctctaactcctgaaacattgagcaagcagaagagtttgtttttattaaaaaaggaaatcattacctttctcataacacactactctcctacggtggctccctgatttgtttggtatatggaaatttgtgaatttgactcttccttacacctatcaaattccatctacactgtatgcattaccaggattcagcatattgttaatcattaattaaggttaacgataaaataatttgatactatgaatagaacatatttaaaattaggtagtatccttgtgtcagaaaagtgacaggaagagggtatagtcagcagggagagacaaaggaaaaatagaagactataactcacaagttaataataatcatgccaaaatctaggctttatcagtaggcttatcgcaggtagagaaatagaaaatttggaaacaggatgggagacgtgtttttgttaaactccttttgtctggaattaataggactacactactcaggattttgccaaacttaaaaatatatatatttcctctttttcttgacctattctctttttttcttctttcctatcttaccaaatttttgacaggaaaacaaacaacattgtatgaccaaaaatatagccgttgtcacacagaccagcaagaacccaattacatccaaagagtggtactggaaccaggtgaggtcatgggctgcaacccgaaggtgcttggctcctttgtggcgcatgacaaactcgatccagaagactgctcgatccaggggctttacaggttgatcatggtgaattcttgataacctcatagcattctctttataactagaagacaaataaataggcagaaattagacaatttttgtttttattttcattgaagataaatatgtgatacacttttgctctacaagtttaaggccatagttacgtggagaaaatataattcttgcatgaactttgttagttgtataggattttaagagttacaaaaaggaagatatggatgaaatatatgcttaacacagtatgatcaaatgtagacataaaaaagtagagtaagccagttgtaaatatagatgtttagcataatttttccaaaaataattttgatactgtgtgagctatactgtaggatggttccaataccaagatggtacataacctaatactgtgggataaaaatcatttaagacatacataaacatatcctctagtgtctggctagttcatatgacagacaaaggaaattggcagtcagcattagtgagtcattttacagttctaagatgtaggcattgtgataattactctgtggcacacatctgtatgtttgtgacgaaaaggacagtgtctgtatctgtaacatgaagactgaacaaaaatactctggtgatttaagaagtggcatatccaagtacatgaactttgatgtttcaattgaaacatctccctagaattagagctctaaatcaacttgccatcacaatagagatagtaacagagataacagttctaatggcttctcaaacaatattgggtggatatctacatatttaaaaggcaaactgtgtcttcacttgcagtttccctagttgttaaaccaaaattagtaggtttcattttggtttgtgtctggaagaaaagttccagcctggattcatgaagatgagcgaaggtaaatggtttgtgcagagatgtcccggtgttggcaggacattgttaggactggggaatggggaacatggtcatcatttacaagagaacatggtacaactagattcagcagcaggagtagtttacatgtgttgagtgtgtgtgtgtgtgtgtgtgtttgtgtgtctgtctgtctagtgaaaaagaatataagtaagtaatttcacatggatcatccgaatatactttaggcaataaataaatttgtacatgtgaatcaaaaaataagaagaagaaagcatgttttcctataaatgatgtgggacaaagaccatgctcataaatttattatttcatgttttattatacactaatgttttatgactgatatgttaaaatattctgaataattaaattacaatggtctattcaaatgtaattgttaatgtttattaattgctttaatgaataacagaatggagtacaaacacatccatatatatactctacactataccttgtgttcccagaggtggtatttggtttagggttaaagtgaagttactttaaattaaataatttttaggcatttatttagaaatttctaacagtatttatagttctcatttttttgcatcaatagttttgtcaatgaaatgaatcaaaatctaaaatatttgaagatatttatttgtagcaaaatatgagtgaccatggcccatgataaagccctcaggaagtcctgagtatatgtgcccaaggtggctggggtgcagcttggtttttacattttaggaaggcataagacattaatcaaatatgtttaagaaatacattggtttggtttagaaaggtgggacaacttgaagtgggggtgcatccaggctataggtaaatttaaacatattctggttgacaattggttgagtttctctaaagacctgggatcaaagggaaggaatgcctgggttaagataaaggattgtggagatccaagtccttatttgcagaggaagccttcaggtagtaggcttcagagagaataggttgtgaaacgtttcttatcagactgaaagtctgtgttgatgctaatgccagagaggtatactaaggcatatttgaccctcatttcccatcatggcctgaaacagactctcaggttaaattttaacttcctctggctgaggaggaagtccatttggatggttgggtgagaagcttagaatttttatttttggtttacagttttcaagtcaataataaaatttaaccatcattttaagcattagagttaaagagaatcacagactgtacctacactgataattaataaaatgaacaaaattgtcagcaactaacaactttgtaatagtctaattgactagtcattaaagtcaaaaaaagatcatactgagccttgctgaagctcctaacccaccacttagctcatgaattatgatttctaaaattatgacttatacaacatgtacgtattaataaaagtcaattaattggaatgtggatggggagcaaaagtggacaaccagggctgagtcttggtatgaatctaaaccaactgttgagtgtctttcttttttgaaatgaatacattagccctcgtgtctaaaatgcctggcaaaggtcactgaatagatgtttttaagcaggttacttccgttaagaaaaagcactaaattccatccgagtttaccttctcctctcctgaatctcagccttcaggaaaagtgaatgaaatattaaagctattcttcaagcttggactctacatgaaaacaattaagtccaatacaacataaagcaagtttaaagcacccacacaaattcagagcaaacaccaagaccgagaaaaaataacagcctgataaccacttacacatattgaaaaataaatgagaaactaaaaatgcatttaggtattgcatatagtccaaagaagaggagattcaaaatacaataatagcgggagggtaatgaatatgatatcaaaattgacttacaaagcaagaggaagtgataaggagataggtgagctgatgatacaagttgttaaaaatgacagttgaaagaattaataaagaaattagaaacagcaagcaatgctcatggtaaaaataataaatttactaatttgtgaactattggaggcaatctcaatgaattaataatagtaaaaattgattagaacaattagacaggaaataagagaggaaaacataccaaaatactttatcatagggaagactaaactggtgctccagaagtaaagataaaaaatggaaataaaaggcattcaaagaaataatacaaaaaaaattaatttctgaaaagaaaaactggataattttttatcttagattaacattgttgtaaagacacagtataattgaagaaaaatatataaaataatttgtaagaatacaccataactgagtttctgaattttaaaaagtaactatttctttttccaagttgaaaagaaagcaaaaagatacaacagtcaggcaggactcagaaatcatatagcacaatttaaactggaaggccataagtaatatttccacaggtctgaaggaaagaaagcaagagctaaatatattgtattcagataaaagtcattctcataacaaagcagtgagtgaatattgctaaacattatctcagagaattcaatatccaagtctttattgaaagaaaattccatgtgagataatcagtcaagaaataaatcctaaatattttggaataaataatctctaattcaacggtgaacactgagtcccttaaaatataggaaacagagtaaatgtgagaaaaaaatgacataaatattggtaaagtaaaattacaacataagtaatataaatttggaatgaaatagagatacatttcaaagcaggagttcaactataagtagctaaaattaaaacacatcatcaaaaataaagactcaaaattacatatacatatatcatattactttggtgagatctttcagagaaaaaaataagacacaatatatatacacacacactatctactaagctatatatatagacttatatatataatatactaagctatgtatacataactcaatatattttatagattcatttcaatctaaaagctgaatcagataaaattatacttaaattttatttaaaatatcacatagtacaaatcaatatttaaaaaattatccactaccctatatcttttctctctgtgtgtatacatatactaattaaaggtatcgaatggtatatactcagtgtgaatagttatttctgaatgcttattactgagcgtattatcatttcaattttgtatttactgattagtttataatatgtacatacttactaattagtttataatattaagcagattatccagaaaaaatgagaatttatataatcatagcattctttattttgaaaaatattgaaataatatttgaagtctttttttttgtttgtttttttttttgagactgagtcttgctcttttgcccaggctggagtgcagtggcacaatcttggctcactgcaacctccacctcccgggttcacgccattctcctgcctcagcctcctgagtagctgggactacaggcgcccactatcatacccggctaaatttttgtatttttagtagagacagggtttcaccgtgttagccaggatggtctcgatctccggaccttgtgatctgccaccctcagcctcccaaagtgctaggattacaagcttgagccactgcgcccggccaatatttgaagtcttaggattttcttatttttctgatttcagcaaatcactttagcagtttggcaaataaaatagtttttatattggtcaggttatggttgttattggaaaataattacaaaagtataaaagaatgtacattttctggtattatgaataatgtaattaaagttaggcaagtttttaggagccttagtacttacgaaggttcattaatgactgttctcaaagcgctaagcaaatccacacttgtcattgtgtttaggttcacttccacagctgctcctttggccttcatgtgagcaatgttatcaggctgatcagcaaacatgggaactcccaccatagggactccgtggtaaatagcttcgtagatcccattagttccaccatgagtgataaaagctttggttttgggatgtcctaatttgaggatggagtgagaagtgggtgtgtaataataacacattagcagaatttgagagacagaaggggtcaaaaagctgtaatgtaactctctaaagaaggatacgttttctacaaaagcagatcacatagggcattggaatgtcagaaaactgtgatcccaggaaaagcagtaattaacagcatttgcattttctgggaatatattactgaggagatgatatctgaactgaaaatgaaacttgaagtgtgattaatgttaactgaaaatgctcttttgtgaaccagaggaagcctgagtctataaaattaatggccaattatgtaattatatctgctttaaaattgagtgtcaaataacattttaaattattaaaaatgtattgaatttatttgctattaaacagttacttaacttgtctattgtcccactgtacagcttttctttccccacagtcttaccaagaagatcattctggggtatccaatcaaagagctgagtattgtttcctaatgtggctggtttctttcctttgtatctccataaaacctgtggaaaatggtgctttaattttgcaaggaaaaacacaatgaggacattttaagttgggagaattatttagaaatcatttagccagctacttggaagacgggaattacataagcagtagtttacaaacgttgagatacgtagtaggactgtttatatgtacctttttgtaaagtcttgtactaatagtctaccaagtatagtattattgttttgatatttatcacttaaaagcttttggaagttagattttaagtgaagaaatagaacgtaaacagtaccagtttaatcaatcacaacatgaaggggaaaaatcatgaagagtgttatgtgctttaaacaatacataaatataaagagtcctaggatgtgtcatgaatagaagtataaaaagaatagaaatgcaaaattgtagagataaaaattaaggttaattgaataacataagtcagaaattgcatgttgttggactataatatttgaattttaattgtttttagctagagaatattcaacttagaaaggctaagtgaattgaggcttctacttctaaaccaactacactttgatagagttgtaataaaacctagacattcgaattatatttttagcataatttctccctgctttgtgtttacactctcttttcctggaccatggagctaacaaacttcaaaacttttgaaagtagtcagtggagaacaaaaaatttcaaatagtaaaaggtcagtaggggcttaaagttttcatttctattccattaaaaataaatgacttcaaaaaagtatgtgtttctaaaataatgccaaggctcagtaggcaaatgattcaatgtgctaatgtacacaattttaatatattacacaacgttacttacaactgttactagtgatactcagtgtataatgagttttgattttcatatggaaagaacattactagctgcattgtctctcccattagtaaaaagctgtgtaccaggattccaggctgtactgaccttctgtggaatctgggcaagggctgaggcaataagattggccttttcttctgtaaggtttttgaccattgatcccagagaaaacaccacaacaccatttttacctgagctctggataaattcttccatttcctgcatacataatatattttctattacaaaggtgtagcatcataagaaaaaataagtttacttacacatttaagtaggtaaaattaagatatatgtcagagaaactgttgaactgtctgtcttctgacatgtagaaagatctagtttctatatttttttttggcagagtctcgctctgtcgcccaggctggagcgcagtggcatgatctctgctcactgcaacctcacctccccggttcaagtgattctcacacctcagcctcctgagtaactgggattatagtctcatgccatcgtgtctggctgagttttgtatttttagtagagatggtgtttcaccatgttggccaggctggtctccacctcctggcctccagtgatccacctgccttggtctcccaaagtgctggaattacaggcatgagccactgtgcccagtcagaaatagtctccttaagaggaaacacgtctctgaaatgtataacttaaatatataatcagtgattacaagtccaagcatgaaagcaaaaccattacagaaatgaacactaaataagggacaactcttctcatgctaactgaaattgttacccccaaggcttaatttaaccaatcaacagggttgtttgcaaactcataaaaacagtttttggagggaagcccaacaaaggatactgagctaggcttttaaaattgttagcattccagttatatctaataaaattattaataaatttatcggttcctgttaagcattcaagatcattttctcaactgtatgcctcctttgattcataggtctaagaaaaaatttgtttaaaatggcatctaattgtaacatattttagaacaggataacaaagtgcatctccaactgtaatcacaatgatgcgtatgagacagtgcatctctttcttcttgatgtataagctgccatgagtgtgatgttagctatgtgcccttaatttgagccttaaagcaaaattaaaatataaatttgtctgccaataaaattccttaggtaattacttatagttttgcaaatttgacactgcaaaatctgagattaaggcctttcacatcatatctatatgaatgctactttctacagatgtatcctgcattccctgtgcaaatatttgttgggatcacactggaatcactgatgtatcactttatgactagccaaataactaggggagggtgatatcttaagtgaaaatagattgctatttttggcttagttaatgtcaggagaatatttctgaagtcccaggaattggtgctttgccattttgatttattttccaaacagatattaattcattaaaataacacacacacacacacacacaaacatacacatacacacaaacgtacacatctatcatactgatatggatttttcatttgacagtctcttgttgtttttgtattctgtgtacccagtgattggcgtaattatttcatcagcaatataacccatggttggtattcatatttcccaaagcctatatcgatatttatattgattgaatacataatggcataatgtctgctattgtaaaacatggctgatttgtctttgtgaaattgtgagaatatgtgtatatgtgtgtgtttgtgtaaaaagtgggtttgggaggaaaaacataatagggtgtcatgggtcattatccagtgacctatggatacgtcatgaatatttctgtgtctttatttagatattggtacattatttcctataataaacattcactagagcttgcctgcagccataacttgactggccagaaaatcctgaaataaaatttttagaatcctgaaataaaattttaaacttaaatatgtctgttactataaacagaaatttagtactcttataggaacctgcaactttctaaaaagattacatttgcttgtgtataaaccaagtaaataatagcctgtttcctcactccttattgatagttaaatacattgttcctaccatgtgtacctgtactctattttgcttctcaacactttttctgtataacatttcttatattccacatttcttttctgaagacttcatattgtagcatacaatttccttctcatgccataaaacctgacactatatttataaagaaccaatacaacatttgtatctctcagttttataatagctactttatgctgatgaatctgaatctatttctaatgcttcctgcttgaatttacactttgtactacctaaatgatttctagaaattaccaaaactcctttttgttccttacagtaaataggtcagaaactaaactcaccattgtcaactcaaaagagttttttttttaaccaattgtttcctaacagtagatggcacaactgtctaataaattctcaagattaaaacctaagagccctgccttatttcattgtctttcttcaataatgacctcttactcaccaagttaaatggaattcacccaacagttttcatgaagacatctttatctctcaagaaatttggtaaatattactgttcataatgctatgtggcttggtaagactagggcagtatccttcgtaatttctatgatctggttttctgtcccaccaagtccagtatcaaggtgtagacacactgatatttgtaacacacagctttaatcattttattcttcagtttaaattgtcaatgtaaagttcaaaacacctaatatcacttgtaggagacctctatcacaaggaaaatagatgtggagtagcaaactgaaatgtccagcagcatttatttgttattgaggctataaactttaaaagaaaattaagtattttattatgaagagcataaaatcctccactgttgtagacctaccttaggtaaaggtttggcaggtttgcagtgcaatcctccaacaaactcaaaattaggtaagtatggacgaggaaattcaaaatcccaatatgttcggattaaccaaatttcagctttccccatagtctcacataacgtagtgggtcttcctggagaaaatgtaacaagttggatggaggaaattagcttatatgtttgctgaggagaaaaaaaagctaccagtaatttcctgataagctgttaagaaaaaactgaattaggtcttctagaatacttatcatgtttatatattaagaagaaggagaaattaaagaggatggaagaaaggaaggaggaaggaagaaaagaaggaaggaagggaggaagggaggaaggcaggcaagcagggagggagagagaggaaagcaaggaaaagtgagaaaaagggaagaaagaggtagaaataaagaaagagagagagagaggaagagagagagatggagaaaaggagaaagggaagaagagagggagtagagtggggcctgggaaaggaaggaaggagggaggattttttgttagtgaaaaagaagtaatgtgtaagtgtaatttcacaataataaatcaaccaaaattaaactataactacaactactgacaaattaaacattcattttctctcttcagttaaatgccagataagtttcttccccaggacagcaaatcagaggcattgctagcatgcctctcccacttgaaaagacaatatagtgaatagagagacacactgtgaatttgtttacaagaagcaacacagaaacttaacagaaaaataaaagtaaccataaaccctttgaaaaaagtggtgggcagcagcctatcctgtgagccaggtgaaaaaccatgagtccccagagtgtgagtggggagaaactgcctctgggatatatacacccactgggaaacctggcaatccagaccacggggaaatgccttaaccctacccagtactggagctgctttagtgagcagtgggaaacacatgagaaagagcagcatctggacatggtttgtgtgcactcccagactccagcagggacagagaaaagtcactcctaatcctatatcacaagggaccttgcggaagtctgtcaactaactcaggttgtggtcacaggttgagagagctcccaactgagaatcacagtacaattttgagtggggacaaactccctttggccagaattgaggaatgagtaggaagtgtgctatggccacaggcacaagagatggacatccctactttagaggagcatggcctgaaagccacagtttccatctcagtgggtgtgttaggcctttctcttattcccataaagaaatacttgaaactgagtaatttatttttttaaaaagaggtttaattggcttatggtcccataggctgtacaggaagcatagtggtttctgcttctggggaggcctcaggaagcatctaatcatggcagaaggcaacagagcagcaggttgttttgcatgatgggagcaggagcaagagagagagtgagggcaaaggtgctatacacttaaaaaaaaaaacagatctcgtgataactcactcactatcacaagaagagtaccaagggaggatggcgctaaacctttcatgaatactctacccccatgatccaatcctctccaatcaggccccacttccaacattggggatcacaatttgacataagacttgggcagagacacagatctaaaccatctcagtggggaaggcttatgacctggggcatttttgagttttgagaggagtgtgcctggaatccagttacctgatgctagtggaatactgcaaatgtgagaactgccttgccaagcatgtaggagccaggtgaggtttacttcctgctgctacacatactccccatgtggattcttctgtgcagcagaggcggctgcacttctccctggaacattaccccaacagccagagagcttccctctgatcctcactgtgaccactactcatgcctacatagggggagccagagcacagacttgactgacccagcctcgtgttcttgctcctgcacctgccctggtggcttaacagaaaggacagagaatttggggagctccatgcccttccccgccccccggagtactactcctgggtaacataaggcaagcacaaaactcacttctaccactacaattggagctcttttgcaagtgccacctcttggctagaggccaactgacagtccattacagcatctgcaggcataataacacaaccccaagaaggaaaacacttctgcatgacctcagctatcactattacctgcatcactttgggtaaccaggaggtcctgagtttgtccacatgccagtacgttactaccacagctggcatttgagaaagtcaacattgctaaggccaataaccaaggaatctcacaaagtctatgtaactcccctgccacccctgtcagagctggtgctggtatccactgatgggagactagaggacaggtcatatcactggatcccttgcagacattccctagcaccagtctggggtgtgacagccctactgggtggccaggtctagaggagcagcagcactcatagtagtctggccctcagagactcttactcttgggcaaaggagggctgtaccacaaccatgcaacttgagaaattaaagggtagagtaaaactaagacaacttgaataattaatataatcaagaaaaagtatattattgaaatagaaatcaaattaaaagtcaatcatactcaaaaatagatgctgttacagttaaaatgattatctgactaaatctagtaatattttaacaaaagatatgaaaaagttggactcattatagtaatgaaatgatagcttaaaactgaaaagtagataagttcaccttattagaaggtaaaaagaggaaaatcctatcatctcaagcaataaaaacagttgttcataatcttgaaattctattagtaaactacaaatagaaaagaatttctttacaccaacaaaggcactccaaacaaaaaagtttcatcaaatgtaacctttatgttaaaatagtaagagcattcttatcaagacgaaaaaaagtcagtggtatgtactaatgacaactttaattcaacaatactttactgcagttaaacaagaaaaacaatttttagaataacaaagatttaggagtttatctatctatctatctatctatctatctatctatctatctatctgatatcatgttatgtaacaaatccaaaacaatatacagataaatcttcagaatgaggaagagaagttttaattttgctgaatgcaaaactataacatagcaactgaaatttctgtgcacaagtaaacgaagatttaatttaaaaactaaatttccactgaaaaacttggaatagtttttacaaaagttacataatctattcatgcttataattgcaaaattgtattaaaacccacaatagaaaagtaaatagagctaacttgttcacagataagaagatcaaaattcataaagatgtccattctctaaaatcaatttatagattaattatgaatcttattaagggtcaggagttcaagaccagtgtggccaagatggtgaaaccccgtctctactaaaaatacaaaaaaattagccgggcgtggtggcaggtgcctgtaatcccagatactctagaggctgaggcagagaattgcttgaacccgggaggaggaggttgcagtgagccaagatcacgccactgcaatccaccctgggtgacagagagagactccatctaaaaaaaataaaaaataaatgaataaataaataaatcttattaaaatttcaaaatcacaagtttcataaacctttacaattgttgtagaactttatatgtgattctaaaatccatacggaaaagcaaagagccaaaaataatcaaggaactccagatgaagagatacaagaggaaggaatattattttaccagatatcaagaactaatataaaggaaagcagttaagatagtgaaaaaaaacaaaaccacttatgtaatgaaattcatgaatgacaaagatgcaggcatgcaggaaaaaatgttttcaataaatagtgatgggacagctccttacccaaaaccccatctctacatcaccatcatcaaagaccaaaggtagataaaaccacaaagatagggaaaaaacagagcagaaaaactggaaactctaaaaatcagagtgcctctcctcctccaaaggaaagcagctcctcacacgcaacagaacaaaactggacggagaatgactttgacgagctgagagaagaaggcttcaaacgatcaaactgctccgagctacaggaagaagttcaaacccatggcaaagaggttaaaaaccttgaaaaaaaattagacgaatggctaactagaatcaccaatgaagaaaagcccttaaaggacctgatggagctgaaaaccaaggcacaagaactacgtgacaaatgcacaagcctcagtagccgattcaatcaactggaagaaagggtatcagtgatggaagatcaaatgaatgaaatgaagcgagaagagaagtttagagaaaaaagaataaaaagaaacgaacaaagcctccaagaaatatgggactatgtgaaaagaccaaatctacgtctgattggtgtacctgaaagtgatggggagaatggaaccaagttggaaaacactctgcaggatattatccagtagaacctccccagtctagcaaggaaggccaacgttcaaactcaggaaatacagagaacgccacaaagatactcctcgagaagagcaactccaagacacataattgtcagactcaccaaagtagaaatgaaggaaaaaatgttaagggcagccagagagaaaggtcgggttacccacaaagggaagcccatcagactaacagctgatctcttggcagaaactctacaagccagaagacagtggggaccaatattcaccattcttaaagaaaagaattttcaacccagaatttcatatctagccaaactaagcttcataagaggagaaggagaaataaaatactttagagacaagcaaatgctgagagattttgtcaccaccaggcccgccctaaaagagctcctgaaggaagcactaaacatagaaaggaacaaccagtaccagccactgcaaaaacatgccacattgtacagaccatcgaggctaggaagaaactgcatcaactaatgagcaaaataactagctaacatcataatgacaggatcaagttcacacataagaatattaaccttaaacataaatgggctaaatgctccaattaaaagacacagactggcaaattggataaagagccaagacccatcagtgtgctgtattcaggaaacccatctcacgtgaagagacacacataggctcaaaataaagtgatggaggaagatctaccaagcaaatggaaaacaaaaaaaggcaggggttgcaatcctagtctctgataaaacagaccttaaagcaccaaagatcaaaagagacaaagaaggccattacataatggtaaaaggatcaattcaacaagaagagctagctgtcctaaatatatatgcacccaatacaggagcacccagattcataaagcaagtccttagagacctagaaagagacttagactcccacacaataataatgagagactttgacaccccactgtcaacgttagacagatcaatgagacagaaagataacaagtatatccaggaattgaactcagctctgcaccaagtagacctaatacacatctacagaattatccaccccaaatcaacagaatatacattcttctcagcaccacaccgcacttattccaaaattgaccacatagttggaagtaaagcactcctcagcaaatgtaaaagaacagaaattataacaaactgtctctcagaccacagagcaatcaaattagaactcaggattaagaaattcactcaaaaccgctcaactacatggaaactgaacaacctgctcctgaatgactactgggtacataacgaaatgaaggcagaaataaagatgttctttgaaactaacgacaacaaagacacaacataccagaatctctgggacacattcaaagcagtgtgtagagggaaatttatagcactaaatgcccacagaacagagcaggaaagatctaaaattgacaccccaacatcacaattgaaagaactagagaagcaagagcataacacattcaagacctagcagaaggcaagaaaaaactaagatcagagcagaactgaaggaaatagagacacaaaaaaccctttaaaaaatcaatgaatccaggagctggttttttgaaaagatcaaccaaactgatagaccactagcaagactaataaagaagaaaagagagaagaatcaaatagatgcaataaaaaatgataaaggggatatcaccaccgatcccacagaaatacaaagtaccatcagagaatactataaacacctctacacaaataaactagaaaatctaaaagaaatgaataaattccttgacacgtacaccctcccaagactaaatcaggaagacattgaatctctgaatagaccaataacaggctctgaaattgaggcaataattaatagcttagcaaccaaaaaaagtccaggaccagatggattcacagctgaattctaccagaagtacaaggaggagctggtaccattccttctgaaactattccaagcaatagaaaaagagggaatcctccttaaatcattttatgagtccagcatcatcctgatatcaaagcctggcagagacacaacaaaaaaagagaattttagaccaatatccctgatgaacatcgaggcaaaaatcctcaataaaatactggcaaaccaaatccagcggcacatcaaaaagcttacccaccatgatcaagtgggcttcatccctgggacgcaaggctgggtcaacatacgcaaatcaacaaacgtaatccagcatataaacagaaccaaagacaaaaaccacatgattatctcaatagatgcagaaaaggccttgaaaaaattcaacaacgcttcatgctaaaaactctcaataaattaggtattgatgggatgtatctcaaaataataagagctatctatgacagacccacagccaatatcatactgaatggacaaaaactggaagtattccctttgaaaactggcacaagacagggatgccctctctcaccactcctattcaacatagtgttggaagttctggccagtgcaatcaggcaggagaaggaaataaagggtattcaattaggaaagaggaagtcaaattgtccctgtttgcagttgacatgattgtatatctagaaaacaccatcgtctcagcccaaaatctccttaagctgataagcaacttcagcaaagtctcaggatacaaaatcaatgtgcaaaaatcacaagcattcttatacaccaataacagacaaacagagagccaaatcacgagtgagctcccattcacaattgcttcaaagagaataaaatacctaggaatccaacttacaagggacgtaaggacctcttcaagaactacaaaccactgctcaatgaaataaaagaggatacaaacaaatggaagaacattccatgctcatgggtaggaagaatcaatatcgagaaaatggccatactgcccaaggtcatttatagattcaatgccatccccatcaaactaccaatgactttcttcacagaattggaaaaaactactttaaagttcatatggaaccaaaaaagagcccgcattgccaagtcaatcctaagccaaaagaacaaagctggaggcatcacactacctgacttcaaactatactgcaaggctacagtaaccaaaacagcatggtactggtaccaaaacagagataaagaccaatggaacagaacagagccctcagaaataatgctgcgtatctacaaccatctgatctttgacaaacctgacaaaaacaagaaatggggaaatgattccctatttaataaatggtgctgggaaaactggctagccatatgtagaaagctgaacctggatcccttccttacaccttatacaaaaattaattcaagctggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacaggaaaagaaactaccatcagagtgaacaggcaacctacagaatgggagaaaatttttgcaatctactcatctgacaaagggctaatatccagaatctacaatgaactcaaacaaatttacaagaaacaaacaaacaaacccatcaacaagtgggtgaaggatatgaacagacacttctcaaaagaagacatttatgcagccaaaagacacatgaaaaaatgctcatcatcactggccatcagagaaatgcaaaacaaaaccacaatgagataccatctcacaccagttagaatggcgatcattaaaaagtcaggaaacaacaggtgctggagaggatgtcgagaaataggaacacttttacactgttggtgggactgtaaactagttcaatcattgtggaagtcagtgtggcaatttctcagggatctagaattagaaataccatttgatccagccatcccattactgcgtatatacccaaaggatcataaatcattctgctataaagacccatgcacacgtatgtttattgcagcgctattcacaatagcaaagacttggaaccaacccaaatgtccaacaatgatagactggattaagaaaatgtggcacgtatacaccatggaatactatgcagccataaaaaatgatgagttcatgtcctttgcagggacatggatgaagctggaaaccatcattctcagcaaactatctcaaggacaaaaaaacaaacactgcatgttctcactcataggagggaattgaacaatgagaacatatggacacaggaaggggaacatcacacaccggggcctgttgtggggtggggggaggggggaaggatagcgttgggaaatatacctaatgttaaatgatgagttaatggatgcagcacaccaacctggcacatgtatgtaactaacctgcacgttgtgtacatgtaccctaaaacttaaagtataataaaaagaaaaagaaaaaaagaaaataggtaggctgagagggagtcagggaagaaggaaggagggaaaaaatgaaaaaaatgcaaagaaatggactcaactctgcaaaatacacacaaaaaataatttattttattatcattatttttagagacagagcttcactcttgttgcccaggctggagtgcagtggcgccatctcagctcactgcaacctctgcctcctgggttcaagccattctcccacctcagcctcctgagtagctgggaccacaggcacatgccaccatgtccagtaatttttgtaaaaaataaataattttaaacaaatttatatgtttaaagtaaaagcaaaaccatagcttctattaagacagcataaaaatcctttttttaatttcatagtagaaaaggatttcctcaggaacataaagaaaaattataaagagtatgattaatatattcacttccattaaatttaaaatctacgattcattatctgatattaaaagataatgagaaaaccatcataaactgtaggaagatatctgcaatatataaaactggctcaggctcatctagaatatataagatttttttttttttttgacacagcgtttttctctgtcttccaggctggaatgcagtggtgccaacacagctcactgcagccttgaccttatgagcccaagaaatcctcctacctcagcctctcagtagctgggaccagaggtgcacaacaccaaacctagctatttttttcttttcttttctactattttttatttttcagttttaattttttgtttgtttgtgttgtagagatgatgtctctctctgtttccctggctggcctcaaactcctgggctcaagtgatataccttggcctcctaaagagctgggattacaggtgtagcaatcattgagttgtagactgaaactgtaaattttaaagcatgtaaattatatctcaatacaactgttaataaaagtcagtaaatgaattgaatagtttgcagaacaatgggaaatataacaccctactcgtgaaagtataaactagtataatgtctctgagatgagattatttatacctatacatatttctatacctatacccacacctatacctatacctatacctatacttattgggtgaaaataaatggtttatatcctgtaaatacaattgttcttctggaacaggagacacatagcaaatgttcactgcattccacaaaaaaattacagtcaattgtcaattgacagaatgtcatgctatagtcacctgatggaaaactgtcatagaacttggggaaaaataaaaaggaaatacatgattgtatctctacactaatgttgagcataagtagaaattctacatatgtgtttgtatacatttcaaaaaactaaataatagaatgttgaggaaataacatataactagcagacctataaagtttttaaagagaatgttaaaaccagtcaggcttctggtttccattggaagaatcatgtttctaatactggcagcaaaactttacactcatgtattagcaaagttgatatagtttctaaaagtggaaaatacatgcatattttaaaagatatataaaatatttttaaatgtgcaaaaattaaagttcatgagtcaatcttgcattgttctaattctgccattacaaaaaaaaagttgcattgaattcattgtccttatgtctctagtatgaagcaccctaaaattgcttaatcatttagcatttaccctcagacattttctggggcagggtacaaatcatttcattttctatctggccatttatcttcttgacttgtaactgttagggcattttaggtaatttaagcctttttcctgtgttatgtattacaaatatttttttcagttgacttatgaaccaattaatattatgcaccctttaaaactttaaacacaaactttaaataatctgttttaaaaatcagtgttatgaattgaattgtactcccctaaaatttgtatatgaagcctgactgtatttgaagataaggcctttagagataattaagcttaaagagttcaagggtgggtctctaatccattatgactagtgtccttccaagaagaggaagtgacaccaggaatgcccatatgcagagaaaaagctatatgagaatataagatggtggccataaaaacttcaagaaaaaacagacctggcaaaccctgattttggacgtctagccatcagaactgtaagaaaataaacctttgttattattagttcttgtattagtttgctagcactgctacagctacacaccactggttaggaagttaaattagctaatctttttcatacccagtataacctttggtttgttagttcacatttccttatgattcttaaagataatagttggagtggaagtctacctcagttcatggatttagatgaaagctgtgtacataaaaattagaaagcaaaaccattatttagcagaataggcaaataattttaaaataggtagaataaatgttatcagtgaagtaaaaaaagaaatctactgttttttgggtttttgtttttgttttattttttgagacagaatcttgctctgtcactcaagctggagtgcagtggcaccaacacagctcactgcagtctcgacctcctggcttcaagcaatcctcctacctcaatctcccagtaggtcacctccaagtccagctattcttaatgctattaatttctgccaaatttttaaaaagtcagaaacaacaaaatacagcagggtcataaaagtactctaagaaaatagaggtaacattatagtctcagagaatggaagtccttttctacaagataacccagaaatgataagaaaaaaaaactaataaatgtatgcacacactatgacaaggttcataatatattatgaaatactttaaatgaagagtaatgctacatgatatagctcagagtttttttctccaaatctgtgtgttagcatagaaatacttctaaattattttatttgagaaaacgaaggtctaacagggattgcataaatttaaaactatgggattatttttcattaggctgggttaaatataaaattgttccctttacaaatcacttttgagtaagcaagaaaataaaaatcagcacactgccaaaacaaagtaaaaacatgaattctgaaatacacaatttagtaaaacttgaatggttcattctgaagatacacagtatgttttagggtgggaaagtaggaaagcctaatggattgccctagtttccctcattacacatacgcattcacataagttcaactccccaaatctaccctcactcttacaaataaattccattacatggaaatgtatagcaagaaaaatttcctctgttgacttgtccctgtgtggaagaaaaatatattctctcagaattaacatagtcagcactcatgtgaagttccagttaaaattcaagctagaaaagcatcttggaagaaactgacactagcctcaaagccttcccacagatcaaattccaaggttaataggcagctcctgtttaccgagaaacaagacttcatgtatgaaaatcagcaaaagtaacagagactagaaatattaatataattatttcaaatattagaattatttgaaatagaatataaaattattccatatactatcgtgagttggaagatagctcatgagttggaaaaatcagtatcgttaaaatggccaaattgcccaaagtaatttacacattcaatgacattcatgtcaaactaccaaaatcatcacataattagataaaaactattctaaaatttatatggaaccaaaataaagtgagaatagccaaagtaaagaactaagccgaaagcaccatactacccaacttcaaactataagactacagtaatttaaaaagcatggtaccagtttgaaaagagacagatagacgaatggagcagaaaacaaaactcattaataaagccacacaaaaccatttgatttttcacaatatggacaaaaacaagaaatagggaaaccactccctattcaataaatggtgctgggataactggctagccatatgcagaagaaagaaaccggattgtcacaatttaccctataaaaacattaatggaatgtggatcaaagatttaaatggaagacctcaaagtataaaaatctttgaagaaaacctaggatattatgtattgacatcagccatggcaaagaacttttggctaagtcctcaaaagcaattgcaactgaaacaaaaattgacatgtggggcataattaaataaagaacctctgcagaaaaaaaaaaaaactatccagagagtacaaagacaacctacataatgggagaaaatatttacaaactattcatttaataaaggtctaatatccagattatatgaaaaatttaaacaggtcaacaagcaaaaaacaaataacctcactaaaaaagacaggcaaaagacatgaatagacacttcacaaaagaagacatacaatcaacctgcatacgaaaaaatgtgcattatcactaatcatcagagaaatgtgaatcaaaatcataatgatatataaaacagacatatagacatataacagacatatagaccaatggaatagaataactagaagtaaacagatacctagacatatatagcccataagactgaagtgtgaagaaatccaaaacctgaacgaggcattatcaaataatgaggtaaagcagtgataaaaattctcctatccaagtaaagcccaggacctgaagactttcactgttgaattctaccaaacatttgaataactaatgtcaattctactgaaactattcaaaacatggttgaaatatgttccaaaacatagtattccaactatgtttggaataccaaaaccaaagacacaacaacagtaacaacaacaacaactacaggccaatatctgtgatgaacatagacacaaacatcttaacaaaaatttagcaatctgaattcaacaacatattaaaaagatcattcatcattattacatgtgatttatctcatggatgcaaaaatttttcaacatatgcaaatcaataaatgtgatacatcttatcaacagtaccaggacaaaatccatatgattattttatttgatgatgagaaaaatatttgagaacattaacatctcttcatgattaaaaactctcaaaacaactgagtatagaaggaacatagctcaacattataaaagccataaaccgcaaacctacaggtagcatcatattgaatgagtacaaattgaaagcctttcttctaagatctggaagaagagtaggatatgtgctttcacaacttttacttaacatcatagtagtagtcctagccagagcaattagacgagtgaaagaagtaaagggcattcaaattataaagaaaataaagtcaattattcttatttacaaaaaatatgatcttgtatctagaaaaacctaacaacctcaccaaaaactgttttaagctgataaacccattcagtagttccaggacacaaaatcaacatacaaatatcagtggcatttctatatgccaacagtgaaccatatgttaaaaaaggaagtaatcccatttgcaacagctacaaataaaataaaatacctaagaataaactgaatcaaatacgagaaatatatctacaatgaaaactacaaaatatggatgaaaaagattgaacaggacagaaaaaaatgaaaatgttttctgttcatagaatagaggaatcgaaagcattaaaacgtctatagcacccaaaacaagttacagattcattgcaatccctatcaaaagaccaataaaattcttcacaaattaaaaaatatatatatatctaaactttgtatggaaccacaaaagaccagaatagccaaagctattctgagcaaaaagaacaaagttggaggaactacattacttgacttcaaattatacttcaaagctagtagccataacagcatggcactattataaaaaaagacatatagaccaatggaatagaataatggacacagaaataaatctgtacatctacagtaaactacctttcaacaaagctgccaaatacatacattgggaaaggaatggactcttaatggtgctgggaagctaggtatctatatgtagaacaatgaaagtggacctctgagtagtctgttctcacattactataaagaactatctgacactgtagtttataaagaaaagaggtttaattgacccacagttccacaggctgtacaggaggcatggttgggaggcctcagacaacttacaattgtggtggaagggcaatggggaagcaagcacatcttcacatggtggcaggagagagaaagagataaggggaaattgctacacacttttaaacagctatatctcatgagaactcactatcacaagaagagcaagtggaaaaccagacctcatgatccaatcacctttcaacagatccctcccccaacattttgaattacaattcaacatgagatttggatgaggacacaggagacaaaccatatcaatctctatctctcaccatacacaaaaatcaaatcaccctgaaaaattaaatcactctaatttaaatctaatctttctaatctttaagttaaatctcactgatttaaaacccgaaactttgaggaaacactaagacaatgttctgggcagatttgattaataagacctcagaagcacagccatccaaagcaaaaatggacagatgggatcacatcaacctcaaccgaaaaagcttctgcacattaaagaaaacaatcaacaaactgaagaaacagtctacaaaatgggagaaaatattttccatgtacccatctgacaagggattgataagtagaatatatcagcagctcaaacaattcaaaaagaaaagaatgagtaatcaaaaagaaatggataaaagatctgaatagacgtttctcaaaagaacaaccaacaggcaagtgaagaaatggtcaacatcactattcatcaaagaaatgcaagtaaaaactataatgagatatcatctgagcccagttcaaatggcttttaccaccctgaccccgccgcaaaaacaaacaagcaaacaaacagacagacaaaaaaacaggcaataacaaatgctggtgaggatatggaaaaagggaacccttgtgcactgttggtgggaatataaaattggtgcagccactatggagaagagtgtggatatttctcaaaaaactaaaaataaaactaccatatgatccgacaatcacactgctgggtatatatccaaataaaggaatcagtatatcaaagaaatatctgtacacccatgtttattgcagtactgttcccaatagccaagatatggaatcaacctatatgtgcatcaatgggtgaatcaacggacaagtgaaaatcccgtcatttgcaataacttggatgaatctagagtttcctccagttaagtcaaatgaaataagccaggcgcggaaagacaaatatgccgtgttttcactcacatgtggaagctaaaaacaataattaacgaatgaagatatagagaagatatagagtagagagatggttaccagaggctgggaaaggtcttggggggtggggagggtataaagagggcatgattaatagctacaaaaatatagttagaatgaaaaaatctagtgtttgatagcacaataggatgactatagttaataataatttgtgtgttttaaaatgactaagagtggaattggaattttcctaacatagaaaagataaatgtttgaggttatggatatcccaattatcctgatttgatcattacacattttaagctttcatcaaaatgtcacatttcctgtaaatcgatacaactattatgtatacataataattaaaaatgaaaacttaaacaattataacatgtaccccaccaacaaaaaggaactgaagtgtttgcaacttccagtttaccatttcctgtaaagccactggcttacccattcaattaatttgagagaaatgaagccagaaaaaattgataattttatcttctaactaggatttgcgatagttcatttagggagataagaaatggaaaagtataagctataaatcctccatttagttggaactgtagcttctcattataataaaaatcaaaagctaatgacactttctaaatttctctgccattttcttttctttttttttttttttttgaatagtggtttctaagtttcattttcccacttgaaattgcctctgtgtatgtggcatctataatcaatgacaatggaggaaagaaatatctgcataagtttctgcccatgctttttccactactgttttgtagttaaaatgtaggtgaatgagaaatatgtagctggtggaaataggatataatttcagtttccaattgccaggaaattctcaacttctctgatcttgatttcttcatctgtaaaataaagttagaattacagaactattgttagtattcaacaataaactatgtgtaaaagcactttcaaaactataaaacaaaaatgtgcatcctttggcagttgctaaatgtagtccttaggttaaagttaaatctcacttgagactttctttttcttcaagcagtttatcaagctttaggatctgctgccctcctatggatgatggttgatagtgctgaataagtatggtgagtccaaattattaggagtttaataattttgttgacggcgtaaaaataaagttcatttagatctacttatgtttatacaaagatataatatatatgtttataacatgtaagaaatgtatattataaaacaaattatgtgtacgtatatacgtagacgtacaaaaccaagatgaacacacacaacatatttaataggaaatattgtagccattctctaagcactagtttccttcatattcaggaagaaagactgtttcaaattagggctagtgctatctataagttaaaataatgatataaatacattaaaagtttaagtagatttcattagcaacatacagggtccattaagacgttctttaaaatactaaaataatataaattattattcattattgggagttaacatttctaaaaatattgccattataatacacttactatctaggattttctgatgtaattttcaagatagttgaaataaaatataactaggtttcaaaataaaacagggcaataattgtcttatgtaaaaatcttcaatacttagtttcctgaggaagaaacaaaaccgacacagtaacagtaacaacaaaaatgaaaaacaagactttacaatcctaacattattgtgttcaaatatgtctttcggaaatcattcacatttgggatttaatgagagaaaattttccaggccttaagaatttatttgtttgacatcatttaattatgagtctaaatagattcaaattaaataaaaattagattacatgtttttatatagatatttagtatccgtgtacgtaatcatcataattctatgagaaaatattatttcacagataaataggccagtaagcatgtgtgtgtgtgtgtgtgtgtgtgtgtgtatgtttgtgtgtgtgtgtgtgtatgtgtgtgttgaagggggaagaatgtattacatttggtaagtctggttacagttctcttaaaaatgtttttggggcattaaattaagtccaaccagtaaccccaggaactcatactaatcaatctaattgggagattccactacaggttggcaaaaggctttgtcacaagagaagagatttaaaaagcacaaaaatgtcttggtgaattctaacacatttctaactttgtttattgaaagggtctttgtctatttctgctgccaaaaataaatttattttaaccatgtggccgttgaatgagaatttaaacagaccatattaataatattttgaaataagttttcatgtgtaagtacacaaagattgtatattgaccattaattcctgaaaccctcgatacagtaaaatctttatgcttttcagattcaactttggttaaaatttctttaaaagtgtaattctaagttcaatcaattctatgattatatcaatcaatgtagaaaagccttaagtatactccaatacctttattggttaaaaaatagaagtgaactttcttagacagatgaaaattatgaaacaactattaaatgacaaaaaaacaaacaaaataagaccagcaagaaaccaaacttcggaaaattttctactcaacattgaaaggttagaagaaattttttaaaaactcaggatcaagacaaagatgttgtttaacatactttaaattaatgttgaattttataatttaattatgcaataatatatggaaaaaagttatatattatacaatatatgtatatacatttgtaaatgtaggaatttatttatatcagaaaaaagtttatcaatattgatagatacaattttaatatacaggccacctgatgtgcttcatgcctacaatcccagtactttggtaagccaatacaggaggattgcttgagcccaggagtttgagatcagcctgagcaacacagggagacatatctctataaaaataaaaataaaaaattagccaagtgtggtggtgcatgcgtgtagtccagctactttggaactgaggtgggagaattgcttgagcctgggaggttgagactacagtgagccaacatcagtggcactgtacttcagcctgggtgacagagcaaaatcttgtcttaatgcatacatacataaatacataaaataaaataaaataaaataaataaagccaatatacaaaagtaaattgcagtcttacataccccatacaaacaaaagtgaaattttaaaataacgttaaagaagactctaaaaataatgatatacccagaaataaatctaacataaaaggaatataatctttttcaggtgaattattccatttgtgtgaaacttaaacacattctaaaacctgtgataaaaaataatgaactcagaatcatcctgttaccaaaatctggcagaaacacaacaaaaaataaaataaaattcaggccaacaaccttgatgaatattgatgcaaaaatcctcaacaaaatactttcaaaccaaatgcagcagcatatctaaaagctaatccatgacaatcaaataggctttatctgcagaaggcaagattggttcaacatacacaaatcaatacatgtggttcatcatgtaaacagaaacacaaaaaccacaagattacctcaataggcacacaaaaggcttttgatacctttatgcaaaaactcaataaactaagcattgaagaaacatacctcaaaataataagagacatatatgacaaacccccagccaacaccatactgaatggggaaaagctgtaagcattttccttataaactggcaaagacaagtatgccctctctcactactcctattcaacatagtactggaagtccttccagagcaatcaggcaagagaaagaaataaaaggcatccaaataggaagagagaaagtcaaactttcctggttcacacacaacatgattctatatgtagaaaaccccatagtctcagccccaaagctgcctgcactaataaaaaactacagtaaagtttcaggaaaaaaaatctatctacaaaaatcactgccattcctatacaccaacagcgaagcagagaaccaaatcaggaaggcaatcccattcacaattgctaaaaaagaataaaatgcctaggaatacagctaaccagggaggtgaaagatctctacaatgaaaattacaaaacactgctcaaagaaatcagagatgacacaaacaaatgaaaaaacatttcatgctcatagataggaataatcgatatcattaaaatggccatatagttcaaagcaatttagagattcaaggctattcatattaaactattaataccattcttcacagaattagaaataaaaaactattttaaaatatatatatggaaccaaaaaaaaaaaagagccacaaaagccaaggcaatgctaaacaaaaagaacgaagatggagtcatcacacaatccaactttaaactatactacagggctacagtaaccaaaacagtatggcactggtacaaaaacagaaacatagacaaaggaaacagaatagagagctcataaataaggctacacacctaacaaccatcagatcttctacaaaactgacaaaaccgacaaaaccaagcaataagaaaaggattccctattcaataaatggtgctggcataaatggctagccatatacagaataccaaaactggacccctttcttacaccatatacaaatatcaactcaagatggattaaaaacataaatgtaaaacccaaaactatagaaacctagaagacaacttagtcaatactatcctggacatagaaaaaggaaatattttatgacaaagatgccgaaagcaatcacaacaaaagcaaaatttgacaaatcatatctaattaaacttaagagcttctgcacagcaaaataaactatcaacagtaaacagacaatctacagaatgagagaaaatatttgcaaagtatgcatctgacaaagatctaatatccagtatttacagggaatttaaacaaacttacaagaaagaaacaacctcattaaaaagtgggcaaaggacattaacagacagtttgcaaaagaagacatacatgcaaccatcaagtatattaaaaagctaaaagctaaataccactgattattggagaaatgaaaatcaaaaccacagtgagataccattttatgtcagtcagattagcttttattaaaaagtaaaaaaaataacagatgctggcgaggttgcagagaaaaggaaacagctataaatggttggtagaagggtaaattagttcacccattgtggaaagcagtgtggtgattcctcaaagccttaaaaacagaactaccattaaacccagcaatcccattcctgggtatacaccgaaaggaatataaatcattctatcataaagacacatgcatgtgaatgttcatttcagcatgattcacaatagcaaaaacatgaagtcaacctaaatgcctatcaacgacagattggataaagaatgtgtggtatatatgcatcatagaaaactacacagccataaaaaggaaagagaacatgttttttgcaggaacatagatggagctggggggagggtcattattcttagcaaactaatgcagacacagaacaccaaataccacattctctcacttacaagttagagctaaatgatgagaactcatggacacaaacaggggaacaagagacagtaaggcctacttgagggtggatggtggaaggaggaagaggaagagaaaatataactattgagtactaggcttaatacctgggtcatggaatagtcagtacaaccaacccctgtgtaccacattacctgtgtaacaaacctgcacatgtactcctgaaccaaaaggtttttatttttttaaataaaaaatttaacatatgagcttaaaatagccaagagaaattgaaagaaaaaagttatgaatacttaccaaaacatatgtcaaaatacataacaaagtaataatataatgtataacaccacaaagatgggaaattggcatacaaaaagttagagatcaaaacatatttatagctaatatgccagtgtatttcatacaactgagaaatgggaaaaaatacgaattatttaattaattatctgaaacaattcttaactacatagaaagtaaaagagaactgtatttttatgtgtaagaaaaccaattacaaactcactaaataaatagatttgaaaacaattgtttttatgtgttatctatataatagactcagggaatctatataatggatacaatatactgaatgaataatatattatatcttaatattatatatgcattggatattgtactgccagttcttggtctcgaggctcaaaggtgaggggggcatgcattgaggatttcatgtgttatgaacttcaattctatacttgatgtctaggcaatgtgatgctgctattgtctagcaaagagaaggaaatcttcacatgacccatagggtcaacaggaatatagacgttcaaggtcctcaaacacattcatccagcggtccacatcctatgtcttggcttcggtgtaggacatttcctgacaaaaattgctaaaaattcagcctcatttataattctgctaagccaacaattaggtcttggctataattttcaacacagtccacccacttgctatgggtcataaaggtctctttaaaaattgtcatgggtgtgttctactttatattgtgtcctgagttatacatgtctgaattaattgaaattttctaccttctgttactgaaggcaataaacacagataacagctacataattcttacaattattattgcttccacacttctcaattgttgatttggcacaagctagtccatcctcttccatctgttcctcatgacaattcatcaaaaatgaaaatcgtagtaattgtgattgtactgcatgccaagtgataccactaccccatttctaccagtaatgtagtctctacagctatctagcctaggattactacaatgtaacactctgttttgagttccccaagaaacagacgctgagaaaagaatttgaatacaagtaatttttgtgagaatcatctcgaagtaacaccacaaaggcagtggataaaatgggatagggaaaagacaaaagccaatatgaatgcattaccaagtcacttgccactgcaggaaactgtgcatacatgtaaaaaaatagcataatatttaacagaatagtttatataaatatttttaaaatataaaataatattttacattatttaatgatagatacaaaatgtacaaagacatacaacagatgcaaagaattgaagtcacagttttaaagagcaaatgagcagccaaggtataaaaaattctatagtaatatttaatttcttcagatggctatcaaatatattaggattcatctcaagttagtgtaaaattatatgtaatacattataaaaataatttaaataaaacctttgagataaaggtagaaaattgagcttaatgctttttaaaacagattcatttgaaagtaaattaaataaaaataaagacttgagcaaaagcatttcagaaaatacaaacaagaaagataaagattttacaaaattaatgctggccagaatgcccaggacaagcaccttaaaaaagcatcttatagattgtgaaatgtaacaaaaacatgtaattttcacaaattatttttccatgaaaaatatgaactctgttatttcctcatttattttctgtgtgcttgtattatcaattactgagagaggaccatcataatctccaagtataaatgggaatctgtctatttctcctttaattttcatcaatttactttctttacgttgatcctcttaggtacacacatatttgtgattattatgtcttcttgatgaatttaacacctttacttataaaatgacctttattctcataataatcatttctctgaaggtctaatttatctaatattaatgcagccactccacctttactttactgttagtatcataggtatattctcattttatttttcacctttttctttatgagtttcttaagatagcacagagtttagtcttgctttttttaaaaaaatccaatttgacaatgtctaactattggtgagggttgtgagaactttacatttaatgtgattatctacatgtttgagttgggatttatcattttgctactttttttaagttacctcatctcttttttgttctttttttctttcctatcttcatgtttattagttgaacacattttatgatcctagttgattttttttagcttattaaatattctttttttgctctacctttgttgtggttgtgtgtaaaatttgcaattagtatcatttttagcataacaactttacgacagtatacttcctgtatctcttcccagattttgtgttattgttgccatacagtttacttctatgtattacaacttcacaatacaataaatatctgtagttatcattttggttttaagcagtcatttaacctttagtaatattaaataacattttttaagtcttttttattcattgacttatttacaatttttgtctctccattcgtctagatcgaaatttttactagagatcatttttcttctgccttcaacatttcttcaagaagtggtggtctatagaagattaattttcttggttcttgtagcaacaaaaaaaatcagcctttatttttaaaattaaattggctgggtattaaatttgctgggaatatatgtattaattatgataattttaatttattttagtactttttaggtgtaattgctgttttgtagcttgcattgctttcaatgagaagtctgttttcattctttttttttctttgctagatgaagtattttttaattttccttccatttttcagattttctttttattactcttcaatatattgattatgatgtgatagaggcattttatttttctttttacttggttaattgaacttcttggatctatttgtatatggaattcaccaaatttgaaaaatttggggccattatttattttaatatttttttctgctgatgctccttcctttaggatattgaaatagtatatgttaggatgttttgtttattttgtggggaagggagaagtgattatttctctttatttttcattttgtatagtttctattactatatctttaaattctttttttctatgctgtgtccaatctattaatactatccaatgtatttttaattttagatattgtgtgtttcatctctggtagtttaatgtgggcttgtttatagaaattttatttttctcattatatgcttacttttatgttcttttggccataccctatttttgtttttaggtctacactatagcacttatgtaaatttaaaatttacatacagaaatacagagcaactgctaaaaagtctaaagatgtatcttttcaaaagccccaggcaggaagacttaaaaaatcaataaacaaatattaaaattaattagtcttgtaagttgtccaacataatatcaaattacaaaattcaatagcattctttaacccagatacaagtataaaatgtaacaaaataagatgtttagaattgcaacacaaactatcatcgaagagttatcttaaagatactcaataaccacaagctatttataatagctgttttagagtacttgtctactaattctatcatgtatgtcatgactgtgaacttgtctgtttaataatatgctatttgttgctctcagtcatatatttatgctttgttaactacttcataacttttttttctgattttaccttgttggatactgggctatttttttttaattctgttaaatatttggacgctttgatctggtagagagatatttgtaatttcatccattagaagcttgcgtttaagtttattagatcacattctaacattttatttcggagtaaattttattccaccaaagaggccatacacatctaaagactctatttggatgatgtttggagacctttaaccatggcaaaaaaaaaactatatacatatgtatgatttttatatacgtatgtatacatgaagtaactattattggaccacctactatttctagttgttttatgacctgtttcagtattttccttacattcgtgtgcagatcagtattccaaaaaacaaaacagacttgaggatatttattgggtattatgctcactactgggtgatgggattattcatccatcaagccttagtgacacgcagtatactcagataacaaatttgcacatatacccttggaaactaaaatgaaagcagaagataaaaaataaaatacaatgttactactaaagaaagctggtcatttaaaaaattttcattattcattttatattcattaattggaattaagagattgcttgttcattgaactgtttatacagtataaactaaaatattaatgaattttattttatgtgttctattcattcatactaattatttattttgcttctcaaattgtcccagattttggaaccttcttcacagtagttcctgtattcttttgaaatggctccatcatttctgagcacttttcactttttggtattactagatggtttagactcgacttctgttttcgctgcctcaaacttaaaattaaacacttctccagtgaacggtattttattttattagataatggcatataaaactcaagatgtatattataggtatattcattgttactggagtttcatgtgttttcaatggacaaagagagaaaatatatttgcacatactgacacacacataaacattttctattatctatttctaaataatttttaacagtaaaaatcctttgccacaataacacaatgtttacctatttgataagtcttaataaatatgtgaaatttgttttggaattactcagagatttataaaaaaaatcaaatccactgcttatggaaaaatatttgtcttataaatgagtctcttaacagcattaaaacagtactactagactcatatcacatactacattactacataatagattcatatgattttatgcatagattataacaaaattccaaataagaaatattttttgttccataggcagacaggcaagcaggcaggcaggcaggcaggcaggcatgcaggaaggaaggaaggaaaagaaagaaagaagaaagaaagaaagagagagagagaaagagagagagagagagagaaagaaagagagaaagaaaaaaagaagaaagaaaagaaagaaagaaagagaagaaagaaaaaagaaaatctcctaaggccaattcaaactgttcagaaaaggactgaagaacaaatatatttaaggttcataaacactcatgaatacaaaggcaagtgtccctgtatcaaattatgagcaaactggaattaatgatgaacaagaaaatataaaatattaatatcacattgaaattaactcaagatggaaggagggataaatagaaaatttataaatgtcatagacaatattacaggttaaaagagaatggagataaaaaatactaaaatattattaatttttgcatactgaccctttatcatatatatgtcttacgaatattcacttccattccacagattgccttttaagtttgttgattgtctcttttgctggccagaagctattttaggttgatataatctcacttgtctgtttttgcttttggtgttatatccaagaaattattgccaaggtcaatgtcaagaagcatttccctatgctttcttccagggtttttgtggttttaggtcttaggttgaatatttaatttgtctcagggcatcaaaatgtccatgttacccaaaacaatccagattcaatgaatccatattaaaatcccactggcatttttttaaagaaatagaaaaaacaaaaccaaaatttatatggagccacaaaaaaacaaatattcaaagcaactttgtgcaagaagagaaaagctgcagacatcacactccctagtttcaaaatacactacaaagtgacaagaatccaaacagtattaaagcacacgtatagaccaagggaacaaaatggagagtctagaaagaaacctacccatatatggtcagctggtctttcaacaagatatcaagaatatacgatgaacaaagagtagtctcttcaataaatgatgccagaaacactaaatatccacaagcaaaagaaggaaattggagccttatctgaagccatcactcttcaaatttgatgaaaaaaattcttaaaacttagaaaacagaacttttttgaattaatacaatggttatatatttaacataagcttaaatgggagaaaaaaataaaagcattttctttaaaagcaaatatatgaatgatctagaatgcctacttctacttaatactaaatgtaaagtttcagcttacaaaataaaatacgtgaaatgcctaaaaactgaaaaaaagaaaaaagaccgccacaacttttacatactattatggtctatattgaaattcaaaggaatctacagccactattaagttatagtctacactgagagagataatctttcaatttccctcagctattagtctcaaaggggattcattgttgaacccaaattgataccaaagagaaagggagccaggtgatatcaggtgatacatggttatactcttctcctgaactatgttaaagctacctttgtcatttccccagtaccacaagccatagcttttttcaaacattgctattccctctccttttaaccaccttcacttgaattttgcagattcagtgatattcacacatgctactctgagctactacaaatgatgggaatattaatactcctccaggtagaaagggagccaggtaatacagtcaataaaagtagcttcctagcactatgaatagcgttcattcaggaggtgtactgcaaagtgtttactttgcaggtctggatttctcaacttgtacattcccaaaaaagactcatgttcttatattcaagaggggctcatacctggctcctaagagctgagttccaatcttttggaatacagtgcctaataagagtgtttttgtatatctgaggtcttggtccacattagtttgactagatagtttatgttatcaatgtgatttaccatgatcaccagtttttgctctgagggtctggagtctgggtagctgaggttagtcaaacaggctctagacatctatgtgattgagccttagcaataacccaagacatcaaggttcaggtgagttagttgataaaactgcatcccgtcaccacatatcatttctaggaatattaaataaatcctgtacaactctactggaagaggacccctgcaagcttgcaactgatcttttctgggctacccttcataggtcttttctctctccttattttaatctgtaatctgtattattttgttataatgaaccataaccatgagcctagcagcttctgagtcctgtgagtctttctagtgaatcatcgagtctcagagtagatccataagaataatcagtaagaagttatgaatattttggtaaaacaaaatgtatattatcattgcaatagaaatttctttgtaaaatattttttccttaatcttgaatgtacaagtatacttaaaattccaaaataccacatgaaaaataatttactggaatttatttctcatatttaaacgtgactttaaattacaccattatagtgtaattaagattatattaaaagattatattaaaatatataactaaaatacagccatatggatcagggctctaagtttccattcttgtagacatttgtctttctctttgatttaatgaggatataccaatagtaatagctccatctgcagttggctacgattcatttttttctcctgcaatttttgacgtagttggagtgaggccatatgcaacagggtctttaagccatttccttcttcccagatgtgccatgcagcgtctttactctttataactccccattcccacctcttcccggttacactcttatcctgactatgttaaagctacctttgtcatttccccagcaccacaagccatagtttttatcaaccatcactattccctctccttttaaccaccttcatttgaattttgcagattcaatgatatttacacattgtactctaagctactacaaatcactgtgaatatcaatactcctccaagtagaaaagggtcataaacagggaattataaaataggcctctaagaaaaccccagaggaatgcaagttaaaatgagacatgtactttcaacaaactggtcacaaaataaaaaccatttattatagccaagatgccaaggatgtataaaaattatatatgttttattatgttagcgaactggtatacagaccctaaaggtgaaaccgtgaatgcaattctaccgctggaggaattcctgatttaccaagtctccagcacacccacatacacacaacacacaaatatactatatatcaattatacatatattatatatatacatacatgtaagaattacactgtggtgtgtgctaaagaatacacgactaagtggcagagttaacaatactacttaaatgttattaataacttgaatgtgatctctgtgataggatgtcccagctctctagatatgaaatcatcgacataagctttctattgttctctttcttaaactataacactactttctcatttgaaaaagagaatcagtgatagctatctcaatatcaaatgctttatttttgacttcctattaacgtcttttctttagaaaagcagagagctagggcttgagtgaatcctagaatcacaaagatacctatactgttttagtgaaattagttaagtgggctttggaggtaaatagatctatcttcccatattttttcaaaatgatgtttgtcaaagagagagttacttaatttttatgtttttattttatcataaaattaaaatgataatattttgtaaatatattgtgaaaattagtaataataatccaaatgtttagaaaaatgcttcagtggagagttacatcatcataaattttaaaactaaactgaagattatagcacaagaaagtaggctgtcaacagatttactgcctaaccaccaataatgagaaatagtttagttatctttccaaggtatataacagaatatacaaaaatataacagaatgaagaatactatttgagatgagaagccataacttcaatgtagtcagatatttgtgtatctaaacctgccaagcaaggagaggagtgtgtacatgggcatttctgggtgtgtccactaattatcccagctgacaacctgaaaaagagaacaactgtagccactacatcagggtattttgggaatttgaagactacggacatattactaggctccactgatgctgggataccaactttaatgaaatcacaattgagctaaaaacaaagattggttgaattcaatttctattctaacacaaggctaccacttcacactacttttagttggcacttttgtcaagaaaagacagaaaatatctagaaacatggattccaaaataatatcattaaaatgacaatataagcaccacagtttgtataaatccaataaataccacattatagttattagtttttctttattcctaaaattgttcacttatgtgatgtatattaactttatttttgaaagagattcacgaaaatgaaagatctattcctatgtgtttattttcaataacaaaattgtctatgaattcaaagataattacattcacagcaatttttaaaaggttcaaggtgttttgatataaatataacagaaattacaaaataatttgatttgctaccatgaaggaagagggaaggcataacatgtaatgttacaaagctcaaaaggactaggttttggggttaataaggggtctgcattaaagataaggtaaattttttttccacaagtagggaaattcttttttagtttacacacagcacctttcagaattgaagttgagttgctgatgatgccagtacacccacgttatgatttctttgaaacatccaatggcttcatcatttaggccaaaagagcataatctcacggaggataatttctatttatgaccaactaaaaacaggagggtggcaaacttcttatgcacgacaatagtaaatatggaaatcatccttagtgaatatatttttataaagaagtaactggccaggcacaatgactcaggcctgtaatcccagcactttgggaggcagaggcgggcagatcacaaagtcaagagtttgagacctgcctggccaacagaatgaaaccctgtctctattaaaaatacaaaaattagccagacatggtgaagggctcctgtaatcccagctactctggacgcagaggcaggaaaatcgcttgaacccaggaggcgggggttgcagtgagccgagattgcgccattgcaatccagcctgagcgacagtgcaagactcggtcaaaaaaaaaaaaaaaagtaactacatttaagacaacttttatttttaatcaaggaatacgttatgcactagagattcttgatggcttacaaaccggacgtgggtgacaatttaatcatgatgttaaagttgaaatgataagaggatgtagtaaaaagtccaccaaagaaaactaaaagtgagtaagaatgaagaatgagaagtaagaggtaggagttactcagcctaagtatctgaaaaggtctgggtagtggccttgttagagaggaatcccagagaatgattgatgtgttagttacacacatacacatttgatgaaagaaatcatactgtacactttatgcactttttatcacataaaaattataccttaataaaaacaatagagatcaacagaatggttacaatgaaaataaataccaaaaagaacaataccaagtgttgatgacaatggagaagagctggaaccctagtatatggctagtaggtttactagtttgcacaaccttttgggaaactaaattttaatgatatctatgacctgtcaattccactctcacgaatatatccaacagtatggcatacatgtattcaccaatattaggtacaagaatgttcaaagcagtgttcatcataaggtggcaaaaccaaaatagcctaaatttccatcagcagtagaatggataaataaaatgtgatacattaattcaatagactccatatagctataagaatgagcacagcatatctacatgcaacaacttgtacgaatttcaaaaacataatattaatcaaaataagcaagatacaaaggagtacataatgtgtgattcaactatataacgtttaaagtcaaggaaaattgatccatggtttcagaagccaagaaagtgtttaccattaaataggagttgtggggactgataagcggatgaaagaggagttatggattgcattcatgttttgtttattaatttgagtgctggttgcaagggtggggttacttcgtgaaacttcaatgagctataaagtttaggatttatgttttgcagaaagaatatacaaaattttaaaaacccggccgcgcgcggtggctcacgcctgtaatctcagcactttgggaggccgaggcgggcggatcaggagctcaggagatcgagaccatcctggctaacatggtgaaaccccgtctctactaaaaatacaaaaaattagccgggcttggtgaccggcgcctgtagtcccagctactccggaggctgaggcaggagaatggcgtgaacccgggaggcggagcttgcagtgagccgagatcgcgccactgcactccagcctgagcgacagagcgagactccatctcaaaaatcaaacaaaacaaaacaaaacaaaacaacaacaacaacaaaaacccacaacactgatcacaggaaagctacatataagaaggaattggaaggcttaggtgacgaaagattaacagaaactccaagttttccagggaaagggtgggaagcagggtatgagaattagagtggggataggaaacggagagaagcaataaatacaacactgggcccagaaaagaaactatagttgaaatacaaataatacattattgtgattaatctagtttagttgcagacaagttggatagagggggaaggttaagaggctgtttttttcttaagttaattggggtttattccaaaaataaaaagttgatttaacaactgataatcactttatatattttaccatattggcggaacaaagagaagaataatataataatttgaatagatgcagaaaaacatttgataaaattcatcatccttttatgatgaaaatttatttgaattaaaaagaaaaagggagattcctcaatctaataagagatatctaaaattagcctacagcaaacatcacccttaatggtaaacaatgcatgattttccactgacatctagaatgagacaaaatgcccattaccctcatttttatcttatattgtgctggagtgtctcattaactgttaagagatttgttttcttcatgggctgggataaggtaacattagttctaagaatccatctaaaatttatcagcaggaaatgcttgaggggatggataccccgtactccaggatgtgcttattttacattgcatgtctgtatcaaaacatcctatctaccccctaaatatatactactatgtacccacaagaaagtttaaaaataaaaataaaaataaatttaaaaagaggagtaaggattaaagttcagatttaaattaaatattaaatgtcaaaaaataaaaatgaataaataaaatatatcagcagggaaagagggcccaacatggtactgacagttaaaactaaattttaccagccaagtgtcacatagcttattactgggctttctgctctcccgatctacagtgcgctgggatggatagagacagactggaaacccaaaagacacatgcaaaatggagccatccagtttccagtggccttacctgtctaaccattttcactacagtgttcaagggcttaacctttctattgctgcagcaaaggctagtctcaaattctacagtgagaactatctatttgctgtacagcagatctcttagaagttgaggaagaaataaagttcagaggctgggtgatgtggctcaagcctgtaatcccagcaatttgtgaggccaaggcgggtggataacttgaggtcaggaacttgagaccagcctcgccaacatggtgaaacctcgtctctattaaaaatacaaaaattagcctgacctgctggcagcctgtaatcccaactacaatggaggctgaggcgggagaatcgcttgaacccgggaagcagaggttgcagtgagccaagatccgccactgcactccagcctgggcaacagagtaagagtccacctcaccaaaaaaaaaaaaaaaaaaaaaagagagagagagagagaaataaggttcagttaaatttgatggtgccatgcagaacacttggcctgaccaaaatttattaatagattcacttctggatatgagtagcagtgattttcataattcctgatatccctgttcccttagctattaaaggtatttttaaaatgttaattgttttactcatttcatctgtaagatttaagagttcctcactgatatagaaaacaagttttttaactggtgcaatcaaatatgtccttgtacttattctgatgtccttcaagacatttggagttcttctttgtcacaatttaacatatcatttctcaagtctgtttttcctacacagaactgaagaacaactattgtaatggaaacgccacaaaaatttgacatgttgttagctctcctgcggtcaaacataattacgtaaaattgtgtatctgccctctttcaatatcagtttacagttagcaggtgttcttaatccttttgtttgtgatggcaaacaaaatacaaaatggggttttaccagttcttcacagtataccttaatttgaaataaaatattcaaggcagttatttgttgttcaaattatgttcagtaacatgagaagcataaaggttttaagtaaataggatatttaatttcttaaatgatagaatttctgaacctagattattattttgtaaaggtgagaagttgagaacttgctgttttacaaagcctttttcacacttatctaatttgttatggcttcctttgagaaggaaggtttagtacataccagaaaccatttattttttgtagatttttttggctactttccatttacagagccctgtggtaatataaaaagggttttatcattgcagatttcctaagtagtttggtgtaaataacatttaatataagtataattctttatagttgacatggaatagccacatatgatatcatatgatcctcctaacgaatatagtgaaatttttaaccctattttaaagaagagaaagcactgtgactctaaagtttcagttacttgtctgagatcccagttagccagtggaacctgaagccacatgcatttttcaggacccttcaccttgttactttttgtatgtctcttatttaaggtgtatagattgttaactcattcagtagctgcaataatcactatccaatacatagctgggtagttacaattattgtagaacacatttcaaatgtcttgagacatactcatgtgaattatacccaaattaaaagaaaaatgtggtttgaaggcatataaaatttgaaagccagaaaaaaagaaactacggttaaattatgccttaaaggaattttaaaaatacagaactatacttgtaaaattttagttatagcatcttcaaaaataaactcaaattttatttaccttgcatatgttttatatgtggtatatttaatatctttcctctagacaaattctaagaaaaagttgaaaactttttgataaaaaaaattattgcaagagttttgcaatatcaagagaagaaaaaagatatattcaaataccccttgtgaaaggtaagagtaagatcaagttagtttatgagtattcaagttagtttatgtgtatggcttgccacaggtctttgtacttgttcttacctactcctaaaaggcttttcctccagggatcttatggattctgactttcacttccctcaggtctttggcctgatgtcattctttcatttgatactttctctgcctgctctatttaaatatgcaaactcactctaagaactatctgttcttcttactttattattacatagcatatatcacaggctaaatttatatatttattttatttattggttgtctcctctcatgagaatgtaagttccatgagatagagaatttgatctgttttgcttattgttgtattcctaccacttagacaagttgtaggaactaggttggcattcaacaaatacttttttttacacaaagtaaacaagagagaatgaaggaagaaaagtaaaaaaggaaggaaggcaagaaggaaggcaggcaggcaggcaggcaggaaggaaggaaggaaagaaggaaggaaaaaaaggaaggaaaaaaggaaggcaagaaggaaggcaggcaggaaggaaggaaggaaggaaggaaagaaggaaggaaaaaaaggaaggaaaaaaggaacgaccaaggggagtgagggagaaaggaaagaaagtcaaaaggtatgtaaaaaagtctttcacattacctctgtgagaaagtaccagtggtagcatcatctgttaattcctgctattgattagtgtcccgagtactaagagatctggaggcaaaatcatcaagagagaaggaaataaaaatataaagggaggctcataaaagccaggaaaaataagtaatataaacaaccaatcaggactggccttgatggttaacattattgtgtttgattctcataaggaatgtttcatgcaaggaaacatgaggctggccacaggatagagagaaattaatttgagagatggtgtccaactacccagagatgtgtaaagatagagagacagtgagaaccagggtagagtgtaaactccagttttctattgcctgattctatgcttttcaaagctttctgcagacaaagaaaataatgaaggacaaaggaggcatggtaaatcatgtatcacctcgaaaatatttgccagggtatttttcagtagtgttataatgtatcctaatatgggcactttcatttatattttgaaattgatttatacattgaaaagctattacctaaatggacacaaagttgtttgcattaagagacaatagcatacatattaataccaccatttcattgttaaggatttattcaaagagaataatcagggaattgtttgtacagagatataagaagtccattatcttcagctcagcatatgcagtggaatggaaatcgtttgccatatgacaataagaataaataagggatgtggagtcattaaaaagagaaaattttagacttacctaaaattttgctatagtatgaattccattctccccagtaggactgaaatatatagtcttgcagagaataagatatggtatttttaatcctttcaccaaaggtcatctggtcagtgagctctgataaggctgccggtacataggagactggtgctgggattttcccacagtgtctctccactgttgatgctggagagaacctcaatgtgtacataaatggaattcctaatttcagagcaacaagatcaccacagattgttactgggtctgctaccaacacatcaaaaccacctttctgaagtcttgccatcaactttgggttctttagtacaccatcacagagttgtatgttaatttgaaagaaagtgtctagaagttttcctagttctttgtagaaagcccatattgtgagaggagttggtctatggtcaatccacagcattatcatatgctcaattaaggaatctatattgctcttcttgtaggaaacaggtatcacttcaaaattcacaggagaatcgggattggagttgatgaatagagttgctgatgaagccagtacagtcacattgtgatttctttgaatcaactcttctagaataatcttaatatttaaccaatggctaccatctgtaggccaaattaacacattcccacttagaacaacttcagtcagagtcaaattaaaaaccagcatctggacaaacttcttaggcatggtaaaatcccttatggaaaccatcc

SEQ ID NO: 1880 - DNA, 64834 bp, Homo sapiens
atcaaattccaagtaagcattttttattttttggcataaaattaaacttttgattacaaatagtgattatatattatgaacattagtgatttttaagcataattaattgatgttttatgtaattatttgtacagttgactaaaaattttataaaaatgataattattttctagatttctaattgttatatcctctaaatatgatctgttcaccttcaacatataacatagaactttctccttgaaataaaagagtcgattgattgatttattaaagacagtacccaaatcttccactacaggttatataagaatatatgttgaagaaaggcaggcaagttatgccgtgattttctagatatgcttaatgaaaattttgtagacatttaatagggacgcacgtcacacttaaaattcattctctaactcctgaaacattgagcaagcagaagagtttgtttttattaaaaaaggaaatcattacctttctcataacacactactctcctacggtggctccctgatttgtttggtatatggaaatttgtgaatttgactcttccttacacctatcaaattccatctacactgtatgcattaccaggattcagcatattgttaatcattaattaaggttaacgataaaataatttgatactatgaatagaacatatttaaaattaggtagtatccttgtgtcagaaaagtgacaggaagagggtatagtcagcagggagagacaaaggaaaaatagaagactataactcacaagttaataataatcatgccaaaatctaggctttatcagtaggcttatcgcaggtagagaaatagaaaatttggaaacaggatgggagacgtgtttttgttaaactccttttgtctggaattaataggactacactactcaggattttgccaaacttaaaaatatatatatttcctctttttcttgacctattctctttttttcttctttcctatcttaccaaatttttgacaggaaaacaaacaacattgtatgaccaaaaatatagccgttgtcacacagaccagcaagaacccaattacatccaaagagtggtactggaaccaggtgaggtcatgggctgcaacccgaaggtgcttggctcctttgtggcgcatgacaaactcgatccagaagactgctcgatccaggggctttacaggttgatcatggtgaattcttgataacctcatagcattctctttataactagaagacaaataaataggcagaaattagacaatttttgtttttattttcattgaagataaatatgtgatacacttttgctctacaagtttaaggccatagttacgtggagaaaatataattcttgcatgaactttgttagttgtataggattttaagagttacaaaaaggaagatatggatgaaatatatgcttaacacagtatgatcaaatgtagacataaaaaagtagagtaagccagttgtaaatatagatgtttagcataatttttccaaaaataattttgatactgtgtgagctatactgtaggatggttccaataccaagatggtacataacctaatactgtgggataaaaatcatttaagacatacataaacatatcctctagtgtctggctagttcatatgacagacaaaggaaattggcagtcagcattagtgagtcattttacagttctaagatgtaggcattgtgataattactctgtggcacacatctgtatgtttgtgacgaaaaggacagtgtctgtatctgtaacatgaagactgaacaaaaatactctggtgatttaagaagtggcatatccaagtacatgaactttgatgtttcaattgaaacatctccctagaattagagctctaaatcaacttgccatcacaatagagatagtaacagagataacagttctaatggcttctcaaacaatattgggtggatatctacatatttaaaaggcaaactgtgtcttcacttgcagtttccctagttgttaaaccaaaattagtaggtttcattttggtttgtgtctggaagaaaagttccagcctggattcatgaagatgagcgaaggtaaatggtttgtgcagagatgtcccggtgttggcaggacattgttaggactggggaatggggaacatggtcatcatttacaagagaacatggtacaactagattcagcagcaggagtagtttacatgtgttgagtgtgtgtgtgtgtgtgtgtgtttgtgtgtctgtctgtctagtgaaaaagaatataagtaagtaatttcacatggatcatccgaatatactttaggcaataaataaatttgtacatgtgaatcaaaaaataagaagaagaaagcatgttttcctataaatgatgtgggacaaagaccatgctcataaatttattatttcatgttttattatacactaatgttttatgactgatatgttaaaatattctgaataattaaattacaatggtctattcaaatgtaattgttaatgtttattaattgctttaatgaataacagaatggagtacaaacacatccatatatatactctacactataccttgtgttcccagaggtggtatttggtttagggttaaagtgaagttactttaaattaaataatttttaggcatttatttagaaatttctaacagtatttatagttctcatttttttgcatcaatagttttgtcaatgaaatgaatcaaaatctaaaatatttgaagatatttatttgtagcaaaatatgagtgaccatggcccatgataaagccctcaggaagtcctgagtatatgtgcccaaggtggctggggtgcagcttggtttttacattttaggaaggcataagacattaatcaaatatgtttaagaaatacattggtttggtttagaaaggtgggacaacttgaagtgggggtgcatccaggctataggtaaatttaaacatattctggttgacaattggttgagtttctctaaagacctgggatcaaagggaaggaatgcctgggttaagataaaggattgtggagatccaagtccttatttgcagaggaagccttcaggtagtaggcttcagagagaataggttgtgaaacgtttcttatcagactgaaagtctgtgttgatgctaatgccagagaggtatactaaggcatatttgaccctcatttcccatcatggcctgaaacagactctcaggttaaattttaacttcctctggctgaggaggaagtccatttggatggttgggtgagaagcttagaatttttatttttggtttacagttttcaagtcaataataaaatttaaccatcattttaagcattagagttaaagagaatcacagactgtacctacactgataattaataaaatgaacaaaattgtcagcaactaacaactttgtaatagtctaattgactagtcattaaagtcaaaaaaagatcatactgagccttgctgaagctcctaacccaccacttagctcatgaattatgatttctaaaattatgacttatacaacatgtacgtattaataaaagtcaattaattggaatgtggatggggagcaaaagtggacaaccagggctgagtcttggtatgaatctaaaccaactgttgagtgtctttcttttttgaaatgaatacattagccctcgtgtctaaaatgcctggcaaaggtcactgaatagatgtttttaagcaggttacttccgttaagaaaaagcactaaattccatccgagtttaccttctcctctcctgaatctcagccttcaggaaaagtgaatgaaatattaaagctattcttcaagcttggactctacatgaaaacaattaagtccaatacaacataaagcaagtttaaagcacccacacaaattcagagcaaacaccaagaccgagaaaaaataacagcctgataaccacttacacatattgaaaaataaatgagaaactaaaaatgcatttaggtattgcatatagtccaaagaagaggagattcaaaatacaataatagcgggagggtaatgaatatgatatcaaaattgacttacaaagcaagaggaagtgataaggagataggtgagctgatgatacaagttgttaaaaatgacagttgaaagaattaataaagaaattagaaacagcaagcaatgctcatggtaaaaataataaatttactaatttgtgaactattggaggcaatctcaatgaattaataatagtaaaaattgattagaacaattagacaggaaataagagaggaaaacataccaaaatactttatcatagggaagactaaactggtgctccagaagtaaagataaaaaatggaaataaaaggcattcaaagaaataatacaaaaaaaattaatttctgaaaagaaaaactggataattttttatcttagattaacattgttgtaaagacacagtataattgaagaaaaatatataaaataatttgtaagaatacaccataactgagtttctgaattttaaaaagtaactatttctttttccaagttgaaaagaaagcaaaaagatacaacagtcaggcaggactcagaaatcatatagcacaatttaaactggaaggccataagtaatatttccacaggtctgaaggaaagaaagcaagagctaaatatattgtattcagataaaagtcattctcataacaaagcagtgagtgaatattgctaaacattatctcagagaattcaatatccaagtctttattgaaagaaaattccatgtgagataatcagtcaagaaataaatcctaaatattttggaataaataatctctaattcaacggtgaacactgagtcccttaaaatataggaaacagagtaaatgtgagaaaaaaatgacataaatattggtaaagtaaaattacaacataagtaatataaatttggaatgaaatagagatacatttcaaagcaggagttcaactataagtagctaaaattaaaacacatcatcaaaaataaagactcaaaattacatatacatatatcatattactttggtgagatctttcagagaaaaaaataagacacaatatatatacacacacactatctactaagctatatatatagacttatatatataatatactaagctatgtatacataactcaatatattttatagattcatttcaatctaaaagctgaatcagataaaattatacttaaattttatttaaaatatcacatagtacaaatcaatatttaaaaaattatccactaccctatatcttttctctctgtgtgtatacatatactaattaaaggtatcgaatggtatatactcagtgtgaatagttatttctgaatgcttattactgagcgtattatcatttcaattttgtatttactgattagtttataatatgtacatacttactaattagtttataatattaagcagattatccagaaaaaatgagaatttatataatcatagcattctttattttgaaaaatattgaaataatatttgaagtctttttttttgtttgtttttttttttgagactgagtcttgctcttttgcccaggctggagtgcagtggcacaatcttggctcactgcaacctccacctcccgggttcacgccattctcctgcctcagcctcctgagtagctgggactacaggcgcccactatcatacccggctaaatttttgtatttttagtagagacagggtttcaccgtgttagccaggatggtctcgatctccggaccttgtgatctgccaccctcagcctcccaaagtgctaggattacaagcttgagccactgcgcccggccaatatttgaagtcttaggattttcttatttttctgatttcagcaaatcactttagcagtttggcaaataaaatagtttttatattggtcaggttatggttgttattggaaaataattacaaaagtataaaagaatgtacattttctggtattatgaataatgtaattaaagttaggcaagtttttaggagccttagtacttacgaaggttcattaatgactgttctcaaagcgctaagcaaatccacacttgtcattgtgtttaggttcacttccacagctgctcctttggccttcatgtgagcaatgttatcaggctgatcagcaaacatgggaactcccaccatagggactccgtggtaaatagcttcgtagatcccattagttccaccatgagtgataaaagctttggttttgggatgtcctaatttgaggatggagtgagaagtgggtgtgtaataataacacattagcagaatttgagagacagaaggggtcaaaaagctgtaatgtaactctctaaagaaggatacgttttctacaaaagcagatcacatagggcattggaatgtcagaaaactgtgatcccaggaaaagcagtaattaacagcatttgcattttctgggaatatattactgaggagatgatatctgaactgaaaatgaaacttgaagtgtgattaatgttaactgaaaatgctcttttgtgaaccagaggaagcctgagtctataaaattaatggccaattatgtaattatatctgctttaaaattgagtgtcaaataacattttaaattattaaaaatgtattgaatttatttgctattaaacagttacttaacttgtctattgtcccactgtacagcttttctttccccacagtcttaccaagaagatcattctggggtatccaatcaaagagctgagtattgtttcctaatgtggctggtttctttcctttgtatctccataaaacctgtggaaaatggtgctttaattttgcaaggaaaaacacaatgaggacattttaagttgggagaattatttagaaatcatttagccagctacttggaagacgggaattacataagcagtagtttacaaacgttgagatacgtagtaggactgtttatatgtacctttttgtaaagtcttgtactaatagtctaccaagtatagtattattgttttgatatttatcacttaaaagcttttggaagttagattttaagtgaagaaatagaacgtaaacagtaccagtttaatcaatcacaacatgaaggggaaaaatcatgaagagtgttatgtgctttaaacaatacataaatataaagagtcctaggatgtgtcatgaatagaagtataaaaagaatagaaatgcaaaattgtagagataaaaattaaggttaattgaataacataagtcagaaattgcatgttgttggactataatatttgaattttaattgtttttagctagagaatattcaacttagaaaggctaagtgaattgaggcttctacttctaaaccaactacactttgatagagttgtaataaaacctagacattcgaattatatttttagcataatttctccctgctttgtgtttacactctcttttcctggaccatggagctaacaaacttcaaaacttttgaaagtagtcagtggagaacaaaaaatttcaaatagtaaaaggtcagtaggggcttaaagttttcatttctattccattaaaaataaatgacttcaaaaaagtatgtgtttctaaaataatgccaaggctcagtaggcaaatgattcaatgtgctaatgtacacaattttaatatattacacaacgttacttacaactgttactagtgatactcagtgtataatgagttttgattttcatatggaaagaacattactagctgcattgtctctcccattagtaaaaagctgtgtaccaggattccaggctgtactgaccttctgtggaatctgggcaagggctgaggcaataagattggccttttcttctgtaaggtttttgaccattgatcccagagaaaacaccacaacaccatttttacctgagctctggataaattcttccatttcctgcatacataatatattttctattacaaaggtgtagcatcataagaaaaaataagtttacttacacatttaagtaggtaaaattaagatatatgtcagagaaactgttgaactgtctgtcttctgacatgtagaaagatctagtttctatatttttttttggcagagtctcgctctgtcgcccaggctggagcgcagtggcatgatctctgctcactgcaacctcacctccccggttcaagtgattctcacacctcagcctcctgagtaactgggattatagtctcatgccatcgtgtctggctgagttttgtatttttagtagagatggtgtttcaccatgttggccaggctggtctccacctcctggcctccagtgatccacctgccttggtctcccaaagtgctggaattacaggcatgagccactgtgcccagtcagaaatagtctccttaagaggaaacacgtctctgaaatgtataacttaaatatataatcagtgattacaagtccaagcatgaaagcaaaaccattacagaaatgaacactaaataagggacaactcttctcatgctaactgaaattgttacccccaaggcttaatttaaccaatcaacagggttgtttgcaaactcataaaaacagtttttggagggaagcccaacaaaggatactgagctaggcttttaaaattgttagcattccagttatatctaataaaattattaataaatttatcggttcctgttaagcattcaagatcattttctcaactgtatgcctcctttgattcataggtctaagaaaaaatttgtttaaaatggcatctaattgtaacatattttagaacaggataacaaagtgcatctccaactgtaatcacaatgatgcgtatgagacagtgcatctctttcttcttgatgtataagctgccatgagtgtgatgttagctatgtgcccttaatttgagccttaaagcaaaattaaaatataaatttgtctgccaataaaattccttaggtaattacttatagttttgcaaatttgacactgcaaaatctgagattaaggcctttcacatcatatctatatgaatgctactttctacagatgtatcctgcattccctgtgcaaatatttgttgggatcacactggaatcactgatgtatcactttatgactagccaaataactaggggagggtgatatcttaagtgaaaatagattgctatttttggcttagttaatgtcaggagaatatttctgaagtcccaggaattggtgctttgccattttgatttattttccaaacagatattaattcattaaaataacacacacacacacacacacaaacatacacatacacacaaacgtacacatctatcatactgatatggatttttcatttgacagtctcttgttgtttttgtattctgtgtacccagtgattggcgtaattatttcatcagcaatataacccatggttggtattcatatttcccaaagcctatatcgatatttatattgattgaatacataatggcataatgtctgctattgtaaaacatggctgatttgtctttgtgaaattgtgagaatatgtgtatatgtgtgtgtttgtgtaaaaagtgggtttgggaggaaaaacataatagggtgtcatgggtcattatccagtgacctatggatacgtcatgaatatttctgtgtctttatttagatattggtacattatttcctataataaacattcactagagcttgcctgcagccataacttgactggccagaaaatcctgaaataaaatttttagaatcctgaaataaaattttaaacttaaatatgtctgttactataaacagaaatttagtactcttataggaacctgcaactttctaaaaagattacatttgcttgtgtataaaccaagtaaataatagcctgtttcctcactccttattgatagttaaatacattgttcctaccatgtgtacctgtactctattttgcttctcaacactttttctgtataacatttcttatattccacatttcttttctgaagacttcatattgtagcatacaatttccttctcatgccataaaacctgacactatatttataaagaaccaatacaacatttgtatctctcagttttataatagctactttatgctgatgaatctgaatctatttctaatgcttcctgcttgaatttacactttgtactacctaaatgatttctagaaattaccaaaactcctttttgttccttacagtaaataggtcagaaactaaactcaccattgtcaactcaaaagagttttttttttaaccaattgtttcctaacagtagatggcacaactgtctaataaattctcaagattaaaacctaagagccctgccttatttcattgtctttcttcaataatgacctcttactcaccaagttaaatggaattcacccaacagttttcatgaagacatctttatctctcaagaaatttggtaaatattactgttcataatgctatgtggcttggtaagactagggcagtatccttcgtaatttctatgatctggttttctgtcccaccaagtccagtatcaaggtgtagacacactgatatttgtaacacacagctttaatcattttattcttcagtttaaattgtcaatgtaaagttcaaaacacctaatatcacttgtaggagacctctatcacaaggaaaatagatgtggagtagcaaactgaaatgtccagcagcatttatttgttattgaggctataaactttaaaagaaaattaagtattttattatgaagagcataaaatcctccactgttgtagacctaccttaggtaaaggtttggcaggtttgcagtgcaatcctccaacaaactcaaaattaggtaagtatggacgaggaaattcaaaatcccaatatgttcggattaaccaaatttcagctttccccatagtctcacataacgtagtgggtcttcctggagaaaatgtaacaagttggatggaggaaattagcttatatgtttgctgaggagaaaaaaaagctaccagtaatttcctgataagctgttaagaaaaaactgaattaggtcttctagaatacttatcatgtttatatattaagaagaaggagaaattaaagaggatggaagaaaggaaggaggaaggaagaaaagaaggaaggaagggaggaagggaggaaggcaggcaagcagggagggagagagaggaaagcaaggaaaagtgagaaaaagggaagaaagaggtagaaataaagaaagagagagagagaggaagagagagagatggagaaaaggagaaagggaagaagagagggagtagagtggggcctgggaaaggaaggaaggagggaggattttttgttagtgaaaaagaagtaatgtgtaagtgtaatttcacaataataaatcaaccaaaattaaactataactacaactactgacaaattaaacattcattttctctcttcagttaaatgccagataagtttcttccccaggacagcaaatcagaggcattgctagcatgcctctcccacttgaaaagacaatatagtgaatagagagacacactgtgaatttgtttacaagaagcaacacagaaacttaacagaaaaataaaagtaaccataaaccctttgaaaaaagtggtgggcagcagcctatcctgtgagccaggtgaaaaaccatgagtccccagagtgtgagtggggagaaactgcctctgggatatatacacccactgggaaacctggcaatccagaccacggggaaatgccttaaccctacccagtactggagctgctttagtgagcagtgggaaacacatgagaaagagcagcatctggacatggtttgtgtgcactcccagactccagcagggacagagaaaagtcactcctaatcctatatcacaagggaccttgcggaagtctgtcaactaactcaggttgtggtcacaggttgagagagctcccaactgagaatcacagtacaattttgagtggggacaaactccctttggccagaattgaggaatgagtaggaagtgtgctatggccacaggcacaagagatggacatccctactttagaggagcatggcctgaaagccacagtttccatctcagtgggtgtgttaggcctttctcttattcccataaagaaatacttgaaactgagtaatttatttttttaaaaagaggtttaattggcttatggtcccataggctgtacaggaagcatagtggtttctgcttctggggaggcctcaggaagcatctaatcatggcagaaggcaacagagcagcaggttgttttgcatgatgggagcaggagcaagagagagagtgagggcaaaggtgctatacacttaaaaaaaaaaacagatctcgtgataactcactcactatcacaagaagagtaccaagggaggatggcgctaaacctttcatgaatactctacccccatgatccaatcctctccaatcaggccccacttccaacattggggatcacaatttgacataagacttgggcagagacacagatctaaaccatctcagtggggaaggcttatgacctggggcatttttgagttttgagaggagtgtgcctggaatccagttacctgatgctagtggaatactgcaaatgtgagaactgccttgccaagcatgtaggagccaggtgaggtttacttcctgctgctacacatactccccatgtggattcttctgtgcagcagaggcggctgcacttctccctggaacattaccccaacagccagagagcttccctctgatcctcactgtgaccactactcatgcctacatagggggagccagagcacagacttgactgacccagcctcgtgttcttgctcctgcacctgccctggtggcttaacagaaaggacagagaatttggggagctccatgcccttccccgccccccggagtactactcctgggtaacataaggcaagcacaaaactcacttctaccactacaattggagctcttttgcaagtgccacctcttggctagaggccaactgacagtccattacagcatctgcaggcataataacacaaccccaagaaggaaaacacttctgcatgacctcagctatcactattacctgcatcactttgggtaaccaggaggtcctgagtttgtccacatgccagtacgttactaccacagctggcatttgagaaagtcaacattgctaaggccaataaccaaggaatctcacaaagtctatgtaactcccctgccacccctgtcagagctggtgctggtatccactgatgggagactagaggacaggtcatatcactggatcccttgcagacattccctagcaccagtctggggtgtgacagccctactgggtggccaggtctagaggagcagcagcactcatagtagtctggccctcagagactcttactcttgggcaaaggagggctgtaccacaaccatgcaacttgagaaattaaagggtagagtaaaactaagacaacttgaataattaatataatcaagaaaaagtatattattgaaatagaaatcaaattaaaagtcaatcatactcaaaaatagatgctgttacagttaaaatgattatctgactaaatctagtaatattttaacaaaagatatgaaaaagttggactcattatagtaatgaaatgatagcttaaaactgaaaagtagataagttcaccttattagaaggtaaaaagaggaaaatcctatcatctcaagcaataaaaacagttgttcataatcttgaaattctattagtaaactacaaatagaaaagaatttctttacaccaacaaaggcactccaaacaaaaaagtttcatcaaatgtaacctttatgttaaaatagtaagagcattcttatcaagacgaaaaaaagtcagtggtatgtactaatgacaactttaattcaacaatactttactgcagttaaacaagaaaaacaatttttagaataacaaagatttaggagtttatctatctatctatctatctatctatctatctatctatctatctgatatcatgttatgtaacaaatccaaaacaatatacagataaatcttcagaatgaggaagagaagttttaattttgctgaatgcaaaactataacatagcaactgaaatttctgtgcacaagtaaacgaagatttaatttaaaaactaaatttccactgaaaaacttggaatagtttttacaaaagttacataatctattcatgcttataattgcaaaattgtattaaaacccacaatagaaaagtaaatagagctaacttgttcacagataagaagatcaaaattcataaagatgtccattctctaaaatcaatttatagattaattatgaatcttattaagggtcaggagttcaagaccagtgtggccaagatggtgaaaccccgtctctactaaaaatacaaaaaaattagccgggcgtggtggcaggtgcctgtaatcccagatactctagaggctgaggcagagaattgcttgaacccgggaggaggaggttgcagtgagccaagatcacgccactgcaatccaccctgggtgacagagagagactccatctaaaaaaaataaaaaataaatgaataaataaataaatcttattaaaatttcaaaatcacaagtttcataaacctttacaattgttgtagaactttatatgtgattctaaaatccatacggaaaagcaaagagccaaaaataatcaaggaactccagatgaagagatacaagaggaaggaatattattttaccagatatcaagaactaatataaaggaaagcagttaagatagtgaaaaaaaacaaaaccacttatgtaatgaaattcatgaatgacaaagatgcaggcatgcaggaaaaaatgttttcaataaatagtgatgggacagctccttacccaaaaccccatctctacatcaccatcatcaaagaccaaaggtagataaaaccacaaagatagggaaaaaacagagcagaaaaactggaaactctaaaaatcagagtgcctctcctcctccaaaggaaagcagctcctcacacgcaacagaacaaaactggacggagaatgactttgacgagctgagagaagaaggcttcaaacgatcaaactgctccgagctacaggaagaagttcaaacccatggcaaagaggttaaaaaccttgaaaaaaaattagacgaatggctaactagaatcaccaatgaagaaaagcccttaaaggacctgatggagctgaaaaccaaggcacaagaactacgtgacaaatgcacaagcctcagtagccgattcaatcaactggaagaaagggtatcagtgatggaagatcaaatgaatgaaatgaagcgagaagagaagtttagagaaaaaagaataaaaagaaacgaacaaagcctccaagaaatatgggactatgtgaaaagaccaaatctacgtctgattggtgtacctgaaagtgatggggagaatggaaccaagttggaaaacactctgcaggatattatccagtagaacctccccagtctagcaaggaaggccaacgttcaaactcaggaaatacagagaacgccacaaagatactcctcgagaagagcaactccaagacacataattgtcagactcaccaaagtagaaatgaaggaaaaaatgttaagggcagccagagagaaaggtcgggttacccacaaagggaagcccatcagactaacagctgatctcttggcagaaactctacaagccagaagacagtggggaccaatattcaccattcttaaagaaaagaattttcaacccagaatttcatatctagccaaactaagcttcataagaggagaaggagaaataaaatactttagagacaagcaaatgctgagagattttgtcaccaccaggcccgccctaaaagagctcctgaaggaagcactaaacatagaaaggaacaaccagtaccagccactgcaaaaacatgccacattgtacagaccatcgaggctaggaagaaactgcatcaactaatgagcaaaataactagctaacatcataatgacaggatcaagttcacacataagaatattaaccttaaacataaatgggctaaatgctccaattaaaagacacagactggcaaattggataaagagccaagacccatcagtgtgctgtattcaggaaacccatctcacgtgaagagacacacataggctcaaaataaagtgatggaggaagatctaccaagcaaatggaaaacaaaaaaaggcaggggttgcaatcctagtctctgataaaacagaccttaaagcaccaaagatcaaaagagacaaagaaggccattacataatggtaaaaggatcaattcaacaagaagagctagctgtcctaaatatatatgcacccaatacaggagcacccagattcataaagcaagtccttagagacctagaaagagacttagactcccacacaataataatgagagactttgacaccccactgtcaacgttagacagatcaatgagacagaaagataacaagtatatccaggaattgaactcagctctgcaccaagtagacctaatacacatctacagaattatccaccccaaatcaacagaatatacattcttctcagcaccacaccgcacttattccaaaattgaccacatagttggaagtaaagcactcctcagcaaatgtaaaagaacagaaattataacaaactgtctctcagaccacagagcaatcaaattagaactcaggattaagaaattcactcaaaaccgctcaactacatggaaactgaacaacctgctcctgaatgactactgggtacataacgaaatgaaggcagaaataaagatgttctttgaaactaacgacaacaaagacacaacataccagaatctctgggacacattcaaagcagtgtgtagagggaaatttatagcactaaatgcccacagaacagagcaggaaagatctaaaattgacaccccaacatcacaattgaaagaactagagaagcaagagcataacacattcaagacctagcagaaggcaagaaaaaactaagatcagagcagaactgaaggaaatagagacacaaaaaaccctttaaaaaatcaatgaatccaggagctggttttttgaaaagatcaaccaaactgatagaccactagcaagactaataaagaagaaaagagagaagaatcaaatagatgcaataaaaaatgataaaggggatatcaccaccgatcccacagaaatacaaagtaccatcagagaatactataaacacctctacacaaataaactagaaaatctaaaagaaatgaataaattccttgacacgtacaccctcccaagactaaatcaggaagacattgaatctctgaatagaccaataacaggctctgaaattgaggcaataattaatagcttagcaaccaaaaaaagtccaggaccagatggattcacagctgaattctaccagaagtacaaggaggagctggtaccattccttctgaaactattccaagcaatagaaaaagagggaatcctccttaaatcattttatgagtccagcatcatcctgatatcaaagcctggcagagacacaacaaaaaaagagaattttagaccaatatccctgatgaacatcgaggcaaaaatcctcaataaaatactggcaaaccaaatccagcggcacatcaaaaagcttacccaccatgatcaagtgggcttcatccctgggacgcaaggctgggtcaacatacgcaaatcaacaaacgtaatccagcatataaacagaaccaaagacaaaaaccacatgattatctcaatagatgcagaaaaggccttgaaaaaattcaacaacgcttcatgctaaaaactctcaataaattaggtattgatgggatgtatctcaaaataataagagctatctatgacagacccacagccaatatcatactgaatggacaaaaactggaagtattccctttgaaaactggcacaagacagggatgccctctctcaccactcctattcaacatagtgttggaagttctggccagtgcaatcaggcaggagaaggaaataaagggtattcaattaggaaagaggaagtcaaattgtccctgtttgcagttgacatgattgtatatctagaaaacaccatcgtctcagcccaaaatctccttaagctgataagcaacttcagcaaagtctcaggatacaaaatcaatgtgcaaaaatcacaagcattcttatacaccaataacagacaaacagagagccaaatcacgagtgagctcccattcacaattgcttcaaagagaataaaatacctaggaatccaacttacaagggacgtaaggacctcttcaagaactacaaaccactgctcaatgaaataaaagaggatacaaacaaatggaagaacattccatgctcatgggtaggaagaatcaatatcgagaaaatggccatactgcccaaggtcatttatagattcaatgccatccccatcaaactaccaatgactttcttcacagaattggaaaaaactactttaaagttcatatggaaccaaaaaagagcccgcattgccaagtcaatcctaagccaaaagaacaaagctggaggcatcacactacctgacttcaaactatactgcaaggctacagtaaccaaaacagcatggtactggtaccaaaacagagataaagaccaatggaacagaacagagccctcagaaataatgctgcgtatctacaaccatctgatctttgacaaacctgacaaaaacaagaaatggggaaatgattccctatttaataaatggtgctgggaaaactggctagccatatgtagaaagctgaacctggatcccttccttacaccttatacaaaaattaattcaagctggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacaggaaaagaaactaccatcagagtgaacaggcaacctacagaatgggagaaaatttttgcaatctactcatctgacaaagggctaatatccagaatctacaatgaactcaaacaaatttacaagaaacaaacaaacaaacccatcaacaagtgggtgaaggatatgaacagacacttctcaaaagaagacatttatgcagccaaaagacacatgaaaaaatgctcatcatcactggccatcagagaaatgcaaaacaaaaccacaatgagataccatctcacaccagttagaatggcgatcattaaaaagtcaggaaacaacaggtgctggagaggatgtcgagaaataggaacacttttacactgttggtgggactgtaaactagttcaatcattgtggaagtcagtgtggcaatttctcagggatctagaattagaaataccatttgatccagccatcccattactgcgtatatacccaaaggatcataaatcattctgctataaagacccatgcacacgtatgtttattgcagcgctattcacaatagcaaagacttggaaccaacccaaatgtccaacaatgatagactggattaagaaaatgtggcacgtatacaccatggaatactatgcagccataaaaaatgatgagttcatgtcctttgcagggacatggatgaagctggaaaccatcattctcagcaaactatctcaaggacaaaaaaacaaacactgcatgttctcactcataggagggaattgaacaatgagaacatatggacacaggaaggggaacatcacacaccggggcctgttgtggggtggggggaggggggaaggatagcgttgggaaatatacctaatgttaaatgatgagttaatggatgcagcacaccaacctggcacatgtatgtaactaacctgcacgttgtgtacatgtaccctaaaacttaaagtataataaaaagaaaaagaaaaaaagaaaataggtaggctgagagggagtcagggaagaaggaaggagggaaaaaatgaaaaaaatgcaaagaaatggactcaactctgcaaaatacacacaaaaaataatttattttattatcattatttttagagacagagcttcactcttgttgcccaggctggagtgcagtggcgccatctcagctcactgcaacctctgcctcctgggttcaagccattctcccacctcagcctcctgagtagctgggaccacaggcacatgccaccatgtccagtaatttttgtaaaaaataaataattttaaacaaatttatatgtttaaagtaaaagcaaaaccatagcttctattaagacagcataaaaatcctttttttaatttcatagtagaaaaggatttcctcaggaacataaagaaaaattataaagagtatgattaatatattcacttccattaaatttaaaatctacgattcattatctgatattaaaagataatgagaaaaccatcataaactgtaggaagatatctgcaatatataaaactggctcaggctcatctagaatatataagatttttttttttttttgacacagcgtttttctctgtcttccaggctggaatgcagtggtgccaacacagctcactgcagccttgaccttatgagcccaagaaatcctcctacctcagcctctcagtagctgggaccagaggtgcacaacaccaaacctagctatttttttcttttcttttctactattttttatttttcagttttaattttttgtttgtttgtgttgtagagatgatgtctctctctgtttccctggctggcctcaaactcctgggctcaagtgatataccttggcctcctaaagagctgggattacaggtgtagcaatcattgagttgtagactgaaactgtaaattttaaagcatgtaaattatatctcaatacaactgttaataaaagtcagtaaatgaattgaatagtttgcagaacaatgggaaatataacaccctactcgtgaaagtataaactagtataatgtctctgagatgagattatttatacctatacatatttctatacctatacccacacctatacctatacctatacctatacttattgggtgaaaataaatggtttatatcctgtaaatacaattgttcttctggaacaggagacacatagcaaatgttcactgcattccacaaaaaaattacagtcaattgtcaattgacagaatgtcatgctatagtcacctgatggaaaactgtcatagaacttggggaaaaataaaaaggaaatacatgattgtatctctacactaatgttgagcataagtagaaattctacatatgtgtttgtatacatttcaaaaaactaaataatagaatgttgaggaaataacatataactagcagacctataaagtttttaaagagaatgttaaaaccagtcaggcttctggtttccattggaagaatcatgtttctaatactggcagcaaaactttacactcatgtattagcaaagttgatatagtttctaaaagtggaaaatacatgcatattttaaaagatatataaaatatttttaaatgtgcaaaaattaaagttcatgagtcaatcttgcattgttctaattctgccattacaaaaaaaaagttgcattgaattcattgtccttatgtctctagtatgaagcaccctaaaattgcttaatcatttagcatttaccctcagacattttctggggcagggtacaaatcatttcattttctatctggccatttatcttcttgacttgtaactgttagggcattttaggtaatttaagcctttttcctgtgttatgtattacaaatatttttttcagttgacttatgaaccaattaatattatgcaccctttaaaactttaaacacaaactttaaataatctgttttaaaaatcagtgttatgaattgaattgtactcccctaaaatttgtatatgaagcctgactgtatttgaagataaggcctttagagataattaagcttaaagagttcaagggtgggtctctaatccattatgactagtgtccttccaagaagaggaagtgacaccaggaatgcccatatgcagagaaaaagctatatgagaatataagatggtggccataaaaacttcaagaaaaaacagacctggcaaaccctgattttggacgtctagccatcagaactgtaagaaaataaacctttgttattattagttcttgtattagtttgctagcactgctacagctacacaccactggttaggaagttaaattagctaatctttttcatacccagtataacctttggtttgttagttcacatttccttatgattcttaaagataatagttggagtggaagtctacctcagttcatggatttagatgaaagctgtgtacataaaaattagaaagcaaaaccattatttagcagaataggcaaataattttaaaataggtagaataaatgttatcagtgaagtaaaaaaagaaatctactgttttttgggtttttgtttttgttttattttttgagacagaatcttgctctgtcactcaagctggagtgcagtggcaccaacacagctcactgcagtctcgacctcctggcttcaagcaatcctcctacctcaatctcccagtaggtcacctccaagtccagctattcttaatgctattaatttctgccaaatttttaaaaagtcagaaacaacaaaatacagcagggtcataaaagtactctaagaaaatagaggtaacattatagtctcagagaatggaagtccttttctacaagataacccagaaatgataagaaaaaaaaactaataaatgtatgcacacactatgacaaggttcataatatattatgaaatactttaaatgaagagtaatgctacatgatatagctcagagtttttttctccaaatctgtgtgttagcatagaaatacttctaaattattttatttgagaaaacgaaggtctaacagggattgcataaatttaaaactatgggattatttttcattaggctgggttaaatataaaattgttccctttacaaatcacttttgagtaagcaagaaaataaaaatcagcacactgccaaaacaaagtaaaaacatgaattctgaaatacacaatttagtaaaacttgaatggttcattctgaagatacacagtatgttttagggtgggaaagtaggaaagcctaatggattgccctagtttccctcattacacatacgcattcacataagttcaactccccaaatctaccctcactcttacaaataaattccattacatggaaatgtatagcaagaaaaatttcctctgttgacttgtccctgtgtggaagaaaaatatattctctcagaattaacatagtcagcactcatgtgaagttccagttaaaattcaagctagaaaagcatcttggaagaaactgacactagcctcaaagccttcccacagatcaaattccaaggttaataggcagctcctgtttaccgagaaacaagacttcatgtatgaaaatcagcaaaagtaacagagactagaaatattaatataattatttcaaatattagaattatttgaaatagaatataaaattattccatatactatcgtgagttggaagatagctcatgagttggaaaaatcagtatcgttaaaatggccaaattgcccaaagtaatttacacattcaatgacattcatgtcaaactaccaaaatcatcacataattagataaaaactattctaaaatttatatggaaccaaaataaagtgagaatagccaaagtaaagaactaagccgaaagcaccatactacccaacttcaaactataagactacagtaatttaaaaagcatggtaccagtttgaaaagagacagatagacgaatggagcagaaaacaaaactcattaataaagccacacaaaaccatttgatttttcacaatatggacaaaaacaagaaatagggaaaccactccctattcaataaatggtgctgggataactggctagccatatgcagaagaaagaaaccggattgtcacaatttaccctataaaaacattaatggaatgtggatcaaagatttaaatggaagacctcaaagtataaaaatctttgaagaaaacctaggatattatgtattgacatcagccatggcaaagaacttttggctaagtcctcaaaagcaattgcaactgaaacaaaaattgacatgtggggcataattaaataaagaacctctgcagaaaaaaaaaaaaactatccagagagtacaaagacaacctacataatgggagaaaatatttacaaactattcatttaataaaggtctaatatccagattatatgaaaaatttaaacaggtcaacaagcaaaaaacaaataacctcactaaaaaagacaggcaaaagacatgaatagacacttcacaaaagaagacatacaatcaacctgcatacgaaaaaatgtgcattatcactaatcatcagagaaatgtgaatcaaaatcataatgatatataaaacagacatatagacatataacagacatatagaccaatggaatagaataactagaagtaaacagatacctagacatatatagcccataagactgaagtgtgaagaaatccaaaacctgaacgaggcattatcaaataatgaggtaaagcagtgataaaaattctcctatccaagtaaagcccaggacctgaagactttcactgttgaattctaccaaacatttgaataactaatgtcaattctactgaaactattcaaaacatggttgaaatatgttccaaaacatagtattccaactatgtttggaataccaaaaccaaagacacaacaacagtaacaacaacaacaactacaggccaatatctgtgatgaacatagacacaaacatcttaacaaaaatttagcaatctgaattcaacaacatattaaaaagatcattcatcattattacatgtgatttatctcatggatgcaaaaatttttcaacatatgcaaatcaataaatgtgatacatcttatcaacagtaccaggacaaaatccatatgattattttatttgatgatgagaaaaatatttgagaacattaacatctcttcatgattaaaaactctcaaaacaactgagtatagaaggaacatagctcaacattataaaagccataaaccgcaaacctacaggtagcatcatattgaatgagtacaaattgaaagcctttcttctaagatctggaagaagagtaggatatgtgctttcacaacttttacttaacatcatagtagtagtcctagccagagcaattagacgagtgaaagaagtaaagggcattcaaattataaagaaaataaagtcaattattcttatttacaaaaaatatgatcttgtatctagaaaaacctaacaacctcaccaaaaactgttttaagctgataaacccattcagtagttccaggacacaaaatcaacatacaaatatcagtggcatttctatatgccaacagtgaaccatatgttaaaaaaggaagtaatcccatttgcaacagctacaaataaaataaaatacctaagaataaactgaatcaaatacgagaaatatatctacaatgaaaactacaaaatatggatgaaaaagattgaacaggacagaaaaaaatgaaaatgttttctgttcatagaatagaggaatcgaaagcattaaaacgtctatagcacccaaaacaagttacagattcattgcaatccctatcaaaagaccaataaaattcttcacaaattaaaaaatatatatatatctaaactttgtatggaaccacaaaagaccagaatagccaaagctattctgagcaaaaagaacaaagttggaggaactacattacttgacttcaaattatacttcaaagctagtagccataacagcatggcactattataaaaaaagacatatagaccaatggaatagaataatggacacagaaataaatctgtacatctacagtaaactacctttcaacaaagctgccaaatacatacattgggaaaggaatggactcttaatggtgctgggaagctaggtatctatatgtagaacaatgaaagtggacctctgagtagtctgttctcacattactataaagaactatctgacactgtagtttataaagaaaagaggtttaattgacccacagttccacaggctgtacaggaggcatggttgggaggcctcagacaacttacaattgtggtggaagggcaatggggaagcaagcacatcttcacatggtggcaggagagagaaagagataaggggaaattgctacacacttttaaacagctatatctcatgagaactcactatcacaagaagagcaagtggaaaaccagacctcatgatccaatcacctttcaacagatccctcccccaacattttgaattacaattcaacatgagatttggatgaggacacaggagacaaaccatatcaatctctatctctcaccatacacaaaaatcaaatcaccctgaaaaattaaatcactctaatttaaatctaatctttctaatctttaagttaaatctcactgatttaaaacccgaaactttgaggaaacactaagacaatgttctgggcagatttgattaataagacctcagaagcacagccatccaaagcaaaaatggacagatgggatcacatcaacctcaaccgaaaaagcttctgcacattaaagaaaacaatcaacaaactgaagaaacagtctacaaaatgggagaaaatattttccatgtacccatctgacaagggattgataagtagaatatatcagcagctcaaacaattcaaaaagaaaagaatgagtaatcaaaaagaaatggataaaagatctgaatagacgtttctcaaaagaacaaccaacaggcaagtgaagaaatggtcaacatcactattcatcaaagaaatgcaagtaaaaactataatgagatatcatctgagcccagttcaaatggcttttaccaccctgaccccgccgcaaaaacaaacaagcaaacaaacagacagacaaaaaaacaggcaataacaaatgctggtgaggatatggaaaaagggaacccttgtgcactgttggtgggaatataaaattggtgcagccactatggagaagagtgtggatatttctcaaaaaactaaaaataaaactaccatatgatccgacaatcacactgctgggtatatatccaaataaaggaatcagtatatcaaagaaatatctgtacacccatgtttattgcagtactgttcccaatagccaagatatggaatcaacctatatgtgcatcaatgggtgaatcaacggacaagtgaaaatcccgtcatttgcaataacttggatgaatctagagtttcctccagttaagtcaaatgaaataagccaggcgcggaaagacaaatatgccgtgttttcactcacatgtggaagctaaaaacaataattaacgaatgaagatatagagaagatatagagtagagagatggttaccagaggctgggaaaggtcttggggggtggggagggtataaagagggcatgattaatagctacaaaaatatagttagaatgaaaaaatctagtgtttgatagcacaataggatgactatagttaataataatttgtgtgttttaaaatgactaagagtggaattggaattttcctaacatagaaaagataaatgtttgaggttatggatatcccaattatcctgatttgatcattacacattttaagctttcatcaaaatgtcacatttcctgtaaatcgatacaactattatgtatacataataattaaaaatgaaaacttaaacaattataacatgtaccccaccaacaaaaaggaactgaagtgtttgcaacttccagtttaccatttcctgtaaagccactggcttacccattcaattaatttgagagaaatgaagccagaaaaaattgataattttatcttctaactaggatttgcgatagttcatttagggagataagaaatggaaaagtataagctataaatcctccatttagttggaactgtagcttctcattataataaaaatcaaaagctaatgacactttctaaatttctctgccattttcttttctttttttttttttttttgaatagtggtttctaagtttcattttcccacttgaaattgcctctgtgtatgtggcatctataatcaatgacaatggaggaaagaaatatctgcataagtttctgcccatgctttttccactactgttttgtagttaaaatgtaggtgaatgagaaatatgtagctggtggaaataggatataatttcagtttccaattgccaggaaattctcaacttctctgatcttgatttcttcatctgtaaaataaagttagaattacagaactattgttagtattcaacaataaactatgtgtaaaagcactttcaaaactataaaacaaaaatgtgcatcctttggcagttgctaaatgtagtccttaggttaaagttaaatctcacttgagactttctttttcttcaagcagtttatcaagctttaggatctgctgccctcctatggatgatggttgatagtgctgaataagtatggtgagtccaaattattaggagtttaataattttgttgacggcgtaaaaataaagttcatttagatctacttatgtttatacaaagatataatatatatgtttataacatgtaagaaatgtatattataaaacaaattatgtgtacgtatatacgtagacgtacaaaaccaagatgaacacacacaacatatttaataggaaatattgtagccattctctaagcactagtttccttcatattcaggaagaaagactgtttcaaattagggctagtgctatctataagttaaaataatgatataaatacattaaaagtttaagtagatttcattagcaacatacagggtccattaagacgttctttaaaatactaaaataatataaattattattcattattgggagttaacatttctaaaaatattgccattataatacacttactatctaggattttctgatgtaattttcaagatagttgaaataaaatataactaggtttcaaaataaaacagggcaataattgtcttatgtaaaaatcttcaatacttagtttcctgaggaagaaacaaaaccgacacagtaacagtaacaacaaaaatgaaaaacaagactttacaatcctaacattattgtgttcaaatatgtctttcggaaatcattcacatttgggatttaatgagagaaaattttccaggccttaagaatttatttgtttgacatcatttaattatgagtctaaatagattcaaattaaataaaaattagattacatgtttttatatagatatttagtatccgtgtacgtaatcatcataattctatgagaaaatattatttcacagataaataggccagtaagcatgtgtgtgtgtgtgtgtgtgtgtgtgtgtatgtttgtgtgtgtgtgtgtgtatgtgtgtgttgaagggggaagaatgtattacatttggtaagtctggttacagttctcttaaaaatgtttttggggcattaaattaagtccaaccagtaaccccaggaactcatactaatcaatctaattgggagattccactacaggttggcaaaaggctttgtcacaagagaagagatttaaaaagcacaaaaatgtcttggtgaattctaacacatttctaactttgtttattgaaagggtctttgtctatttctgctgccaaaaataaatttattttaaccatgtggccgttgaatgagaatttaaacagaccatattaataatattttgaaataagttttcatgtgtaagtacacaaagattgtatattgaccattaattcctgaaaccctcgatacagtaaaatctttatgcttttcagattcaactttggttaaaatttctttaaaagtgtaattctaagttcaatcaattctatgattatatcaatcaatgtagaaaagccttaagtatactccaatacctttattggttaaaaaatagaagtgaactttcttagacagatgaaaattatgaaacaactattaaatgacaaaaaaacaaacaaaataagaccagcaagaaaccaaacttcggaaaattttctactcaacattgaaaggttagaagaaattttttaaaaactcaggatcaagacaaagatgttgtttaacatactttaaattaatgttgaattttataatttaattatgcaataatatatggaaaaaagttatatattatacaatatatgtatatacatttgtaaatgtaggaatttatttatatcagaaaaaagtttatcaatattgatagatacaattttaatatacaggccacctgatgtgcttcatgcctacaatcccagtactttggtaagccaatacaggaggattgcttgagcccaggagtttgagatcagcctgagcaacacagggagacatatctctataaaaataaaaataaaaaattagccaagtgtggtggtgcatgcgtgtagtccagctactttggaactgaggtgggagaattgcttgagcctgggaggttgagactacagtgagccaacatcagtggcactgtacttcagcctgggtgacagagcaaaatcttgtcttaatgcatacatacataaatacataaaataaaataaaataaaataaataaagccaatatacaaaagtaaattgcagtcttacataccccatacaaacaaaagtgaaattttaaaataacgttaaagaagactctaaaaataatgatatacccagaaataaatctaacataaaaggaatataatctttttcaggtgaattattccatttgtgtgaaacttaaacacattctaaaacctgtgataaaaaataatgaactcagaatcatcctgttaccaaaatctggcagaaacacaacaaaaaataaaataaaattcaggccaacaaccttgatgaatattgatgcaaaaatcctcaacaaaatactttcaaaccaaatgcagcagcatatctaaaagctaatccatgacaatcaaataggctttatctgcagaaggcaagattggttcaacatacacaaatcaatacatgtggttcatcatgtaaacagaaacacaaaaaccacaagattacctcaataggcacacaaaaggcttttgatacctttatgcaaaaactcaataaactaagcattgaagaaacatacctcaaaataataagagacatatatgacaaacccccagccaacaccatactgaatggggaaaagctgtaagcattttccttataaactggcaaagacaagtatgccctctctcactactcctattcaacatagtactggaagtccttccagagcaatcaggcaagagaaagaaataaaaggcatccaaataggaagagagaaagtcaaactttcctggttcacacacaacatgattctatatgtagaaaaccccatagtctcagccccaaagctgcctgcactaataaaaaactacagtaaagtttcaggaaaaaaaatctatctacaaaaatcactgccattcctatacaccaacagcgaagcagagaaccaaatcaggaaggcaatcccattcacaattgctaaaaaagaataaaatgcctaggaatacagctaaccagggaggtgaaagatctctacaatgaaaattacaaaacactgctcaaagaaatcagagatgacacaaacaaatgaaaaaacatttcatgctcatagataggaataatcgatatcattaaaatggccatatagttcaaagcaatttagagattcaaggctattcatattaaactattaataccattcttcacagaattagaaataaaaaactattttaaaatatatatatggaaccaaaaaaaaaaaagagccacaaaagccaaggcaatgctaaacaaaaagaacgaagatggagtcatcacacaatccaactttaaactatactacagggctacagtaaccaaaacagtatggcactggtacaaaaacagaaacatagacaaaggaaacagaatagagagctcataaataaggctacacacctaacaaccatcagatcttctacaaaactgacaaaaccgacaaaaccaagcaataagaaaaggattccctattcaataaatggtgctggcataaatggctagccatatacagaataccaaaactggacccctttcttacaccatatacaaatatcaactcaagatggattaaaaacataaatgtaaaacccaaaactatagaaacctagaagacaacttagtcaatactatcctggacatagaaaaaggaaatattttatgacaaagatgccgaaagcaatcacaacaaaagcaaaatttgacaaatcatatctaattaaacttaagagcttctgcacagcaaaataaactatcaacagtaaacagacaatctacagaatgagagaaaatatttgcaaagtatgcatctgacaaagatctaatatccagtatttacagggaatttaaacaaacttacaagaaagaaacaacctcattaaaaagtgggcaaaggacattaacagacagtttgcaaaagaagacatacatgcaaccatcaagtatattaaaaagctaaaagctaaataccactgattattggagaaatgaaaatcaaaaccacagtgagataccattttatgtcagtcagattagcttttattaaaaagtaaaaaaaataacagatgctggcgaggttgcagagaaaaggaaacagctataaatggttggtagaagggtaaattagttcacccattgtggaaagcagtgtggtgattcctcaaagccttaaaaacagaactaccattaaacccagcaatcccattcctgggtatacaccgaaaggaatataaatcattctatcataaagacacatgcatgtgaatgttcatttcagcatgattcacaatagcaaaaacatgaagtcaacctaaatgcctatcaacgacagattggataaagaatgtgtggtatatatgcatcatagaaaactacacagccataaaaaggaaagagaacatgttttttgcaggaacatagatggagctggggggagggtcattattcttagcaaactaatgcagacacagaacaccaaataccacattctctcacttacaagttagagctaaatgatgagaactcatggacacaaacaggggaacaagagacagtaaggcctacttgagggtggatggtggaaggaggaagaggaagagaaaatataactattgagtactaggcttaatacctgggtcatggaatagtcagtacaaccaacccctgtgtaccacattacctgtgtaacaaacctgcacatgtactcctgaaccaaaaggtttttatttttttaaataaaaaatttaacatatgagcttaaaatagccaagagaaattgaaagaaaaaagttatgaatacttaccaaaacatatgtcaaaatacataacaaagtaataatataatgtataacaccacaaagatgggaaattggcatacaaaaagttagagatcaaaacatatttatagctaatatgccagtgtatttcatacaactgagaaatgggaaaaaatacgaattatttaattaattatctgaaacaattcttaactacatagaaagtaaaagagaactgtatttttatgtgtaagaaaaccaattacaaactcactaaataaatagatttgaaaacaattgtttttatgtgttatctatataatagactcagggaatctatataatggatacaatatactgaatgaataatatattatatcttaatattatatatgcattggatattgtactgccagttcttggtctcgaggctcaaaggtgaggggggcatgcattgaggatttcatgtgttatgaacttcaattctatacttgatgtctaggcaatgtgatgctgctattgtctagcaaagagaaggaaatcttcacatgacccatagggtcaacaggaatatagacgttcaaggtcctcaaacacattcatccagcggtccacatcctatgtcttggcttcggtgtaggacatttcctgacaaaaattgctaaaaattcagcctcatttataattctgctaagccaacaattaggtcttggctataattttcaacacagtccacccacttgctatgggtcataaaggtctctttaaaaattgtcatgggtgtgttctactttatattgtgtcctgagttatacatgtctgaattaattgaaattttctaccttctgttactgaaggcaataaacacagataacagctacataattcttacaattattattgcttccacacttctcaattgttgatttggcacaagctagtccatcctcttccatctgttcctcatgacaattcatcaaaaatgaaaatcgtagtaattgtgattgtactgcatgccaagtgataccactaccccatttctaccagtaatgtagtctctacagctatctagcctaggattactacaatgtaacactctgttttgagttccccaagaaacagacgctgagaaaagaatttgaatacaagtaatttttgtgagaatcatctcgaagtaacaccacaaaggcagtggataaaatgggatagggaaaagacaaaagccaatatgaatgcattaccaagtcacttgccactgcaggaaactgtgcatacatgtaaaaaaatagcataatatttaacagaatagtttatataaatatttttaaaatataaaataatattttacattatttaatgatagatacaaaatgtacaaagacatacaacagatgcaaagaattgaagtcacagttttaaagagcaaatgagcagccaaggtataaaaaattctatagtaatatttaatttcttcagatggctatcaaatatattaggattcatctcaagttagtgtaaaattatatgtaatacattataaaaataatttaaataaaacctttgagataaaggtagaaaattgagcttaatgctttttaaaacagattcatttgaaagtaaattaaataaaaataaagacttgagcaaaagcatttcagaaaatacaaacaagaaagataaagattttacaaaattaatgctggccagaatgcccaggacaagcaccttaaaaaagcatcttatagattgtgaaatgtaacaaaaacatgtaattttcacaaattatttttccatgaaaaatatgaactctgttatttcctcatttattttctgtgtgcttgtattatcaattactgagagaggaccatcataatctccaagtataaatgggaatctgtctatttctcctttaattttcatcaatttactttctttacgttgatcctcttaggtacacacatatttgtgattattatgtcttcttgatgaatttaacacctttacttataaaatgacctttattctcataataatcatttctctgaaggtctaatttatctaatattaatgcagccactccacctttactttactgttagtatcataggtatattctcattttatttttcacctttttctttatgagtttcttaagatagcacagagtttagtcttgctttttttaaaaaaatccaatttgacaatgtctaactattggtgagggttgtgagaactttacatttaatgtgattatctacatgtttgagttgggatttatcattttgctactttttttaagttacctcatctcttttttgttctttttttctttcctatcttcatgtttattagttgaacacattttatgatcctagttgattttttttagcttattaaatattctttttttgctctacctttgttgtggttgtgtgtaaaatttgcaattagtatcatttttagcataacaactttacgacagtatacttcctgtatctcttcccagattttgtgttattgttgccatacagtttacttctatgtattacaacttcacaatacaataaatatctgtagttatcattttggttttaagcagtcatttaacctttagtaatattaaataacattttttaagtcttttttattcattgacttatttacaatttttgtctctccattcgtctagatcgaaatttttactagagatcatttttcttctgccttcaacatttcttcaagaagtggtggtctatagaagattaattttcttggttcttgtagcaacaaaaaaaatcagcctttatttttaaaattaaattggctgggtattaaatttgctgggaatatatgtattaattatgataattttaatttattttagtactttttaggtgtaattgctgttttgtagcttgcattgctttcaatgagaagtctgttttcattctttttttttctttgctagatgaagtattttttaattttccttccatttttcagattttctttttattactcttcaatatattgattatgatgtgatagaggcattttatttttctttttacttggttaattgaacttcttggatctatttgtatatggaattcaccaaatttgaaaaatttggggccattatttattttaatatttttttctgctgatgctccttcctttaggatattgaaatagtatatgttaggatgttttgtttattttgtggggaagggagaagtgattatttctctttatttttcattttgtatagtttctattactatatctttaaattctttttttctatgctgtgtccaatctattaatactatccaatgtatttttaattttagatattgtgtgtttcatctctggtagtttaatgtgggcttgtttatagaaattttatttttctcattatatgcttacttttatgttcttttggccataccctatttttgtttttaggtctacactatagcacttatgtaaatttaaaatttacatacagaaatacagagcaactgctaaaaagtctaaagatgtatcttttcaaaagccccaggcaggaagacttaaaaaatcaataaacaaatattaaaattaattagtcttgtaagttgtccaacataatatcaaattacaaaattcaatagcattctttaacccagatacaagtataaaatgtaacaaaataagatgtttagaattgcaacacaaactatcatcgaagagttatcttaaagatactcaataaccacaagctatttataatagctgttttagagtacttgtctactaattctatcatgtatgtcatgactgtgaacttgtctgtttaataatatgctatttgttgctctcagtcatatatttatgctttgttaactacttcataacttttttttctgattttaccttgttggatactgggctatttttttttaattctgttaaatatttggacgctttgatctggtagagagatatttgtaatttcatccattagaagcttgcgtttaagtttattagatcacattctaacattttatttcggagtaaattttattccaccaaagaggccatacacatctaaagactctatttggatgatgtttggagacctttaaccatggcaaaaaaaaaactatatacatatgtatgatttttatatacgtatgtatacatgaagtaactattattggaccacctactatttctagttgttttatgacctgtttcagtattttccttacattcgtgtgcagatcagtattccaaaaaacaaaacagacttgaggatatttattgggtattatgctcactactgggtgatgggattattcatccatcaagccttagtgacacgcagtatactcagataacaaatttgcacatatacccttggaaactaaaatgaaagcagaagataaaaaataaaatacaatgttactactaaagaaagctggtcatttaaaaaattttcattattcattttatattcattaattggaattaagagattgcttgttcattgaactgtttatacagtataaactaaaatattaatgaattttattttatgtgttctattcattcatactaattatttattttgcttctcaaattgtcccagattttggaaccttcttcacagtagttcctgtattcttttgaaatggctccatcatttctgagcacttttcactttttggtattactagatggtttagactcgacttctgttttcgctgcctcaaacttaaaattaaacacttctccagtgaacggtattttattttattagataatggcatataaaactcaagatgtatattataggtatattcattgttactggagtttcatgtgttttcaatggacaaagagagaaaatatatttgcacatactgacacacacataaacattttctattatctatttctaaataatttttaacagtaaaaatcctttgccacaataacacaatgtttacctatttgataagtcttaataaatatgtgaaatttgttttggaattactcagagatttataaaaaaaatcaaatccactgcttatggaaaaatatttgtcttataaatgagtctcttaacagcattaaaacagtactactagactcatatcacatactacattactacataatagattcatatgattttatgcatagattataacaaaattccaaataagaaatattttttgttccataggcagacaggcaagcaggcaggcaggcaggcaggcaggcatgcaggaaggaaggaaggaaaagaaagaaagaagaaagaaagaaagagagagagagaaagagagagagagagagagaaagaaagagagaaagaaaaaaagaagaaagaaaagaaagaaagaaagagaagaaagaaaaaagaaaatctcctaaggccaattcaaactgttcagaaaaggactgaagaacaaatatatttaaggttcataaacactcatgaatacaaaggcaagtgtccctgtatcaaattatgagcaaactggaattaatgatgaacaagaaaatataaaatattaatatcacattgaaattaactcaagatggaaggagggataaatagaaaatttataaatgtcatagacaatattacaggttaaaagagaatggagataaaaaatactaaaatattattaatttttgcatactgaccctttatcatatatatgtcttacgaatattcacttccattccacagattgccttttaagtttgttgattgtctcttttgctggccagaagctattttaggttgatataatctcacttgtctgtttttgcttttggtgttatatccaagaaattattgccaaggtcaatgtcaagaagcatttccctatgctttcttccagggtttttgtggttttaggtcttaggttgaatatttaatttgtctcagggcatcaaaatgtccatgttacccaaaacaatccagattcaatgaatccatattaaaatcccactggcatttttttaaagaaatagaaaaaacaaaaccaaaatttatatggagccacaaaaaaacaaatattcaaagcaactttgtgcaagaagagaaaagctgcagacatcacactccctagtttcaaaatacactacaaagtgacaagaatccaaacagtattaaagcacacgtatagaccaagggaacaaaatggagagtctagaaagaaacctacccatatatggtcagctggtctttcaacaagatatcaagaatatacgatgaacaaagagtagtctcttcaataaatgatgccagaaacactaaatatccacaagcaaaagaaggaaattggagccttatctgaagccatcactcttcaaatttgatgaaaaaaattcttaaaacttagaaaacagaacttttttgaattaatacaatggttatatatttaacataagcttaaatgggagaaaaaaataaaagcattttctttaaaagcaaatatatgaatgatctagaatgcctacttctacttaatactaaatgtaaagtttcagcttacaaaataaaatacgtgaaatgcctaaaaactgaaaaaaagaaaaaagaccgccacaacttttacatactattatggtctatattgaaattcaaaggaatctacagccactattaagttatagtctacactgagagagataatctttcaatttccctcagctattagtctcaaaggggattcattgttgaacccaaattgataccaaagagaaagggagccaggtgatatcaggtgatacatggttatactcttctcctgaactatgttaaagctacctttgtcatttccccagtaccacaagccatagcttttttcaaacattgctattccctctccttttaaccaccttcacttgaattttgcagattcagtgatattcacacatgctactctgagctactacaaatgatgggaatattaatactcctccaggtagaaagggagccaggtaatacagtcaataaaagtagcttcctagcactatgaatagcgttcattcaggaggtgtactgcaaagtgtttactttgcaggtctggatttctcaacttgtacattcccaaaaaagactcatgttcttatattcaagaggggctcatacctggctcctaagagctgagttccaatcttttggaatacagtgcctaataagagtgtttttgtatatctgaggtcttggtccacattagtttgactagatagtttatgttatcaatgtgatttaccatgatcaccagtttttgctctgagggtctggagtctgggtagctgaggttagtcaaacaggctctagacatctatgtgattgagccttagcaataacccaagacatcaaggttcaggtgagttagttgataaaactgcatcccgtcaccacatatcatttctaggaatattaaataaatcctgtacaactctactggaagaggacccctgcaagcttgcaactgatcttttctgggctacccttcataggtcttttctctctccttattttaatctgtaatctgtattattttgttataatgaaccataaccatgagcctagcagcttctgagtcctgtgagtctttctagtgaatcatcgagtctcagagtagatccataagaataatcagtaagaagttatgaatattttggtaaaacaaaatgtatattatcattgcaatagaaatttctttgtaaaatattttttccttaatcttgaatgtacaagtatacttaaaattccaaaataccacatgaaaaataatttactggaatttatttctcatatttaaacgtgactttaaattacaccattatagtgtaattaagattatattaaaagattatattaaaatatataactaaaatacagccatatggatcagggctctaagtttccattcttgtagacatttgtctttctctttgatttaatgaggatataccaatagtaatagctccatctgcagttggctacgattcatttttttctcctgcaatttttgacgtagttggagtgaggccatatgcaacagggtctttaagccatttccttcttcccagatgtgccatgcagcgtctttactctttataactccccattcccacctcttcccggttacactcttatcctgactatgttaaagctacctttgtcatttccccagcaccacaagccatagtttttatcaaccatcactattccctctccttttaaccaccttcatttgaattttgcagattcaatgatatttacacattgtactctaagctactacaaatcactgtgaatatcaatactcctccaagtagaaaagggtcataaacagggaattataaaataggcctctaagaaaaccccagaggaatgcaagttaaaatgagacatgtactttcaacaaactggtcacaaaataaaaaccatttattatagccaagatgccaaggatgtataaaaattatatatgttttattatgttagcgaactggtatacagaccctaaaggtgaaaccgtgaatgcaattctaccgctggaggaattcctgatttaccaagtctccagcacacccacatacacacaacacacaaatatactatatatcaattatacatatattatatatatacatacatgtaagaattacactgtggtgtgtgctaaagaatacacgactaagtggcagagttaacaatactacttaaatgttattaataacttgaatgtgatctctgtgataggatgtcccagctctctagatatgaaatcatcgacataagctttctattgttctctttcttaaactataacactactttctcatttgaaaaagagaatcagtgatagctatctcaatatcaaatgctttatttttgacttcctattaacgtcttttctttagaaaagcagagagctagggcttgagtgaatcctagaatcacaaagatacctatactgttttagtgaaattagttaagtgggctttggaggtaaatagatctatcttcccatattttttcaaaatgatgtttgtcaaagagagagttacttaatttttatgtttttattttatcataaaattaaaatgataatattttgtaaatatattgtgaaaattagtaataataatccaaatgtttagaaaaatgcttcagtggagagttacatcatcataaattttaaaactaaactgaagattatagcacaagaaagtaggctgtcaacagatttactgcctaaccaccaataatgagaaatagtttagttatctttccaaggtatataacagaatatacaaaaatataacagaatgaagaatactatttgagatgagaagccataacttcaatgtagtcagatatttgtgtatctaaacctgccaagcaaggagaggagtgtgtacatgggcatttctgggtgtgtccactaattatcccagctgacaacctgaaaaagagaacaactgtagccactacatcagggtattttgggaatttgaagactacggacatattactaggctccactgatgctgggataccaactttaatgaaatcacaattgagctaaaaacaaagattggttgaattcaatttctattctaacacaaggctaccacttcacactacttttagttggcacttttgtcaagaaaagacagaaaatatctagaaacatggattccaaaataatatcattaaaatgacaatataagcaccacagtttgtataaatccaataaataccacattatagttattagtttttctttattcctaaaattgttcacttatgtgatgtatattaactttatttttgaaagagattcacgaaaatgaaagatctattcctatgtgtttattttcaataacaaaattgtctatgaattcaaagataattacattcacagcaatttttaaaaggttcaaggtgttttgatataaatataacagaaattacaaaataatttgatttgctaccatgaaggaagagggaaggcataacatgtaatgttacaaagctcaaaaggactaggttttggggttaataaggggtctgcattaaagataaggtaaattttttttccacaagtagggaaattcttttttagtttacacacagcacctttcagaattgaagttgagttgctgatgatgccagtacacccacgttatgatttctttgaaacatccaatggcttcatcatttaggccaaaagagcataatctcacggaggataatttctatttatgaccaactaaaaacaggagggtggcaaacttcttatgcacgacaatagtaaatatggaaatcatccttagtgaatatatttttataaagaagtaactggccaggcacaatgactcaggcctgtaatcccagcactttgggaggcagaggcgggcagatcacaaagtcaagagtttgagacctgcctggccaacagaatgaaaccctgtctctattaaaaatacaaaaattagccagacatggtgaagggctcctgtaatcccagctactctggacgcagaggcaggaaaatcgcttgaacccaggaggcgggggttgcagtgagccgagattgcgccattgcaatccagcctgagcgacagtgcaagactcggtcaaaaaaaaaaaaaaaagtaactacatttaagacaacttttatttttaatcaaggaatacgttatgcactagagattcttgatggcttacaaaccggacgtgggtgacaatttaatcatgatgttaaagttgaaatgataagaggatgtagtaaaaagtccaccaaagaaaactaaaagtgagtaagaatgaagaatgagaagtaagaggtaggagttactcagcctaagtatctgaaaaggtctgggtagtggccttgttagagaggaatcccagagaatgattgatgtgttagttacacacatacacatttgatgaaagaaatcatactgtacactttatgcactttttatcacataaaaattataccttaataaaaacaatagagatcaacagaatggttacaatgaaaataaataccaaaaagaacaataccaagtgttgatgacaatggagaagagctggaaccctagtatatggctagtaggtttactagtttgcacaaccttttgggaaactaaattttaatgatatctatgacctgtcaattccactctcacgaatatatccaacagtatggcatacatgtattcaccaatattaggtacaagaatgttcaaagcagtgttcatcataaggtggcaaaaccaaaatagcctaaatttccatcagcagtagaatggataaataaaatgtgatacattaattcaatagactccatatagctataagaatgagcacagcatatctacatgcaacaacttgtacgaatttcaaaaacataatattaatcaaaataagcaagatacaaaggagtacataatgtgtgattcaactatataacgtttaaagtcaaggaaaattgatccatggtttcagaagccaagaaagtgtttaccattaaataggagttgtggggactgataagcggatgaaagaggagttatggattgcattcatgttttgtttattaatttgagtgctggttgcaagggtggggttacttcgtgaaacttcaatgagctataaagtttaggatttatgttttgcagaaagaatatacaaaattttaaaaacccggccgcgcgcggtggctcacgcctgtaatctcagcactttgggaggccgaggcgggcggatcaggagctcaggagatcgagaccatcctggctaacatggtgaaaccccgtctctactaaaaatacaaaaaattagccgggcttggtgaccggcgcctgtagtcccagctactccggaggctgaggcaggagaatggcgtgaacccgggaggcggagcttgcagtgagccgagatcgcgccactgcactccagcctgagcgacagagcgagactccatctcaaaaatcaaacaaaacaaaacaaaacaaaacaacaacaacaacaaaaacccacaacactgatcacaggaaagctacatataagaaggaattggaaggcttaggtgacgaaagattaacagaaactccaagttttccagggaaagggtgggaagcagggtatgagaattagagtggggataggaaacggagagaagcaataaatacaacactgggcccagaaaagaaactatagttgaaatacaaataatacattattgtgattaatctagtttagttgcagacaagttggatagagggggaaggttaagaggctgtttttttcttaagttaattggggtttattccaaaaataaaaagttgatttaacaactgataatcactttatatattttaccatattggcggaacaaagagaagaataatataataatttgaatagatgcagaaaaacatttgataaaattcatcatccttttatgatgaaaatttatttgaattaaaaagaaaaagggagattcctcaatctaataagagatatctaaaattagcctacagcaaacatcacccttaatggtaaacaatgcatgattttccactgacatctagaatgagacaaaatgcccattaccctcatttttatcttatattgtgctggagtgtctcattaactgttaagagatttgttttcttcatgggctgggataaggtaacattagttctaagaatccatctaaaatttatcagcaggaaatgcttgaggggatggataccccgtactccaggatgtgcttattttacattgcatgtctgtatcaaaacatcctatctaccccctaaatatatactactatgtacccacaagaaagtttaaaaataaaaataaaaataaatttaaaaagaggagtaaggattaaagttcagatttaaattaaatattaaatgtcaaaaaataaaaatgaataaataaaatatatcagcagggaaagagggcccaacatggtactgacagttaaaactaaattttaccagccaagtgtcacatagcttattactgggctttctgctctcccgatctacagtgcgctgggatggatagagacagactggaaacccaaaagacacatgcaaaatggagccatccagtttccagtggccttacctgtctaaccattttcactacagtgttcaagggcttaacctttctattgctgcagcaaaggctagtctcaaattctacagtgagaactatctatttgctgtacagcagatctcttagaagttgaggaagaaataaagttcagaggctgggtgatgtggctcaagcctgtaatcccagcaatttgtgaggccaaggcgggtggataacttgaggtcaggaacttgagaccagcctcgccaacatggtgaaacctcgtctctattaaaaatacaaaaattagcctgacctgctggcagcctgtaatcccaactacaatggaggctgaggcgggagaatcgcttgaacccgggaagcagaggttgcagtgagccaagatccgccactgcactccagcctgggcaacagagtaagagtccacctcaccaaaaaaaaaaaaaaaaaaaaaagagagagagagagagaaataaggttcagttaaatttgatggtgccatgcagaacacttggcctgaccaaaatttattaatagattcacttctggatatgagtagcagtgattttcataattcctgatatccctgttcccttagctattaaaggtatttttaaaatgttaattgttttactcatttcatctgtaagatttaagagttcctcactgatatagaaaacaagttttttaactggtgcaatcaaatatgtccttgtacttattctgatgtccttcaagacatttggagttcttctttgtcacaatttaacatatcatttctcaagtctgtttttcctacacagaactgaagaacaactattgtaatggaaacgccacaaaaatttgacatgttgttagctctcctgcggtcaaacataattacgtaaaattgtgtatctgccctctttcaatatcagtttacagttagcaggtgttcttaatccttttgtttgtgatggcaaacaaaatacaaaatggggttttaccagttcttcacagtataccttaatttgaaataaaatattcaaggcagttatttgttgttcaaattatgttcagtaacatgagaagcataaaggttttaagtaaataggatatttaatttcttaaatgatagaatttctgaacctagattattattttgtaaaggtgagaagttgagaacttgctgttttacaaagcctttttcacacttatctaatttgttatggcttcctttgagaaggaaggtttagtacataccagaaaccatttattttttgtagatttttttggctactttccatttacagagccctgtggtaatataaaaagggttttatcattgcagatttcctaagtagtttggtgtaaataacatttaatataagtataattctttatagttgacatggaatagccacatatgatatcatatgatcctcctaacgaatatagtgaaatttttaaccctattttaaagaagagaaagcactgtgactctaaagtttcagttacttgtctgagatcccagttagccagtggaacctgaagccacatgcatttttcaggacccttcaccttgttactttttgtatgtctcttatttaaggtgtatagattgttaactcattcagtagctgcaataatcactatccaatacatagctgggtagttacaattattgtagaacacatttcaaatgtcttgagacatactcatgtgaattatacccaaattaaaagaaaaatgtggtttgaaggcatataaaatttgaaagccagaaaaaaagaaactacggttaaattatgccttaaaggaattttaaaaatacagaactatacttgtaaaattttagttatagcatcttcaaaaataaactcaaattttatttaccttgcatatgttttatatgtggtatatttaatatctttcctctagacaaattctaagaaaaagttgaaaactttttgataaaaaaaattattgcaagagttttgcaatatcaagagaagaaaaaagatatattcaaataccccttgtgaaaggtaagagtaagatcaagttagtttatgagtattcaagttagtttatgtgtatggcttgccacaggtctttgtacttgttcttacctactcctaaaaggcttttcctccagggatcttatggattctgactttcacttccctcaggtctttggcctgatgtcattctttcatttgatactttctctgcctgctctatttaaatatgcaaactcactctaagaactatctgttcttcttactttattattacatagcatatatcacaggctaaatttatatatttattttatttattggttgtctcctctcatgagaatgtaagttccatgagatagagaatttgatctgttttgcttattgttgtattcctaccacttagacaagttgtaggaactaggttggcattcaacaaatacttttttttacacaaagtaaacaagagagaatgaaggaagaaaagtaaaaaaggaaggaaggcaagaaggaaggcaggcaggcaggcaggcaggaaggaaggaaggaaagaaggaaggaaaaaaaggaaggaaaaaaggaaggcaagaaggaaggcaggcaggaaggaaggaaggaaggaaggaaagaaggaaggaaaaaaaggaaggaaaaaaggaacgaccaaggggagtgagggagaaaggaaagaaagtcaaaaggtatgtaaaaaagtctttcacattacctctgtgagaaagtaccagtggtagcatcatctgttaattcctgctattgattagtgtcccgagtactaagagatctggaggcaaaatcatcaagagagaaggaaataaaaatataaagggaggctcataaaagccaggaaaaataagtaatataaacaaccaatcaggactggccttgatggttaacattattgtgtttgattctcataaggaatgtttcatgcaaggaaacatgaggctggccacaggatagagagaaattaatttgagagatggtgtccaactacccagagatgtgtaaagatagagagacagtgagaaccagggtagagtgtaaactccagttttctattgcctgattctatgcttttcaaagctttctgcagacaaagaaaataatgaaggacaaaggaggcatggtaaatcatgtatcacctcgaaaatatttgccagggtatttttcagtagtgttataatgtatcctaatatgggcactttcatttatattttgaaattgatttatacattgaaaagctattacctaaatggacacaaagttgtttgcattaagagacaatagcatacatattaataccaccatttcattgttaaggatttattcaaagagaataatcagggaattgtttgtacagagatataagaagtccattatcttcagctcagcatatgcagtggaatggaaatcgtttgccatatgacaataagaataaataagggatgtggagtcattaaaaagagaaaattttagacttacctaaaattttgctatagtatgaattccattctccccagtaggactgaaatatatagtcttgcagagaataagatatggtatttttaatcctttcaccaaaggtcatctggtcagtgagctctgataaggctgccggtacataggagactggtgctgggattttcccacagtgtctctccactgttgatgctggagagaacctcaatgtgtacataaatggaattcctaatttcagagcaacaagatcaccacagattgttactgggtctgctaccaacacatcaaaaccacctttctgaagtcttgccatcaactttgggttctttagtacaccatcacagagttgtatgttaatttgaaagaaagtgtctagaagttttcctagttctttgtagaaagcccatattgtgagaggagttggtctatggtcaatccacagcattatcatatgctcaattaaggaatctatattgctcttcttgtaggaaacaggtatcacttcaaaattcacaggagaatcgggattggagttgatgaatagagttgctgatgaagccagtacagtcacattgtgatttctttgaatcaactcttctagaataatcttaatatttaaccaatggctaccatctgtaggccaaattaacacattcccacttagaacaacttcagtcagagtcaaattaaaaaccagcatctggacaaacttcttaggcatggtaaaatcccttatggaaaccatcctactgtagatccttcaagatgaaaaaaaaatcttcaaagtatatttaggtcaatttttaaataaagtaatatttagtgcgatggttacactcagtcgtaggtcaattgatctttagattaaaaggtaaataatataattcaaattcctatatgcactaacatcattatttcagtaacagaaataaaatctggttctttttaaagaaaaggaagcacggggttataaacctaccatctacatattctgtgataataactatgatttataaaatacatctttaatatatttttcactaaattgaataaacaactttcagaggaagtttgctcaaacatttcaaggtgttttagattatatggattatagggtaaaatactatgcatttgatatagaatagctttcttctccataaagccaactgattgttgtctcctatgcctttgttacagggaatttttcagtttcttccatatgacacagatcaagaagatatggcctggaactccaaagaatcacagactttgttattcagagaagttaggtagacactggagttcaatagacccagattcaaatattgtccttttataagatttctgacaccgggtaattattcagaccctcccattctcagttttctcaaagaaaaatgagaggtgagacattaatttgttatattactttgtggattaacaatagtatctgtaaagctacttttcaatcttcttggtacagagtaagagcgtagtaatgttagcggtttaataaatttgtccaaagattgattaggaaatcagtaggccagctacagaatgactggctagacttggatatagtgagatcagatatggatatagtgttgcaattcttagtgaatcccaaactgagcaatagcaattatgtaacaatgctgttttgaaatcattacaggctaccattaaaaagagaaataagaacaaatagagtgattaaaaggataaaaatcaaaaattaagattagaaaataagtgacagattttaagtttatactcaattgcccttaaattatgtaatttcaggcccttgagtaacaaaagaactgggaggacagagaacaggaaagacaagagagagaagtgatggttttagaatttttgcatttgtgtcctctcaagaataagcctcaatttgaatatagtggcagtaccttaaaaattaattagatttttgaaacaaggcagccagagaagagtgtaaataatcttaatggtcttcaaaataagcccagtaaaaggggtttaaaaatcttcataaagaaatctgttgctgtcaaactttcaataaaaagtaaagaaagcaaaacattatagaaaacatgaacaaaagtctatctataaaatacttagatttgttcaaatattgagttacatgtaagaaaaatataataattaattagggattactcacaaatgtagctgcaatagcacataaaagcttatcaaaatatgctccaaaatctcaatacatatagatatccctaaattacccagagtaagggaaaaaatgatgatattagtcaacttccacttttacgtaatatctgcagggcaataaaatatttacctaatttagtgaagaacaataaaatgtatataacgcttttaatttgagttgattatccttaaaacaacattttgtttagtaaaatgtatacaatcctattagtctgaattgataatcctcatagcaacattttggtatgaaagattttcttttccactgaagacatgcccttgcctgaaagtcttctcttccgaagtgctccctgaatattgcacctgatggctaggattcaactctgctggctcttttttcattgtctccccaaggccaaaaaaagcctggaaaccagctttcatactgttttggggatgagtgattcagttttatttgagtttcttgatttgtatttacctaattctctaaaagcttaaatttagatgtacttttagtttttctttgttttgctaaacagaaacagtatattctagcactttgctttttacctcagagtggagtctgatattaaatgattcaccactttctgaattgtaactaggcaagttacttagcctcctcatttaacaaatgatgagaacaatggcacctatttcctatagttctgggtatggtgtgacataatgcaggtaaatgattcagaacagcacctgggctccataagtaatagctagctatgatattttagggagagaatcttattttttaaatgatcaaattaatccgatctcattaccttgacccttctctactctttccctcctcctacactgacagactggggaatctagggtttggtgcagaatttctcaaacactgagagtctccccataaggcagtcactctcagtctttaggcagaccacaagtgataggctattaacaatgcacagagtaccaaaatttacaaattatttattttaagaaatatatgcatataaaactcaagattatatccacacaaattgtaacttccatttccttttgttctgatactctctcatgagtgggagcgaaaaagatagagtgatcactatctctgagaatttccaatgtcccaatgtcaattacatctccaatgtaatgccggtggctgtcattcagcttatggctcattgcagaaaagggaatgatactagaagatttttcaaagattctaaccaatcaagatcaatgtaaattaaaacagaaaaagaagaaggaaggaaggagagaggaaagcaaaggaatgattagtaagaaagagaaaaagaaaaaaaggaagacctaagtagtaatgtattattctacaggaaaagattccagtgcattttttcttctttaaaattactactgaaaatcaagaatcatggaaggatatacacttgaatgtgtttcatttctagcactttattttacattaattactcatgcttagtgagcccacagttcatgcaaagatctagatattatgatcattctttttgaaaatctagatttcttatttactagacttgctaaagtatgttattatagatggcattcatcttagagattattcacctaattattcatatataatgttatgtatttttacatattatatacctctaatatatagagattattcacaaaaaaaccttgtttttacagtggttaaagggtaaagtgctgttggtaacaatatgtaatgcttatggattataagtatttttaatgataaaaatgttacatttttctccccttaaatgtgcccagttttggtgtttttttttaaataaaagtaaaaatgaaatacctggttccattttttgaaatgcataaaaattcaaaaattttttgaaggtatacattcgaaactgtggaaccctttacttcctttcagttagaggtgacttagaaagctctcctaatgccaaaaatatatccctagacaatcctccccagacaacagaatcacatgatgacctactccttaatggatagtaaattatctggtgatacaatggcccaattatattcatttgacaaatcaaaaataggcaagaaatagaatagcagattttaaaagctaaacacattgaaaagaagaaaagcgttcaagaaaaatttaacctaaaatattctgaacagttaatagatttgcacctgaaatttaaaaagaaggaaaaacaattcctagaacaaggaaatatgacatcaaagctttgatatgagaaagattttcatttgaatactattttctcataattttaacatgtttgatatttccaagtctcaatattcttttctgtgttacaacttttttcttgcaatgaactgcaacagttcaaggattgatagaaaatatatgtaaatcacttatcacagtggctagtgcataggaagatattaatatatactgctatcattattatgatatccatgagtttgagctaaatgcccatgatctgaaataaaatgagtaattttacattataaatacccaatttctaccaattagcagagattaaggactcactctgaccttcttattgcattccactgcagagaagtaaacttagggagttgttctatttatttactcaggtgaggctgttcgaggcctgagtggatataaatttgttgcaatgatttcattaaagaattttaagtaaatatagaagatcaattcaaattacaaattggaaaggagttatttttacaagtcagttccatttatcattctcctttatcattctacatccacaaagacttgcacaaaaataagtcactctgtcatgtcaatactttacttcttacctggtcttttaaatatgactgttcatgttcctggcatcagtaagaatattgtgttttaataaagacaaacttaagtagtcattctaagtcagaagagggtaatttgatcagaaacatgatatatcaaaatcagaggataagaacatctttagaaatctttattatgttcctctgaacaaattgttaagaaagattagcctcatgtcttaagactgaaagaatagtgtgcttttattaccagcattaacttacaggcaaaataaaatggaacatgtgattctgagactgccagcctaggtaaagtaaactagtggataacttcacaaataaagagcatagtaatcatgaaaattagaattccaaggttgatgatgagcagttgacaaaactgaagtggtaggattgaaaatgtaaatacaaattgtgaccaagagacggtctatgtacattccgctcttatatgaacggagatgctgcacatattcagagtcccttttagtttaccatacacctgaggatatgaaggagattttgccatcttgacagtttcattgcttcacaaaacttcaattttttttctctgctttcttttaagatctagtttcaaccataagatgtttcccattcacttttatctttataggacacttgaaggtttatctataatcattgtagcaaggcttgtattctctgaatgacagaatagctagctcttcttttacatcccaagatttaaagatctgtttttgaattttgggccaattacttaacatacccagaggaggtgatgacttttgctatcagtgctaattataattggtttaccagcttttgataataatcattcacatggctgtagtatctcacatcctcattcacatactaacctatgcatatttattttgattgatacatatcaactttacagttgttttagaacagagatctgtagaaaagaagctaatgtgtcagtaggtatcactacacagaaatctcactttttcttttgccaacattcacgcaacccactgttttacacagtgcacttcgtcatctttaaattatttttaatagcatttaggatgttcattcattagctagtaaacatctctaggccttacaagctctgcttagcaaacattacagtctctgcagtctgtgcattattactttgttatcagtaacgaatgcacacaaattaatgtgtcaatgttaataacccatgagattacctctgagatctcatcccgtatatccagctgcttactggatttcgccaaatattcccaaaagtatcacatacacagcatgtccaaaattcaatgcaatattaatttttactctcccatattcgctatcagggttgattgggccacactattctaaaatcctttcagatgtaaactaatttagtccttttagtagccctgtcagagatgagataaatgaagttcaggtgcaaggagactgaattacttttcccagccacagactgctatgtggatgttgcctgtaagcacctgctctcccaattgtgttgctaggtagtctcatactgcattattttcctccatttatcagctacttctgtagggcaggctcctaccacatctttcctagagtgatacattagtctagtctcacacctctcaactctactgccacatctgtccaagtgttttacgtaaaatgaaaatcaggtcataatatttccctttagatggtcctgaattgcttattagattaaaatgtttttagaatgacatacaggagactttgaaatattcattgaattaattcactcattcttgcggttccgacgtcattagcatcttcctccatgtctccctaccttacacttgaaccttcagaaatactaaattatcagaaatatccatcgcacctgtgctgttttgtcttcaactttgagcacacttttccttccccattcttaccttgcagaaaaactcacattcagtattttaaaatatccttatgcattatctgaactctgaagtttttcagaataactcactctgtctgtcgcataatacctaactcctctacattttgtattttgtatatatttccatatttacataattcacataataaatattccttttaatgtctgatttatctgtttgtgaaatccttgaatccatggactttattttagtcttcctatctaaaagagtgcttagtaaagagtaagaaatctataattaatgaagaataaatgataaaattcaaaagcataaaaaatgggcaaggcctgtttgatttttagacaaatatgtgtataaatgtatcaacatgatcaatataggcttttattctagtaccattgattatattgtattcatcaggtaaacaccatatcacacttaagcaaattaaataagcttagcatggataaatcaccctgatcaatggttgtagttcacaccttacaattaaaggtgataaagccttaatgtattttgtttctttatgagccttaatatttattaagtgatgatcagagattatccacatatatgtatgttcttaaacgtgcatattaatgtctgtattaataataagcttgtggaaagtttaacattttccggctttctccacacatcactgcagtttctaggcaatttctattttgagcataattatctacatgagatccagcccaacttttaaattgaagtatttgtcactatattttatccataaaagaactgaattgatatatttaagtccatgcaattagaaaacaacacactgtacttctgaagtacaatgtcttttatcttcttttctgctatcaagtgatagtaatatatagtacatcaatacttggaattaaaaaagaatagacatagggaaataaagaagaggctctacaaaggtctgtttgttcaaattcaagtaataaaaacaaaatttgttacatacctaaagctttactatagtatgaatcccatgatttccaaagagtttcaaacatgtagtcctgtaggtggtaggagatgaaatttcttattctgtcagtgaaagacatttggtcggtgagttctgataaaacagcaggaacataggaaggagggtatggtaccttcccacagtgcttttccactgttgaggctggagaaaacctcaaggagtacataaatggaattccaagttttaaagctactatatcgccacaaggaaatactggatcagacaccaggacttcaaacttgcttttctttagctttgccatcagctgttggtttttaagaacgccatcacagatctcctgagacaccatgtggaagtccttgattactttggccatctcctgatagaatctccaaatggttgaaggagatggtctattttccagccatgtcaaaacgaagtccttaattactccttctattctttctttgccaaagggcaccctatatatttcaaatgtcagagatgggttagaggttggtgtgatgaaaagtgcaccagaggcaactaggacagtcacattatgctcctttttaatgagctcatctataattatcttaacatttagccaatgactaccttccattggccaaatcaaaacattcccaccaagagtggttcctatgagacttatctgaagggagaacagcagaaggttgtttaacatgatgtggcttgatgcagaagatttgatgagatgtgaagcaaatgtttttctctgcttttaaagaaaaaaaggaaagacaaaattatttctcaattttgaggcaaaccattaatatccttaaaagccttctttctagaaagtgatactagtcatagtagctccatattttaggatatttacagatttatgggtaatgtgtcttacttctcaaatctgttgttttaattttagtgttttagttatgattcctgctgtctaatcctccttttgaacttgatactccaacccttttttgtgtgtttcataattgttacatttttactattaaattggataaagcttctgtacatctcaactctacattcaggcctaggtattgaaacctcagataggaccaaaactcattcagaaatttaaagatgttaatgctgtaagtttttaaatttttaatgcatgaatataattccatttatcacaattaaacattataataacagttacaatatataagattgtcaaataatatgtataaatatattactataaatatttataaattcaaatatttataaattcaaataatacttataaataatatgtataacacatatagtattatattactactttagtaatatgtttacaaaaatagtttgttaatcctcaagaaaatattataaataaatgaataaaataaaatatgtgcaagagattataggtaatgctagtagtgaataggagctatttaagagaattactaagtcaagcatacatctaccaaaagtgctgttcaaaaactatctagcctgcatgaaaaacagctacttgacatctagattcagccttcaacaactgctagcgtttattaagtccttgttatgtcagacattacgcaaactctttaacacgttaatttcatttcttccttattttaaaaattatccaattatggatcttttataattactcccacatcaaagaaaaagaaaccactgcccaaagagattgaataatttgccatgttcctacagcaaaataagaaaatattacttattgggtacaatggaaatacagtgtacactacttgagtgatgggtatactaaaacctcagatttcaccactacacaatgtacccaaacaggacaactgcacttgaacccctaaatctataaaaataagaataaataaaagataggaactgctggtagcagtcttaaggatctctgactcccacagcctattgtattaaccactgggatagattgccacatcaaaatgtatcacgtccccttaccaactaaggaatccatatgaatagcagcctgccaaaagcatgctaacacaatacaaaattgtgtaacgcacattggataatatcggatcaagtaattcaagtaaagcgatctctgtgaaaatattatgtttgtatgcatatgtctgtgaataagcagagtgatccttttcatgttaataaatcttctgaaattataaattctatatttttagtaatatcataaaaatgtctcttctaagctctcccatcaccaaagataatctgtatggaaacatcaactgtttcattaaaacaattacttttataaagtactgttcaaagtttaacagagtaatcataaaattccttgagtgtatttccattgaagtttctctgcagaagatgttatggtgtgcacaaaatttttgcctttctggtgtcagtctggttcatagtgacttggcaagaaactttaaaataattgtcatgattcactaggatgtcatgattcactgatgttattttcttctatttatttattggcagggaatcaggtccagttttagacaactaaaatatagtattttattcaggtgctattgagagaggagaaagcaagaaaccagttaggcagatagttagaacaaggtccgttggtaaaattctttttaacaaaagggcagcctgaagctgcacaaccttcaagcacagataaacaggcaaggtcgaccctaaaacacccttgtcttttgtaaccagcaaaagacatatacatatacatatacatgctgtgggcttcagtgagcatgtttctttccttttttggacataatcagataaaataacttacacagtggggcttgcctacaacatgcctggaggtgcacagataagattagttacacagaaccagacatgtctgtaatggaaaagtccatctcctgacacatgcgcagtaaggaaacagggtaataaggagtaactcaggttaagggcctgcatgtgcatgagagggagtgggtggagttgtgagaaattcacacctttgcaaataaaaatctttttttgtgtgccatatgaaaattaaacaccccaccccactggcttgtttataaaagcctttgtattcaactgagaaatggcaatcctcttgggccccctctctgctgtggaaaactttcccctttcacttattaaactttcactccaacctcacctttgatgtccacgctcattaattttcttggtcctaagacaaagaactcttgagtaatacctcagatagggagactgctccagtgaccctgggctgcttcactatgtgtttattgggtacctactattcacacacagcagtacctactaggtagaagaggaatccaggagatctttctcatattaattttatagtctatcagtggaagataagaaaaatacatacatatctgtgacaaaaatcactgtagtacattatagtcagcaagatattaaaaacataatttagattttagaataaattaggccaaagaatcctagcttcacattatgctgcttaatatttattagactcaattttctcatatataaaatgaaaattaaaaacaacttgagtttgagaatataaagtaataaaataaaataaacaacatatctgttaataaattaaaaatgaatatacaaaaaataccataaattattatgtaataatacataccacatataagaaaactatatatttaaatagatacaattgtatttattaagcaacaagtatattacctggagtaaaagtgacgtttaaaaatatactatctttttcatgtaatcccttctctttctcttccctagagaaattaacaagggccttcagatgaaatgacataggtaaagtgttttcagagatctgtagagattacttccagctttttggggggattaacggtagggtggaggataggaaagtcttcatgaaaggtatgatatttgatattcatgctgaagtataggctacctggatgtgcatgacaagcagtgcgcaaaaaggcaattgctgttatgccactaatgaactttagtgtttttaaatgttttctattttaatttttgtggagtacataatagacgcataaattcatgtgatacatgtgatgtgctgatacagcataaatacctcagaaatatgatcagtattaaaaaatttctcacactagtgaggttaaattttagattgatttgtattttcgaatttaatagaaaactaaatgaagttatattcacaacaaaaggcttaaagaggttgttaagtaaaaagatttggcctaaaatgtgggtctgaatttgtgtttgtaattactctgatcttaaaatcactgaaaagctaatctgcccttgccagaaaaattttgaaagaaacacattgtatgcctgtatcaaaacatcacaaatatgtcataaatatatacctatatatactatgtgcacataaaattaaaaataaaaataaactgtgtaatatgattactatatttgtgaaagctcatgaattcagagaaaaaaactaacgtatttcagaagaagctagcatactcaaatattttcatcttagagaatgataataaaatatatactttgcttaattgtgttacaggtaattagataggcattaggaatgtcaggtgacagttccatgattatcacactgcctctctaaaaatgagaattttgcagccagtagtgccagggagagacaagctctttatgatccacagctgttaacattaaagtgttaattgaatgcagatgccagagaggagcgactgcctgggcacgtgcattaagagacaaaatgttgaagtgtgaccatccaaggacactttaccaaaaaagggaagaaagcctcagatgagcatatatacaacttcctaaacagactgtgcatgctcatttcccaagggtaagaagggcactgcacatgtgggcagcccaccctaagggaagaatcatggaaaagaggcgagcctataaagtcctaggatcgaggttaaacggggcacttcaggtgcccacttgagtctcttccaagtacgttttcctttctttcctgttctaaagcctttaaaataaacttccgctcctgctctgaaactcccgtcagtctcatctgcctgatgccccccagtcaaattcttacttctgaggaggcaagaattgaagttgcttcagacctgtaaggattcgccactgataactcagatgccttctactggttaacaactgcatacaaaaggagttagcatggcattcacattaacacaattggttattgcttttacaacagcattttctttagaaaaactttatgtccttttttttttttttttttgagaccaagttttgctcttgttgtccaagctggagtgcaagggcataatctcgggtcactgcaacctccatttcccgggttcaagctattctcctgcctcagcctcccgagtagctgggattataggcgaccaccaccacacctgtctaatttttgtatatttagtagagacggggtttcacctggtcttgaacttctgaccagaggtgatccaccctcctcggcctcccaaagtgctgggattacaggggtgagccaccgcgcctggccattattttctttttttaataaataaaattgattttgcataaaacttatttgatttatagcataaaacatttgacttatatttaaagtaaatagattttaaaataaatatttaaaaatccattaaacaatattaagaaaataaaatacccactaaagatgacatctcacatcctctcattcatgtgttgtcttaaggaccacagtggtcacttgtgtacattattcttgtcttcaccatatatcagtataaagtttcttatttgtcactttatgtgtcatctaatgaaggaacaaacaactctccactggtaggaacaaaaggcatgagaagaatccctaaagaggactttgagttcacacttagacaaaactctcaacttactgctctgtccacacagttccctcgatatctgtaaaattattttgaagtataaaatctgggagaaaaatccatcaaattataaagtagaactaataatgctttcatgggtaagcaatgaaacaaaccaaaaggtaaaccagcgttttaaagattgatatttctttaagaagagaatggaaaataaattaaaatatacattttatattgattatcatgaagttttctagtttcttacctgaagtttcctggaggaactttaacagcactcatttgacattaggaagaagccgaatgtaa

SEQ ID NO: 1881 - DNA, 64834 bp, Homo sapiens; identical to SEQ ID NO: 1880

SEQ ID NO: 1882 - DNA, 64834 bp, Homo sapiens; identical to SEQ ID NO: 1880

SEQ ID NO: 1883 - DNA, 3287 bp, Homo sapiens
gagaggaaagaaccctgggaacgggaggcgaagggataatgagctggggatgggagcagtcgcaggaagaatcctctgcctggagccggcaggctccaacccctcagcttgagagtcaggagccccatagtccccacagcaataggaagcaccagctcctggtcccgaaaaaaggagggccccaactccagggactgcggcccgccctggagctgagaacacgcggactccagggagaggacagggcttcagggacccgagagccgctctgagcaccgggggatgtgactgcctcagcggcagagctggaagggccctcgaatgccattcacaggaacagcccaggaacccagggacttcagaagggctggtttgtccgaaaagtgagaggaggcggaggagaggtgaggagagcaagtgcaagaagagaccagaaagtgcagggggtgggggtgatgcgcgatcccgaggaggactgaaaagagactgaaaagcagggctgaggagtggcggcaaccggcagcgtccagctcccgcacctcgctgcacatcgcacctgagccccgccgcgaccgcatcgcgctcgctgcgacccattcagaccccccagaaacgccaagccgctcccgctctagccgagggctagaacaatcctgccacctcagcctcctgagtagttgggactacaagcgagtgccaccacgtccagctgtcatttaccatctggtaccaacccccattagacaatgaaccatccatgatcacgaactgtgtcccttccatcttcgtcagctttaggagcattttttttcccaatggaactccacctatgattactaaccattccccaggacccctagcctacacttttctgtagatgaaaatgtcatacaccacagagttttaacaattacttagttttcccatccacattcactgattatttatttcgagcattatcatttattgagcacagcagggactggggtcttgtccccaccttagagggattatttacactgctaaaggtcacaagggtagtgaggggcagagagggagatggacccagctctcctgacgctggtcccaagctcttccctccacagtgtctaccctctctcgaggactttttctccctgcggcagttccagcaaaggatctcattcagctcacccccaagaagacttttaatacttcaatgacgatgatactaataataatatgcaaagtttgttccaacgcatttagaggtgatcgcgacaagacatgaagccaatccctccctttctggggcaggggaggcagtgatgatcttggactttggatgagtcgctccccagggtctaggcctggctgcccctccccaaccaaatctcccaggtcttttctgtccaaagccctccccctctaccctacctccagctccttctgctctgagccatcaactacgttttctccctcagcactcgccttagattcctggacttaccagcacaaaggtgattttctcctcgcagactgtaggcgccactgctgggtccggaaaagaaagagaaaaggcccagcgtggtcgcgtgtgtaactcaggacgcggctgcgctgggcgcccgagcgcgttctcaggactgcggcccggagttcactgcgaggactgggatcacccatcaccccgccctggtctacggaaaatgacaagtgtttactgatatagaaacggaataacggcgctgtgggctggggagggccgagctgccttcagggttctggtctccagctgcgcggcactcacacctgccgctgtgaaaatgcagacccacggggcaggaattccgagtcccggctggagcgcgatctggaatctgactcgcttgaaacagcaccgcggtggattcggagccgggtgagcagggaactgcgcctcagcccctcccacgggccgcccactgattccaggatccgaaaacgcttccagctgctccgtcaccccaggaaggcagcgccggcctctgggcggttctggtggaaacgggctccgccgcccgcaggaaaactcacaactaagggaccaggaaaaagcctctcagggtcgcgcgccttcagtgaggatcctaatttacaccccgagtgtggccccgtcaaagactagagcgaaggtcactgaaatgacacaagatcagcgaggcccagggcgctgccgctcacagaatgcggagacacggctgcctcgcgtcccttccctgacctgccccaggcggacgcggtgacgtgtgtttgcctcgaggctggaatacatggggatcaaatgcagagaatggagaaaggagggaaggatggggggacatttcgaggaaaggaagggagagggagaaaaggggagagaaaaggtgaaggtgagaataatatctgaaagatgtagttttattatttctaattttatttttgccctttatctagttttgttatttatgaacatttttaccaaagcttttttttctctgtgtgtgaatctgtaaatatacggcttattattcttatttcagagcctgcgaggtcaagctgcagagaacatgagcttctacctccagatgtgccagggtgcatctcgtgggtgcaagaacaagggttttgttttgttttacaaaatcaaagtacaaatctcaaatagaataatatttttaaaccattattgggacatactttgcacacaatcagtgtatctatttgaaatgcacagctcattgagttgtactgcttggctgttttacacacccacatatccactaccacaatgaagataaagaaataacatttccatagtcccctaaagaatagccacgcgataaaattccacgcagtccttaaaaagaggaggataaatttgtaagtattgttatgagaagatctgtgcccagcctacttttatccatttttaaaaggacgaggatatatggaattataataccagtaataccacttacataatatatattttaagtaggggaaaacatggaggattattccccaaaattttgacagggaccccagggactgggataacgttgtgactttcaccttctctgaaatgttggaattttatattacagaataaacttggattttggccaggcgcggtggctcaggcctgtaatcccagctctggaagctgaaggatagcttgagcccaggagttcgaggctgcagtgagctatgatctcaccactacactccagcctgggtgacagcaagagatcttgtctcagaaataaataaataaaatttaaaaataa

SEQ ID NO: 1884 - DNA, 11690 bp, Homo sapiens
gagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggtaggaaacggaggggaggcgctacagctccggggtgggcacagtaggtgggggaagcggggtctgctgtggacacgagacggggtcctgggacagggaaagcccaccggtggggaggcgcggcctcgcctgtctttgcctcaggctgcccggcctgggtcgcggggaggaggaagtgaagggaggagggtgtggtagaatccagcgacaactgaagaaactgcattctggccagagaagtgagccgaggagggcggaaaaaggcccccttgatcttggcattgatggcttacttcatggaatgtttaaggaatccctctctcgggacatacctgagccttcggatgcaggggactccctgaagttggggcactgatgagacctacttgagtgacgggagaggttgggcccgaccagcactgaggtgccaagactcctaggctgattctcctctgtaaccctaggcctcctgtccctgcctgctctgggtgctcatggaatcagctgctgccctgcacttctcccggccagcctccctcctcctcctcctcctcagcctgtgtgcactggtctcaggtagggatgtgtgccacttgctgctgtcacctatcagaaaggaacatcaaccctgtagtctgcaaagggaaagaaagaaggactgtggagttgttgacttaccctttcattctgaacatgttcattgaatttataccagcactgtccaaaaggaatacagtgaggcacaaaggccgagtgcatgtacaattgcaaattttcaaaaaaaattaaattttactttttattttaaaaagtaaaaagaaacatgaaataaatttgtatactatattttgtttcgccccaaataatcaaatacgaatatttaaatacttagttaatataccatattaccaatgagatagtcaacattttgaaattttaaatcttcataatcctgtgtgtattttacacttacagctcatttcagttggaactagctagtggatatgtgtcctattgcacggctcaagtttacagtacactcaggcacagcactagattgggaaatcgaggaaaatcccctcaagggcacagggtggacagagggtgctcagggcaggttcctcagggtttccttcatgaagcagaagcacactttatagttactgctcccaggggtgctgtcgactagccacagctactggtccccagatttctcagcccaaagagaccctatggccatggaaaaaataagtttgtccctagaatatctgcttcctttcttgccttagagatgtgatggctggtgtctttgtctgactctacccctttgttgaacagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggtgcgtcgcttcattttgctttgttactttggcacagtgtgactttggggaaagtttctctcctaacctcaggcccattgcagaccagcaaatttttgtctggactcccttttccactctccctgtggaaacggaattccagggaaaaatccttcctcctgcacaagggacacatgagtgggtttgccctgctaagctaagggcttcacttcttgagaagcacatgcagaattcagctgaggccgtgagcaggggaaaatggtcagtctcggaagagaagtcttatacctgccttaggattgaactgtgcacttcttttgggttttttttttctttttgagacagagtcttgctctgttgtaccctcgctggcacgatcttgtctcactgcaacctctgcctcccaggttgcacttctgagagtgagaggagacactgtcaataattgttccaagacaactggaataaactgattacccagagaactacaacatatcaaatcttatttcttgataaatattaatctttacttcatctttcccaaaatgctgattgcagagagagtgacttattgtaaatagatggttttattaaaccaagacgaaatacagaagcaaaattatatatagttcctgctaactccatagagaaagactacgaattttgctgggaggtaatagggaagccttccacataaaaatgcatttaaactgggatttctaggaatttgttaaaatgacattaagtgattacttcagttttggggttagtgtattatgctttaaaagatatatttgggctgggcgtggtggctcatacctgtaatacgagcactttgggaggcagaggcaggtggattacttgaggccaggagttcgagaccagcctggccagcatggtgcaaccccatctctactaaaaatacagaaacattagccaggctttgtggagtgtgcctgtaatctgagcttcttgggaggctgaggcacaagaattgcttgaacccaggaggcagaggttgcagggagccgagatcttaccacatcactccagcctgggcgacagagcaagactctgtatcaaaaattaaacaacaacaaaaaagatatatttgaggactgaaaaagcctttaaggtgcaggataatctgtggtggcatttcactccatcagaccagacagaggaggtgaggactagggaattgggtctttccctgggggcctcaaatcataacaggtaggagaccccatctttgctacacacaaaggcaaccttgcatctgattaaagcagaatatcatggaaggagggtttcttgaccctgcatcatgactgtgttcatagcagcactccagggttgaccagttatggtttctgcgcggcaggaatctgccattctttgcctataaaactgacagtggcctggcctttcccactctgaattggattgcttaggactttttgtttgtttgttcattgtattctctttgttaggttggttggtggctgattttgcccttaaatctattttgtcatgcttgcctgtattgaacctcatagaatgttttgaagaatttcgttttccaatttgctgagttattttaattcttattccactgagcctttaaatgtacaagtagttttatctcttgataaaaattaaagtgaccctgggccgagtgcagtgattcatgcctgtaatcctagcattttgggaggccaaggcgggtgggtcatccgaggtcaggcgctggagaccagcctggccaacatggtgaaaccctgtctttactaaaattacaaaaagtatccaggcatggtggcacatgcctgtagtcccagctacttgggaggctgaggccagagaatcacttgaattcaggtggcctaggttgcaatgagctgagatcctaccatttcactctagcctgggctacagagcaagactctgtctaaaaaataaatcaataaataaataaataaataaaaataagcctgggcaacatggcaaaatccagtctctacaaaaagatacaaaaaaaaagtagctgggcatggtggcacatgcctgtagtctcagctacttgggaggctgaggtgggaggatcacctgaccctcagaaatcgaggatgcagtgagccatgatcatgcttctgcattccagcccaggcgatagagtgagactgtgtcaaaaaaaaaaatttttttttattaaattgagccaaagcaccagacttaagttattgatttaatttcctgtctttggtaaaattctttgggagactttacaaaggaattactcagaagaagtttagatggtcacacatggctgaaaggtctcccaggaccacgcttttgcagctctttcatacctggtgttcactcttatggaagattcatttaaagatggattgtagttagggtgagtctagtttcttaggatttttggtgatgatctctgatattgaaaaagtggtatggttatcttagtccctggatcatccagatctttctaataagttgatgttctccaagtactataagaaaatcacccagcctgggcaacatgttagccaagaatggtggaaaatgcctgtaatcctagctagttgggagactgaagcaggaggatctcttgagcccaggagtacaaggcacagtgagctatgattttgccactgcactccaacctggacagcagagctaaaaccctgtccctaaaacaacaaaagcaatactgcctaatggatggagcctctgggaggtaaacagtgtgaattaggattagagttggatttgcaggctagatctgtcaagtctcctaaaaaccatcacctcctatgggtggtagaaagcggtggttatgtgaagttctgaactagacagaagggtcaatgtctttggatcaaaaggtttcttaggattctgcccgcctggcagactttcgtccttctcgttattattctagagcttctggaagctgaggtctactgagaagtcgtcccagaagcagaaagtgaaatccaaaacctgcctgtttgaagttggagtcgacacacccatctcaaagtgagaaaattagtctggcaggataaattgaacaagcatttatggcagacagatagatgcttggtgctgtgatggggcctataggtggaccgcaaagaaaagggtgcaatgggatcctttcctcttagagagctcacagtttatgtggcccattggcctgctggtgttctccaacatcaatgttctttcttccttaccctcatcctttttttcttccttcctatttcttgtttcctatctccctcttttttacctttactttctagcttcacagaagagatgcaataggcacagaagagatgcaaaaggcactgacttttgcctgaaccctgatatctctccacaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccaggttagttctctgccctctgagactcgtcgagtgcatgggggatcctcagcacacagatggagcccagaacggggatgggggcagcagtgtgggtgaaatagtcctgggccctaaggacctggaggctgcagctgagtgaagcctttccgcttctcacaaaaggagaatcaaagtgtcccaaaactcaggagtaggagcctcttctctgagggtaaacctgtttttgttgttgttgttgttgttgttgttgtttttccccccaataaggtccttacactgctgcaatttttttttaagacaagttcttgctctgtcacacaggctagcatgcagtggcacaatcttggctcactgcaacctcctcctcccaggttcaagcaattctcatacctcagcctcccgaaggctaggactacaggcacacgccaccacacccggctaatttttgtatttttagtagagatggggatttcaccttgttgaccaggctgttctcgaactcctgacctcaagtgatccacctgcctcagccttccaaagtgctaggattacaggcgtgagccaccatacccggccagcaatttttagacattgaaaacaaccataacatatggagggtggtgtggataagtgactctctacacttggtgttcctgtatgctgtagccatcccttcctgtgcaggggattttccacaggacagagctgtggaaattccctatagacacacactcacaattcattcaacaaatggtcaagaagcatatcgtatgttcaaaacactgttctaccaagggtaaatcattgaacaaattatattaagaactcttccctcaaaaagtgattagttagctaaccatatattctatcagatggtaatgaacatctataggaaacattaagcaaggaaggaataaagaggcaatgtgagacattgcaattcttaacagaatggtcagggaagacttcactgtaaagatgggaattgagccatcccatctgatggcaaggagtcatcagatgcttaaggactgaacaacccagctacaggaagagcatatgcaaagggcctggggaaggaacatctctggcagtttccaggacccccagaaggtgatgctggtgtggctgaaatggagtgagtgcaggaagtgaaaggagatgaattcacagaggcaatgaaaacacattaaacatggcattgtaagccacaaacagtctttggtttttagggcgagtgacgtggaaagcgttggaaggttttgagctaagaagtatcatgatcacactagggctggtctgttgaaaatagactacagaaggtaagggcagaataagaaggagggcaccgcagtattccaggcgtgagtgatggtagcttgaggcagggtggtggctgtgccgactcagcatgacgggttagctttattcatcctggtccttcccatggtgactggtttgctacctctgggccttggccctggaagccattgaggtgtcagccaggtgtgagccagcatcactttctccatctgagttttctgagggagaaagcaggagagcaggtggctgaggagctcttcaagtgtgctcctaggggcactcttaccccagatgttctgtttcaaactaagtggatatttctggctgccttttcagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaaggtaaaagaggctgagtatggtggctcatggcttgaatcccagcactgtgggaggctgaggcaggcagatcacttgagccctggagttcgagaccagcctgggcgataaagtgagaccctgtttaattaaaaaaaaaaagaaaagaaaaagagtagaaggacagttcaccaccatagaaaggacacagctctcccaggtaccagcatacagaagagagaggaaatgcacagcagcagcaaggacttggaactctcatgtccttggaatgaatctctcagagctttcattctttcactctgcccaccttgcattcattcatctggctacataaagtactaaatggttgagcaaaagcaagtgtaacaatgtgctggtactacccagccacctgatcatacataatttctggtttctgacagtgccctaggcatgagggaagggagatgttgctgttcatagaaaggacggttcctgcattgtttactaaaaacccaacttcttttagttcttctgtcaaagacatgattttctttgtttgtttttcagagaaacttcaagaagaattgcgtaagtttagcctttccttaactacatgtacaatttgagttctgctcagcaacatctcatgacattcgtctctgtctgtcccttgcaggatggagaagaacattcttacatgctggtgagtgcctctgatgttccctcagatctcagctttctccacactagccagctaacaggactccttagaggagatgagcaaggggcccagggcaaggtggggacagcagggaacgggggtcagttcatcaacagtgtcccagcaatgatgcatcatgtctcttctgtcagggaatcccagcagctctcaatccaccctatggtttacatcccaggatcctttatcttttggagtaatttaatgcatgattaccagaggtgtcccatatatagtagccttcctaagagttacatttcagtagttgttgttctttgatcctggatgaatttgaaaaaagacaatgctatcttagcagcttatatcctggggatggtgtagactgtgccaagttgaagacccatgtagggaagaggccaggagggtccctagtaagcctgacataagggtgtaccaataggtggccagaaatgcctttctgctcttaagagaacactaatactttgtgtatagcctgccgtgggagggatttcaggtgggtgggagagcacagaacccaattgcccactcccagtgagcacttttcatcttatgattcagcccctctgcccataagcaccacagaatccaagctttaccagataccatggcacatggacctttcctctttaggtgaatttcaaaattgccactgtcaacttgggacaaaatagcaaattgtcacagccagacatattaacttggggaatggaggaaatcattttaacacaatagaaaagtagactgaataagtaagaataaatacagatgggagaggtctgcagaatgcccggagtctggagcatttcttgtacctacagaagtgatatgtgaagacatcagacccatgttgttgaagcaaaactggatgggaatagttactccctacatttgcccacagacccctcaggcaacaggttttcttttggggacatttattctccttcttcattttttgaagggtgcccttgttagtcatttaagtcagttgtgatctggtaaaaggaacacataggaccaatgaagagaccctttatcctccaggacagtgtgaagggaaagactcaccttagttgatccaccggggagaggaggagcaggacataaagcctttgtgctggtttaagccaagttggaaagtttctaagtaaagaaaatcccagagatcataggtcttcatttggggttttgttttgttttgttttgagatgatgtcttgctctgtcacccaggctggagtgccatggcacaatctgggctcactgcaacctctgcctcccgggttcaagcaattctcgtgcctcagcctcctgagtagctgggattacaggtgtgcaccaccatgcccggctaatttttgtatttttagtagagatggggtttcaccatgttgtccaggctggtctcgaactcctgacctcaggtgatccacctgcctcagcctcccaaagttctgggattacaggcgtgagtcaccacgcctggccagagatcatatgtcttggatagaaaagggaacacatcttagaatgctgagagaaagtataagaatgattgattttacttcatttgctaaactttccggatttcttagagctccaattcttctcaaactgagagaactgcttctgtctctggagagacagaagtgcagcttcagtaattctcagtgtgtgagctgcctaggatcagagagccttcatggaagtggccactacgtggggatcccttcagagatatctgagacctctctggggatcaggaaccacacaatccccagggttcctgagaccccaggcctaaacctgagacttcctctgcagttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgg

SEQ ID NO: 1885 - DNA, 18698 bp, Homo sapiens
aactcttgggactgtggaagcccaggagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggtaggaaacggaggggaggcgctacagctccggggtgggcacagtaggtgggggaagcggggtctgctgtggacacgagacggggtcctgggacagggaaagcccaccggtggggaggcgcggcctcgcctgtctttgcctcaggctgcccggcctgggtcgcggggaggaggaagtgaagggaggagggtgtggtagaatccagcgacaactgaagaaactgcattctggccagagaagtgagccgaggagggcggaaaaaggcccccttgatcttggcattgatggcttacttcatggaatgtttaaggaatccctctctcgggacatacctgagccttcggatgcaggggactccctgaagttggggcactgatgagacctacttgagtgacgggagaggttgggcccgaccagcactgaggtgccaagactcctaggctgattctcctctgtaaccctaggcctcctgtccctgcctgctctgggtgctcatggaatcagctgctgccctgcacttctcccggccagcctccctcctcctcctcctcctcagcctgtgtgcactggtctcaggtagggatgtgtgccacttgctgctgtcacctatcagaaaggaacatcaaccctgtagtctgcaaagggaaagaaagaaggactgtggagttgttgacttaccctttcattctgaacatgttcattgaatttataccagcactgtccaaaaggaatacagtgaggcacaaaggccgagtgcatgtacaattgcaaattttcaaaaaaaattaaattttactttttattttaaaaagtaaaaagaaacatgaaataaatttgtatactatattttgtttcgccccaaataatcaaatacgaatatttaaatacttagttaatataccatattaccaatgagatagtcaacattttgaaattttaaatcttcataatcctgtgtgtattttacacttacagctcatttcagttggaactagctagtggatatgtgtcctattgcacggctcaagtttacagtacactcaggcacagcactagattgggaaatcgaggaaaatcccctcaagggcacagggtggacagagggtgctcagggcaggttcctcagggtttccttcatgaagcagaagcacactttatagttactgctcccaggggtgctgtcgactagccacagctactggtccccagatttctcagcccaaagagaccctatggccatggaaaaaataagtttgtccctagaatatctgcttcctttcttgccttagagatgtgatggctggtgtctttgtctgactctacccctttgttgaacagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggtgcgtcgcttcattttgctttgttactttggcacagtgtgactttggggaaagtttctctcctaacctcaggcccattgcagaccagcaaatttttgtctggactcccttttccactctccctgtggaaacggaattccagggaaaaatccttcctcctgcacaagggacacatgagtgggtttgccctgctaagctaagggcttcacttcttgagaagcacatgcagaattcagctgaggccgtgagcaggggaaaatggtcagtctcggaagagaagtcttatacctgccttaggattgaactgtgcacttcttttgggttttttttttctttttgagacagagtcttgctctgttgtaccctcgctggcacgatcttgtctcactgcaacctctgcctcccaggttgcacttctgagagtgagaggagacactgtcaataattgttccaagacaactggaataaactgattacccagagaactacaacatatcaaatcttatttcttgataaatattaatctttacttcatctttcccaaaatgctgattgcagagagagtgacttattgtaaatagatggttttattaaaccaagacgaaatacagaagcaaaattatatatagttcctgctaactccatagagaaagactacgaattttgctgggaggtaatagggaagccttccacataaaaatgcatttaaactgggatttctaggaatttgttaaaatgacattaagtgattacttcagttttggggttagtgtattatgctttaaaagatatatttgggctgggcgtggtggctcatacctgtaatacgagcactttgggaggcagaggcaggtggattacttgaggccaggagttcgagaccagcctggccagcatggtgcaaccccatctctactaaaaatacagaaacattagccaggctttgtggagtgtgcctgtaatctgagcttcttgggaggctgaggcacaagaattgcttgaacccaggaggcagaggttgcagggagccgagatcttaccacatcactccagcctgggcgacagagcaagactctgtatcaaaaattaaacaacaacaaaaaagatatatttgaggactgaaaaagcctttaaggtgcaggataatctgtggtggcatttcactccatcagaccagacagaggaggtgaggactagggaattgggtctttccctgggggcctcaaatcataacaggtaggagaccccatctttgctacacacaaaggcaaccttgcatctgattaaagcagaatatcatggaaggagggtttcttgaccctgcatcatgactgtgttcatagcagcactccagggttgaccagttatggtttctgcgcggcaggaatctgccattctttgcctataaaactgacagtggcctggcctttcccactctgaattggattgcttaggactttttgtttgtttgttcattgtattctctttgttaggttggttggtggctgattttgcccttaaatctattttgtcatgcttgcctgtattgaacctcatagaatgttttgaagaatttcgttttccaatttgctgagttattttaattcttattccactgagcctttaaatgtacaagtagttttatctcttgataaaaattaaagtgaccctgggccgagtgcagtgattcatgcctgtaatcctagcattttgggaggccaaggcgggtgggtcatccgaggtcaggcgctggagaccagcctggccaacatggtgaaaccctgtctttactaaaattacaaaaagtatccaggcatggtggcacatgcctgtagtcccagctacttgggaggctgaggccagagaatcacttgaattcaggtggcctaggttgcaatgagctgagatcctaccatttcactctagcctgggctacagagcaagactctgtctaaaaaataaatcaataaataaataaataaataaaaataagcctgggcaacatggcaaaatccagtctctacaaaaagatacaaaaaaaaagtagctgggcatggtggcacatgcctgtagtctcagctacttgggaggctgaggtgggaggatcacctgaccctcagaaatcgaggatgcagtgagccatgatcatgcttctgcattccagcccaggcgatagagtgagactgtgtcaaaaaaaaaaatttttttttattaaattgagccaaagcaccagacttaagttattgatttaatttcctgtctttggtaaaattctttgggagactttacaaaggaattactcagaagaagtttagatggtcacacatggctgaaaggtctcccaggaccacgcttttgcagctctttcatacctggtgttcactcttatggaagattcatttaaagatggattgtagttagggtgagtctagtttcttaggatttttggtgatgatctctgatattgaaaaagtggtatggttatcttagtccctggatcatccagatctttctaataagttgatgttctccaagtactataagaaaatcacccagcctgggcaacatgttagccaagaatggtggaaaatgcctgtaatcctagctagttgggagactgaagcaggaggatctcttgagcccaggagtacaaggcacagtgagctatgattttgccactgcactccaacctggacagcagagctaaaaccctgtccctaaaacaacaaaagcaatactgcctaatggatggagcctctgggaggtaaacagtgtgaattaggattagagttggatttgcaggctagatctgtcaagtctcctaaaaaccatcacctcctatgggtggtagaaagcggtggttatgtgaagttctgaactagacagaagggtcaatgtctttggatcaaaaggtttcttaggattctgcccgcctggcagactttcgtccttctcgttattattctagagcttctggaagctgaggtctactgagaagtcgtcccagaagcagaaagtgaaatccaaaacctgcctgtttgaagttggagtcgacacacccatctcaaagtgagaaaattagtctggcaggataaattgaacaagcatttatggcagacagatagatgcttggtgctgtgatggggcctataggtggaccgcaaagaaaagggtgcaatgggatcctttcctcttagagagctcacagtttatgtggcccattggcctgctggtgttctccaacatcaatgttctttcttccttaccctcatcctttttttcttccttcctatttcttgtttcctatctccctcttttttacctttactttctagcttcacagaagagatgcaataggcacagaagagatgcaaaaggcactgacttttgcctgaaccctgatatctctccacaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccaggttagttctctgccctctgagactcgtcgagtgcatgggggatcctcagcacacagatggagcccagaacggggatgggggcagcagtgtgggtgaaatagtcctgggccctaaggacctggaggctgcagctgagtgaagcctttccgcttctcacaaaaggagaatcaaagtgtcccaaaactcaggagtaggagcctcttctctgagggtaaacctgtttttgttgttgttgttgttgttgttgttgtttttccccccaataaggtccttacactgctgcaatttttttttaagacaagttcttgctctgtcacacaggctagcatgcagtggcacaatcttggctcactgcaacctcctcctcccaggttcaagcaattctcatacctcagcctcccgaaggctaggactacaggcacacgccaccacacccggctaatttttgtatttttagtagagatggggatttcaccttgttgaccaggctgttctcgaactcctgacctcaagtgatccacctgcctcagccttccaaagtgctaggattacaggcgtgagccaccatacccggccagcaatttttagacattgaaaacaaccataacatatggagggtggtgtggataagtgactctctacacttggtgttcctgtatgctgtagccatcccttcctgtgcaggggattttccacaggacagagctgtggaaattccctatagacacacactcacaattcattcaacaaatggtcaagaagcatatcgtatgttcaaaacactgttctaccaagggtaaatcattgaacaaattatattaagaactcttccctcaaaaagtgattagttagctaaccatatattctatcagatggtaatgaacatctataggaaacattaagcaaggaaggaataaagaggcaatgtgagacattgcaattcttaacagaatggtcagggaagacttcactgtaaagatgggaattgagccatcccatctgatggcaaggagtcatcagatgcttaaggactgaacaacccagctacaggaagagcatatgcaaagggcctggggaaggaacatctctggcagtttccaggacccccagaaggtgatgctggtgtggctgaaatggagtgagtgcaggaagtgaaaggagatgaattcacagaggcaatgaaaacacattaaacatggcattgtaagccacaaacagtctttggtttttagggcgagtgacgtggaaagcgttggaaggttttgagctaagaagtatcatgatcacactagggctggtctgttgaaaatagactacagaaggtaagggcagaataagaaggagggcaccgcagtattccaggcgtgagtgatggtagcttgaggcagggtggtggctgtgccgactcagcatgacgggttagctttattcatcctggtccttcccatggtgactggtttgctacctctgggccttggccctggaagccattgaggtgtcagccaggtgtgagccagcatcactttctccatctgagttttctgagggagaaagcaggagagcaggtggctgaggagctcttcaagtgtgctcctaggggcactcttaccccagatgttctgtttcaaactaagtggatatttctggctgccttttcagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaaggtaaaagaggctgagtatggtggctcatggcttgaatcccagcactgtgggaggctgaggcaggcagatcacttgagccctggagttcgagaccagcctgggcgataaagtgagaccctgtttaattaaaaaaaaaaagaaaagaaaaagagtagaaggacagttcaccaccatagaaaggacacagctctcccaggtaccagcatacagaagagagaggaaatgcacagcagcagcaaggacttggaactctcatgtccttggaatgaatctctcagagctttcattctttcactctgcccaccttgcattcattcatctggctacataaagtactaaatggttgagcaaaagcaagtgtaacaatgtgctggtactacccagccacctgatcatacataatttctggtttctgacagtgccctaggcatgagggaagggagatgttgctgttcatagaaaggacggttcctgcattgtttactaaaaacccaacttcttttagttcttctgtcaaagacatgattttctttgtttgtttttcagagaaacttcaagaagaattgcgtaagtttagcctttccttaactacatgtacaatttgagttctgctcagcaacatctcatgacattcgtctctgtctgtcccttgcaggatggagaagaacattcttacatgctggtgagtgcctctgatgttccctcagatctcagctttctccacactagccagctaacaggactccttagaggagatgagcaaggggcccagggcaaggtggggacagcagggaacgggggtcagttcatcaacagtgtcccagcaatgatgcatcatgtctcttctgtcagggaatcccagcagctctcaatccaccctatggtttacatcccaggatcctttatcttttggagtaatttaatgcatgattaccagaggtgtcccatatatagtagccttcctaagagttacatttcagtagttgttgttctttgatcctggatgaatttgaaaaaagacaatgctatcttagcagcttatatcctggggatggtgtagactgtgccaagttgaagacccatgtagggaagaggccaggagggtccctagtaagcctgacataagggtgtaccaataggtggccagaaatgcctttctgctcttaagagaacactaatactttgtgtatagcctgccgtgggagggatttcaggtgggtgggagagcacagaacccaattgcccactcccagtgagcacttttcatcttatgattcagcccctctgcccataagcaccacagaatccaagctttaccagataccatggcacatggacctttcctctttaggtgaatttcaaaattgccactgtcaacttgggacaaaatagcaaattgtcacagccagacatattaacttggggaatggaggaaatcattttaacacaatagaaaagtagactgaataagtaagaataaatacagatgggagaggtctgcagaatgcccggagtctggagcatttcttgtacctacagaagtgatatgtgaagacatcagacccatgttgttgaagcaaaactggatgggaatagttactccctacatttgcccacagacccctcaggcaacaggttttcttttggggacatttattctccttcttcattttttgaagggtgcccttgttagtcatttaagtcagttgtgatctggtaaaaggaacacataggaccaatgaagagaccctttatcctccaggacagtgtgaagggaaagactcaccttagttgatccaccggggagaggaggagcaggacataaagcctttgtgctggtttaagccaagttggaaagtttctaagtaaagaaaatcccagagatcataggtcttcatttggggttttgttttgttttgttttgagatgatgtcttgctctgtcacccaggctggagtgccatggcacaatctgggctcactgcaacctctgcctcccgggttcaagcaattctcgtgcctcagcctcctgagtagctgggattacaggtgtgcaccaccatgcccggctaatttttgtatttttagtagagatggggtttcaccatgttgtccaggctggtctcgaactcctgacctcaggtgatccacctgcctcagcctcccaaagttctgggattacaggcgtgagtcaccacgcctggccagagatcatatgtcttggatagaaaagggaacacatcttagaatgctgagagaaagtataagaatgattgattttacttcatttgctaaactttccggatttcttagagctccaattcttctcaaactgagagaactgcttctgtctctggagagacagaagtgcagcttcagtaattctcagtgtgtgagctgcctaggatcagagagccttcatggaagtggccactacgtggggatcccttcagagatatctgagacctctctggggatcaggaaccacacaatccccagggttcctgagaccccaggcctaaacctgagacttcctctgcagttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtggcattgattaactttttccagatctaatgtgtggcttgaaagaatatgactggattctcatatctgcctttatactcactctgttgagatatcatagactatataggctcaagaaaactttatcctagtgacagaatgagattaaaaacaacaaactgtgttttattattaatatgaaaatacgattattaaccttgcaggccccttaaaacagttctggttaactgagaccttgtctctaccaaaaacaaacaaaaaaaattaggtgtggtagcgcacgcctgtagtccctgcttcaggagactaaaaagactaactccaactccttgcttgagccaggagttggagtttgcaatgagctgtgatcctgccattgcactccagcctaggcaacagagtgagactctgcctcaaaaaaccaaaacacaggtcgggcacggtggctcacgcctgtaatcccagcactttaggaagccgaggtgggtggatcacctgaggtcaggagttcaagaccagcctggtcaacatggcaaaaccccatctcactaaaaatacaaaaattagccaggcatggtggcgggcacctataatcccagctactcaggaggctgagacagggaatccttgaaccccagtggggtggaggttgcagtgagccaagatcgtgctgcttcactccagcctgggtgaaagagtgaaactcccgtctcaaacaaagagggggagggaacttatgtcagagaccccccccaccccaccccaggaatcctgaaaccatatttgagagttgggatagaggattcgggaagtaaatcaatgtgatggttaattttaggtgtcaacttgattgggttaaggaatacctagacaactgatggagcattatttctggatgtgtctctgagggtgtttccaggggagactggtatgtgagtcagtggactgagtggaagagatctgccatcaatatctttgggcaccttccaatcagctgtgagcccaacagagcaaaaggcagaggaaaggtgaattctctctctctctctgtctctctggaacactcttctcttgctcttcaatatcacaactccaggctctccggcctttggtctttgggacttataccagtggccctgaggttctcaggccttgggtctttggactgagttacgccatcagcttggttctgaggctgtcacactttgactgagccatgctgccagaatctcagggtctccagcttgcagatggcccgtcatgggatttctcaggctacataattgcatgagtcaattcccttaataaatgccctctcatgtctgtatcccctattggttctgtctctctggagaaccctgactgaaacgatcaggcatctaaaatgctggcttaaatgatagtgttttggattttagacaactcagtaatccagttgtaaaactgggttgaacaaaaagctttttaaacagtctgaaattatattactgaaattacaaatgacacattatgggaagaatcaggaacatatatttaaatacctgatttgttaaggcagaaaacagggttgtttatgtgcatgttttagtctgcccagacagctatgacaaatataccaagactgagtcgtttataaacaaccaaaattttttttcttgcactctgggggctgggaaatgtaagaccaaggcaccagcagtttggtaactggtaagagcctgcatccttgttcacagccttttaaatgtgtcctcatatggcaaaggagaaaagtagatctttggtttttgtcccaagaaactggaaagatgggccgggcacggtggctcacgcccgtcatcccagcactttgggaggccaaggcaggtggatcacttaaggtgaggagttcgtgaacagcctggccaacatggtaaaaccctgtctgtactaaaacccagaaggtggaggttgcagtgcaccactgcactctagcctgagtggcagagtgagactctcaaaaaagaaaagagagagaaggaaggaaggaaaggaaggaaggaaggaaggaaggaaaagtaactggaaagatgaagttgttaatttctgagatggggaaacggagagacaaggagcaagacgggagtggtacagaaccaaaggttcagttgtggatacattaaggttgaggagtctatattagagatgcacatggagatgcagagtagtccattgaataaccaagagtccaggtgagacctcaaggctggagatagagattccatactcaactttcctatatgtttgaagagtttcatgatacactgtagtgggtagagggaagaattgtattttgttattaataacagtcctgaatatcattggctttgacaaaatgaggacttcttttcatgtcaataaatatggatggtggccatcaagggctgatctgagagcttgaaatgtcatacatgccccagcttagttctgtctttattttcttctgtcttagcatgtggcttgcatcttcaatgttgcctcatggtcacaaaagggctgcccagctccaaagtccatattctagataagaggaagtagaaagtaaggggagtgtaagggtctaccagctgttttagcctccccttaaataatctgtctgataaacttccaccctcaagcaattggctcaaacttagtcccttggcttcccctgtctacaaatgagatggacaccttgcaataagaaaatgggattttattactgagaaaagtagatctgttattgaacaagcagccagccaactctaccacagagcctaaattcaaactgttgtagtatcattttctaccagccaaggtttcagctaagtcctaggagttttaattactttaagggtctgttttataacataaacaaatgataggcctttatattttatttgtgacccaactaaagttgcaagtgctagtgatacaggatttttatttgtcactttgcaagcaggggacctctggccagcaacaccccacccaagcctcgcttggctaaactggcatgccccagctcacctgtgttatagcttatacccacgttcagcagttcctgagctcttgtaccatgcccaagaagaatgaggatacactagacgttgaagggtgaggagggctgagaagaattttatcaagcgactgaacagctctcagcagagaggggatgctggcacccctacctgaaggcaggaaagctccccctgtgtggctgggtccaggcctgttttatggactcagaatgggaagtgtgtgctgaatggtttgtgagtatgcaaaaaaggttaaagtgaagacaccactcaaagatggccacaacagtgtaaaaaaacaattaggaaagtgtgggtatatggaaagtagttgaagggtggggaccaatcagaggaaagtgcaccaaacaggaagacaagttctcaacaagttctcaatttgggctgaggatttaccttgtagtttggctttcaggctttaaactgtcttcagcttggaggtggggtatcactggggacccattgctacctgcctaggcatctgactgcctcctgtctgctatcactaggtcccaaggtttgtagcaaggaccccttacaaagacatcccccacagtctacccaaaggttaaccttagaacatatttcattgtcagagtgagaaacaaatacacatgaaaatacagtatggcacaaataaggagcaagaggtgaagaaagcttcagtcacacccaaaataattttgtgaaaaatataaaatatgcagttatagacagcactaactctggataccagaaaattctataattcggtaatggatctgagacctgaattttggaggtactaaaatagatgcaatagatctagttttcattatgttcatactttcatttggctctgtggtaaaagatgataatatccaaaacaaaagatgataatatcctccatgtaacaattacatgcaaggggatgtctgcaaactgccacagtatcattttaattaatacctatcttctcttcttaaaatcttttcatttttccactcagttctcctgatatttctgttatgatataaaagacagctgaatgtgaagaaacactgattgtacacgtaacacacacattaatgattcaaatatgtaaacacagagagctgcaaacactttgagaggtagggctgaaacttttcgtcaatgtgtacaattcaatatcgtttcagttttcattctaaccgtccccagtggcttctgcccagcaactgatgagaaatggtacctctgagccaatcaaaacacgaattcctacaaagaggattctcttagtgtttctcggaccgagtgtacagcacatgctttcttttcctttattctggatcagagaatcttaactaaagcagaaataattgtgttaaattaaactaaatttggtatgagatatgtatacatttagcctgagggatggctcttgagcccttaaataatgaactgcaacctaacttagtatgtaaactaactgaaagcttaaggcatgggagtatacttttgtaacaaatagctgagtctcagccaatcccagtagccgaacttcagtcggcggcagtcaaccctgcagccaagtgatcagactatgttcaaataaggccaactctgagctgtaaccaattaagctgtttctgtgtgtcacttcccttgtggaatggagctcactgaacctctctgatggctgcccgatcgttctgatggtttgcaaattgttctttgttcaaattaaaccctgctaaatttaatttgtctaaagtttttattaacaacagaaaactattgattacctttttttgtgggctatgattttcagataggaatattaaggagtaagtggggaaaattgcttagagccagggctacaaggcctggaagaaaagggactgaaaagctgagaggggaactggcacagagaaaggggtgaggatggagagggtagaatgcaaagagtaaggacctgaagaggctgagatttggctgaagagggacaacctgaatagagaaaccttccaactgcatgttcttaggaactaattacagtcagaaaggagcaaagactccttttttttttttttgtcagagtctcactgttgcccaggctggagtgcagtgacacaatctcggctcactgcagcatccaccttcccagccaagcaattctctggcctcagcctccggagtagctgggaatacaggcatacgccaccacacctggcaaattttttgtatttttaatagagacggggtttcaccatgttggccaggctggccggccaggctggtactgaactcctgacctcaagtgatccacccaccttggcctcccaaagtgctgtgattacaggcatgagccactgcccccagccaggagacgaaaagactcctaaaatatctcctggttatgtttaggaacatattccaaaaggttctaaaaagagatgtgccttaaagattcatatgtatattgtaaattttcaactccatattttctagatgtccccaacatccccacaacagcccgtcaacaccctgcccaggtgaccaagtacaccagtgcaacagggctggttcctgcctgcttgcccttgcttaactgtgacctagtgacctcctcccatcttttgatctttattcctctagttcacttcctttgtcactatctctccacccacacctacttgccttaatcaccttaacagcaaaggctgaattattgtaaacaaaaggagtctgtctttttagtgcatgggtccccaagtatgtatatatgaatatgcaatgaaccccaggatactaagcttcacttaaggattttttcctacaaggactcagctgtcacatttgggggcattttgttttgttttgtgaatgtttaaccaagctaatggaggaactattggtacaatgaactcaaaaaatgtacaggatcagcagggcatagtggctcacgcctgtaatttcagcactttgagaggctgagttgggaggatcacttgagcccaaaagttcaagatcagactgggaaacatagtgagacttcatctctaaaaaattaaaataaaataaaataaatacaaggaaaaaagaaaaatgtactggattgaggggaaaaatttatgatgcaaacagaagagcatttatgattgaagtgagagaaggataatgggggaggatggtgaaagaacatcaatctaaatttatatttaaatttacatgaatccagtgcaggcagcatctcaggggagggaggagtctatttttctgttgatttcctgggctaaattcctgactgactcattgctgaaagtaaataacatattattatagttgaaagatttttttttagtgtagtgatttcaaactgtgctcatttatatgcaacccatgaacgcctcccttctcctatgtctccttttgagttgtagggccagtttgaagctttatatatcatttaccaaacttagggtggtgagtgggtgctgatggcagcctggtttgaaaatctccactggagagaagacacagcaggattcagatgcaaatgaccagagcactccaagttggaaagaactgctgagcgggtctgtagagcccatcgctctctcctgtctattcatcagctaggctgaagctcctgacagactcacaccagtatcttgctgctccagaaaggtcgaagatggcagttttcccaaactccggcttgcccagatgtctgctcaccctcattcttctccagctgcccaagctggtttcagataggtctctctctctggcctgcagagttaaaacatctcaataaatataaagtataaaaagaagctggagcccaaccacttcggcacatgttcacaggatctcggggctgtgtcacaagccactgggcactcatatctggctgagaataaatctcttgcaatatttt

SEQ ID NO: 1886 - DNA, 12945 bp, Homo sapiens
caatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaagtaagtggggaatgttgattagagcctgggctacaatgcctgggaggacaagagctgaatcgctgagagtggtgagtgggcatgcagggagagtacttgcccagggaaaggggtgcagtgcctctgtgtgtgtgtgtgtgtgtgtgtgtgtgtgtgtgtgtgtgtgtgcgtgtgtgcgcatgggcacccatgcacacatgtgggcacatggagaagaggcaagtagtgcaaagaataaagacctgcagatattgggatttggtggaaggagagggagacaacataaatgaagaaatattccaactgcatgttcttaagaacttattgtggtcagaaaagggcaaaaaagtcgctaaaatctgttttggccaacacaagccatctattctaagagattctagaaagagatgtgccttatagattcatatgtaaatttgttcattacagaaatacttataatatagaaaaatctgaaccagcatacacatacaacaggcagggggtagacaaacagtgcgtggctctatcataaaagagatttctatgcagcttttaggcatcatgtttttaatgaagggcaattatttctcattttaacagcattagatccatacattaaaccttgttttgtatgttttaggtacagtatctgtttttccttccattaatcatttcctcataacccaatatatgtgtttcaatggacacaatctatttcattgtgtgaatatataattattttgtaatactttactaattttggctatttcaattatctacatttggctactgtatagattttattatatttaacaacctcagacataaatttttgtcttaatttctgtcttttttttttgcctcaacaataattcctataagtggaacttttgggtaaagcatacaacttttttttttaatagcatttccttggtagagcatgtaactttttaaagatgcttgctgtatatatgaccaaaatgctttgagaaatatttatatttctactaccaaagtatatgattactactacagagttttaattttattgattgactaatttgtagaaatgggggtctcattatgttacccaggctgttttaaacccctgggctcaaggaatcctcccaccttgaccatccaaattgctaagattgcaggcatgagccactgaacttttattcctttatgcttttcttcatttgcaatattgactataatcaggaagaaaatataaacatcctttaaaaagaatgaaaacatatgtctcactctaagcagagcagagaaattgttaactttgaaaccagtgataataaaaatgataccccttctatagcaacataaagagaagttttgaggaacagaagatgtgaaatgcaatatttagtctgggtcagtgcaagatccaggcgagggtggaggatggccggctgcacagacctctgttccggtgctttctcttcatccctccccacctccctctgcagaccttgttctcagaggccattcccagactcaggtagctacagcagcgggtgttgtggctgcaggcctcatgctcctttgctttggaagaaactgttgaggagttagtatttactgagcagcttatatgttccagtcagtattatcactcataataattactgttaagtaatacatgaaaaatcttaaatttaaagcatttcaatattttaaaagtaaagggagcaaaaggccaacgtgttcttttgctcacttaacttccgatcttcagtttagcatgcatctttttagactttttcaggcgtttacatctataaatatgcagaaatgtatagctttgtttttgtttttcagttgaatcattagtgtagttctgcaacatgctttttgaccgcttagtgtatcaccattatctaggttcatgacaataaatcaactctttttacctgctgcattgaattccctctgagggatgagccgtagttcctctaaacagtctcctgttgggtggctggttcagtcggttaccacttttatactttaaaaacagtgctgcagtgtcattctcacagaggcttctctctgcactcatgcaagtactttgctagactagacatcagaaagtggaattgctggacccaattgtgcacattcgaaatttcacacttcatgatattgtatgaatcaataaagttccaatggttttgtcccatgaacaagatcacacagcttgtgaatcttagagcctttacctattgcttaccttctttatgtccttaacactaatatagtaggcctcacccattgtgggtgctcagtaaatacttgttgaatgactttatgaagggaagaaagaaaagatgagtaaggcctggtcttattcaaagctctcctaatcaatatctttgtgattaaacgtggtgggttcagcccctgactgacttcagagcctctgccaggcagtctgcctggatcccaccaggagccaccaggccataagttgactgtagtaatggccaagagtttgatgcttgaggagtccacagtgttggacacccacagagctgaacaagggtgggaccagggaatccagtgaagagggtccttcatgaatcagagggggatgatggaagcttggacctggcaagggaagtgtggggaagtgataggattatgaatattttaatattttaatgcagtagagtcagagatgtcctgatcagataacagatattatttttacagatggttttccatactggaacccaaaggtaaagacactcaaggacagacatttttggcagaggtaagatcttctttggtcaccatacttgagttagccctggggaagtggacatttccatgcagaagcctaaagcttcttccaggccatagtgtctgtcccacaccttctggtatctcttgatatgcagcatagatgaaaatggcaagttccctggctttccttctgctcaactttcatgtctccctcttcttggtccagctgctcactccttgctcaggtagggaatgattccatgattccacatttatgtttctgaagcagacaattatctcaattacctaattaagcagacaattacctaaatgccctcttagaacctttaactcattcccatacctggaagtccatcccaacctgaaggaccacctgtcacaaagagacaaatggtccttctgttaggattgtgttcccctctaggttctctgtatctcgccttccctgtctgagaaggacccttcctctcgtgaccccaactccaaaaccctctgatggagcttcccccttgtgctgacagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcaggtgagcctccaggttttgttctgagaacacttctctgtaggatctagagcagatgcagagtccctcttccaaaagtactgcagacactcctggctgctcactagcaattgtctgcactgcctcccaacttagcttctctgcaacccttaagaaagacacattctttctttagaaagaattcctgctgtaccttacatgccgaagtaaacaactccctccctctgacaaccagagatataagggaaatgaaggacgacggataggaaacattagaaatcatctctttagtgactggtacacagtcattttggtttagtcatgtaacagacggcttctgttgtgtctccaagtgcacgttaccgtgggtcctgggaggtggaatggtgactgtatctgctgccagtgttttccaatcagtgactcccagaaacatttttgtagtataatgaggcatgtttcttacttgttgctttgaggaagaacacacatcatggggagctgtggcgaggtctcagtaaggttttagagcagatttattttacaatttgggcttgtgttaggggatttgggggagggtttatagacttagctctcttctctggatgagatactgtcaggaaggtgtggggagatgaattctgagagtgggagccttaatcaagcttatctaggaggaaggagactagggtgagactaaagctgtaaatgatgaagaggcagcaattcctcattgctgatgggggatgtttggttattgttgtggtttgtacaatgttcatgtttttctctgcactcacaaaagattggggtggtcttgtatttcccatgatctgtcacagtgataaagtactattttttgtgttctgtgaaattacttatgttcaacaggaggataccaagacctggtatcaggttccagacgccgaggagagcttttttctttctcagtgcaatcccttgcctcatggcttctggttgggtttggtttaaggggagctgtagcagacaatggtaggaagaagagaaaagggagaggtctgggtgcttattccctggcttccttcctgcaagattccctcaggctggctgcattgccttgctgaaggtcacaagtcaactcaagaaagtcctcaatgcatcaatctttttatgtctccggaacagatccctctcctcctccctctggtaattggggtggatgggaatagccccacattactgaccctgggatactgcactagcccatttagttttcttttcatcatgaccacacttgtgtaaatagctcctgaatgaaatcttccttggattatcaaatgtgagtctgccattgattcccattgagaccctccctgatacaggagctctcaagaatttagggcaatttatccttctacagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcaggtcagtaccctgcttggcctcagctttactgagctgagctgtggcaggtgatgaagggggatgtgtgagtctctactgtgtgagtctctgcggtcaacctgggtctctacaatgcatgtaaggctcaaagcagggacctgaaggctactcactgctttaggggagcttccccacgccacaaagctgttcatgccacaaacatttactgatcacttcctgtctgacagaaacagaaagtgtgacaggcagtgggaattggggaaaaacattaagagaagctccttatgtaaagtcaaatgacaaaatgggaaaacatatatatatttacaaactcatagagaaagagctaatctttttgaaacagaagagtttgaaaactgagtaaaaaatattaacaaaggtcatgaattgttaattcacaggaaaagaaataacccacaaaagagtgctcattctcactcattagggaaacatatctgaaatcatttttcacttatgatattagcaaaaatcaaaaccccactgccttgcttgataccacatggctatggcaggagtgtaggaaggcagtgactctcagtcatttgctcgtgtcacttgtatttttggtgtgcattagcacaagctctattgggggatctatccaaactacatatttattgatccaaaattccagttctgggatatgcttgcatttgtatgagatgatccatgtaaaaggtttctgggggtttttttgtttgtttgtttgtatgttttttgagagggagtctcactctgttgcccaggatggagtgcaatggcgcaatctcggctcactgcaacctcctcctcctgggttcgagagagcctcctgtctcagcctccccagtagctgggattacaagcatgcaccaccacacctggataatttttatatttttactagagatgtggtttcaccatgttggccaggctggtttcaaactccagaccccaattgatccgcctgtctcagcctcccaaggtgctgggattacaagtgtgagtcaccagcccggcctataaaaagtttcttatagcattgattatgattgtataaggttagaagctatggagatgctcactgatggtgaacttccatacaagggaatactgcccaactgtgaaagaaaaaagagataattctctctacactaatatggaaagatctccaagacacactttacacagaagagtgagatgcagagtgatgtgtatagaatgttatttttagtttaaacaagaggaaaaataggaacatattttaatttactttttttagttcttgattctgttatttaacttacatttttaaaatttaacaagcaattttgtaatactcactgtacatcaagtactttatttacttatttagagacagagtctcactctgtcacctaggctggaatgctgtggcacaatcttggctcactgcaagccccgcttcctgggttgaagcaattctatagcctcagcctcccaagtagttgggattacagggacatgacactatgcccagctaatttttgtaattttagtaaacatgggttttcaccgtgtcggccaagctggtctcgacctcctgacctcaagtgatctgcctgcctcggcctcacaaagtgctgggattacaggcatgacccactgcagcccattaggcccttttaaagtattaatttaattcttctaacctcaggagataggcattatcattaccctcattttatagattaggccactacaaacagagaggttatgtaagtagtccaacatcacactgctagtcacataggggagccagcatttaaacccttgccctctgactccacagtttatgtccctaagcatcatattaagtggactaaggaaaagttaatagatggagggagggagtactaggtagatgggagagttgcataactttatgtacatgaagtttttgaaccatgtaaatgtgttactggttgaaaaaatatttagaaaaaaatgagtatgactctgctgaagttaatttccatacgagaggcagacctctcaagatagtaatagtagtagcttgtagtgagggtttaccaaagtcctctctacagtcctctgagactttagggacagaacgcttatttaacctcatgagatggattccatgcccccaacctgggctgagcagctaaagcttggggtgctgaggctggggaggctgagtgcactagctcccatgacccacagctctccccttcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagaggtatccaacgcaagcagagaatctaagcccctggcttgcatgccccagcctgaagatctcacccccattcccaccctgacactgcatcaagtttaaggtttattttcccaaaaccccccttacccataactgttctttttttcttttctttttttgcttattttccagagaagctccaggaggaactcagtaagttcccattccccaggagacccaggcatgtcttcttatccccactttgagcaccttgataacccttccctattcattccattgcagagtggaggaaaatccagtacatggctcgtgagtgactctgacattttctctgaatttgaatcttgaatctatgactctcttctgcttggaaattttccagcccataagtctttgcccagggttgaaaaatggtcctagatccctttactcaggaaaagaaaataagtttggctctttggagaaaccacccagaaggagtctctctctctcgtctatctctctctctaagaaaagaaaaagaggtcttcaatctctttgtactaggggccacagacctttatgccctaaaaagcactgaggaatatccaggggtacacttcaaaaggaagagagaaggatgaggtgcattttctgtggcaggaaacttacttgttgttttccataatctagaggatgttgaaaggaaaacaagaatggaagatttaagagataagaaaatcagaaaagagagagggagacaagtgtgtctaataaagaggaatagctacagtggctcagttggtacagatttatcataactgctttcaaaaactagtccctgaaattgctcattaaatttcccaaattctttttagagcaaggtaggaaatgatacagattgagaagggtggatcttgtactcctagacatacacatatagacatggtgacacctatgcccaggtacaggagtatagacagattcaaaatagattagctggactccactgggaaggaactctcacagtgactgccctgccactagcattcaaccaatgttcccagacttgatattaagaagaagaggtgaagagagaattgagcttgcagagtgagaccacagggaagagtggaatggtcaaaaagaaagtctagatggatgcgaaaggaagtggaaggggccaacagagcaaaggcagtgttcaggtgacacctctatctttctttcattgtaggtggagagaagtctttggcctatcatggtgagtgagcctgatgctctctgggtttgctgggtcatgtacaatgaacatttcaactttttctctgctgtgacccattgacgttctcagttggattaatcagatctaacccttagactcaattttgcatggtagggggttgacttctgcttttctggagcctctgagagactcctgaccctgcacatgcccaggcaaagcataaccatgcagcctgcaccccccatggcacagggagccgagcctgacattgtttagaaggtgccacctctgatctatcagagctgtagaggaaggaagctgaagcctggaagagactctgaagaaaaggagagaaaacgtgtagtgaaaggagaatggagtggagaaaagaacaaaaatactgacctttttcttatctgtgtctccttcctttcagaatggaaaatggccctcttcaaacctggtgagtaaatcactgtatgttccctggatcaacaacctgagggactatattcctttctcctcctccaactcttgtgatttagggaagaaaagttcccttgactaagaaagtttggggtagacaacattaaatcccaatctgaaaagtgggcccatctccaagacccttcccgctgagagcccagggaaccagggagaattgctctcttgggcttcctcagaccttcctgggaaggaagacacataaagggtggagctgaggggaaggagacacacactgagtgatactgcagggagagtgaggatgcaaatgccaaggagaggaggtgatgcctgcccaaagaactttgcacttcccaggcttctcatgccccctactgcctgtgtcacctcaaatgatttaatgcttccgagctttcgcctccacatttttaaatgaaaattgcaatctgtgttttgtgggggtgaggtgaagactgaagtaataataaatatccactggtcaaaaaccaagtaagaaagagatgacaagttcaaactggttggttgaaaaaggtttgcggaaaggagggataagggtaagcaataaggaaaagtgcagtgcccccatggttcccaacagtggggagctgtcttcactcctagcctgggaggtctaggaaggggaggcagttactggaacccagagaaaagtagctcaaaagagagggctccctgagaagagtcgtcaggccttgttagagtagcatcagctgctgctggcagggaggaagcaggagaataaacagtgtgtctctcctttctttctccttccaatcttctatcagggcctcccattggccaaacccaacagcaaaccagaagacaagggagcccagtggcactatccttagagtacagattcctaggacccagaagagggtggaaaaagctgaaggctggagagtgaatctggggcccctcatagagcccagcatagagacggccttgcagctattagaacatcaggagcttccttcatgccctgctgtgggctgagtaaataacatgattcccctatactacgctagagagtcatatttttatccccatttttcaggtgacaaaatgcttcagatgaggctccaccttgttaaataaattggatgtatggaaaaatagactgcagaaaaggggagctcatttagttcataagcggtcgagtgaagattgaaaattaacctctgagtataaggcattagggggcagagtcaatgtggggagggaaacaagaaaaatgtagcaagaggatccttattgcttcctgaggcagcatcagggtattgggttaggcagatactgaccttactttcatttcccctctggacacaagaccccttgagctttctcccatgacattgatgagagagtcatatttagagcaggctagggacgccaggttctggaaggacctccttagcatggtccaggccttgcatgctgaggctctgaaatccaggaaaaatggctgaccccatggacacctcctcaaactctctgcagcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgctta

SEQ ID NO: 1887 - DNA, 11715 bp, Homo sapiens
aactcttgggactgtggaagcccaggagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggtaggaaacggaggggaggcgctacagctccggggtgggcacagtaggtgggggaagcggggtctgctgtggacacgagacggggtcctgggacagggaaagcccaccggtggggaggcgcggcctcgcctgtctttgcctcaggctgcccggcctgggtcgcggggaggaggaagtgaagggaggagggtgtggtagaatccagcgacaactgaagaaactgcattctggccagagaagtgagccgaggagggcggaaaaaggcccccttgatcttggcattgatggcttacttcatggaatgtttaaggaatccctctctcgggacatacctgagccttcggatgcaggggactccctgaagttggggcactgatgagacctacttgagtgacgggagaggttgggcccgaccagcactgaggtgccaagactcctaggctgattctcctctgtaaccctaggcctcctgtccctgcctgctctgggtgctcatggaatcagctgctgccctgcacttctcccggccagcctccctcctcctcctcctcctcagcctgtgtgcactggtctcaggtagggatgtgtgccacttgctgctgtcacctatcagaaaggaacatcaaccctgtagtctgcaaagggaaagaaagaaggactgtggagttgttgacttaccctttcattctgaacatgttcattgaatttataccagcactgtccaaaaggaatacagtgaggcacaaaggccgagtgcatgtacaattgcaaattttcaaaaaaaattaaattttactttttattttaaaaagtaaaaagaaacatgaaataaatttgtatactatattttgtttcgccccaaataatcaaatacgaatatttaaatacttagttaatataccatattaccaatgagatagtcaacattttgaaattttaaatcttcataatcctgtgtgtattttacacttacagctcatttcagttggaactagctagtggatatgtgtcctattgcacggctcaagtttacagtacactcaggcacagcactagattgggaaatcgaggaaaatcccctcaagggcacagggtggacagagggtgctcagggcaggttcctcagggtttccttcatgaagcagaagcacactttatagttactgctcccaggggtgctgtcgactagccacagctactggtccccagatttctcagcccaaagagaccctatggccatggaaaaaataagtttgtccctagaatatctgcttcctttcttgccttagagatgtgatggctggtgtctttgtctgactctacccctttgttgaacagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggtgcgtcgcttcattttgctttgttactttggcacagtgtgactttggggaaagtttctctcctaacctcaggcccattgcagaccagcaaatttttgtctggactcccttttccactctccctgtggaaacggaattccagggaaaaatccttcctcctgcacaagggacacatgagtgggtttgccctgctaagctaagggcttcacttcttgagaagcacatgcagaattcagctgaggccgtgagcaggggaaaatggtcagtctcggaagagaagtcttatacctgccttaggattgaactgtgcacttcttttgggttttttttttctttttgagacagagtcttgctctgttgtaccctcgctggcacgatcttgtctcactgcaacctctgcctcccaggttgcacttctgagagtgagaggagacactgtcaataattgttccaagacaactggaataaactgattacccagagaactacaacatatcaaatcttatttcttgataaatattaatctttacttcatctttcccaaaatgctgattgcagagagagtgacttattgtaaatagatggttttattaaaccaagacgaaatacagaagcaaaattatatatagttcctgctaactccatagagaaagactacgaattttgctgggaggtaatagggaagccttccacataaaaatgcatttaaactgggatttctaggaatttgttaaaatgacattaagtgattacttcagttttggggttagtgtattatgctttaaaagatatatttgggctgggcgtggtggctcatacctgtaatacgagcactttgggaggcagaggcaggtggattacttgaggccaggagttcgagaccagcctggccagcatggtgcaaccccatctctactaaaaatacagaaacattagccaggctttgtggagtgtgcctgtaatctgagcttcttgggaggctgaggcacaagaattgcttgaacccaggaggcagaggttgcagggagccgagatcttaccacatcactccagcctgggcgacagagcaagactctgtatcaaaaattaaacaacaacaaaaaagatatatttgaggactgaaaaagcctttaaggtgcaggataatctgtggtggcatttcactccatcagaccagacagaggaggtgaggactagggaattgggtctttccctgggggcctcaaatcataacaggtaggagaccccatctttgctacacacaaaggcaaccttgcatctgattaaagcagaatatcatggaaggagggtttcttgaccctgcatcatgactgtgttcatagcagcactccagggttgaccagttatggtttctgcgcggcaggaatctgccattctttgcctataaaactgacagtggcctggcctttcccactctgaattggattgcttaggactttttgtttgtttgttcattgtattctctttgttaggttggttggtggctgattttgcccttaaatctattttgtcatgcttgcctgtattgaacctcatagaatgttttgaagaatttcgttttccaatttgctgagttattttaattcttattccactgagcctttaaatgtacaagtagttttatctcttgataaaaattaaagtgaccctgggccgagtgcagtgattcatgcctgtaatcctagcattttgggaggccaaggcgggtgggtcatccgaggtcaggcgctggagaccagcctggccaacatggtgaaaccctgtctttactaaaattacaaaaagtatccaggcatggtggcacatgcctgtagtcccagctacttgggaggctgaggccagagaatcacttgaattcaggtggcctaggttgcaatgagctgagatcctaccatttcactctagcctgggctacagagcaagactctgtctaaaaaataaatcaataaataaataaataaataaaaataagcctgggcaacatggcaaaatccagtctctacaaaaagatacaaaaaaaaagtagctgggcatggtggcacatgcctgtagtctcagctacttgggaggctgaggtgggaggatcacctgaccctcagaaatcgaggatgcagtgagccatgatcatgcttctgcattccagcccaggcgatagagtgagactgtgtcaaaaaaaaaaatttttttttattaaattgagccaaagcaccagacttaagttattgatttaatttcctgtctttggtaaaattctttgggagactttacaaaggaattactcagaagaagtttagatggtcacacatggctgaaaggtctcccaggaccacgcttttgcagctctttcatacctggtgttcactcttatggaagattcatttaaagatggattgtagttagggtgagtctagtttcttaggatttttggtgatgatctctgatattgaaaaagtggtatggttatcttagtccctggatcatccagatctttctaataagttgatgttctccaagtactataagaaaatcacccagcctgggcaacatgttagccaagaatggtggaaaatgcctgtaatcctagctagttgggagactgaagcaggaggatctcttgagcccaggagtacaaggcacagtgagctatgattttgccactgcactccaacctggacagcagagctaaaaccctgtccctaaaacaacaaaagcaatactgcctaatggatggagcctctgggaggtaaacagtgtgaattaggattagagttggatttgcaggctagatctgtcaagtctcctaaaaaccatcacctcctatgggtggtagaaagcggtggttatgtgaagttctgaactagacagaagggtcaatgtctttggatcaaaaggtttcttaggattctgcccgcctggcagactttcgtccttctcgttattattctagagcttctggaagctgaggtctactgagaagtcgtcccagaagcagaaagtgaaatccaaaacctgcctgtttgaagttggagtcgacacacccatctcaaagtgagaaaattagtctggcaggataaattgaacaagcatttatggcagacagatagatgcttggtgctgtgatggggcctataggtggaccgcaaagaaaagggtgcaatgggatcctttcctcttagagagctcacagtttatgtggcccattggcctgctggtgttctccaacatcaatgttctttcttccttaccctcatcctttttttcttccttcctatttcttgtttcctatctccctcttttttacctttactttctagcttcacagaagagatgcaataggcacagaagagatgcaaaaggcactgacttttgcctgaaccctgatatctctccacaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccaggttagttctctgccctctgagactcgtcgagtgcatgggggatcctcagcacacagatggagcccagaacggggatgggggcagcagtgtgggtgaaatagtcctgggccctaaggacctggaggctgcagctgagtgaagcctttccgcttctcacaaaaggagaatcaaagtgtcccaaaactcaggagtaggagcctcttctctgagggtaaacctgtttttgttgttgttgttgttgttgttgttgtttttccccccaataaggtccttacactgctgcaatttttttttaagacaagttcttgctctgtcacacaggctagcatgcagtggcacaatcttggctcactgcaacctcctcctcccaggttcaagcaattctcatacctcagcctcccgaaggctaggactacaggcacacgccaccacacccggctaatttttgtatttttagtagagatggggatttcaccttgttgaccaggctgttctcgaactcctgacctcaagtgatccacctgcctcagccttccaaagtgctaggattacaggcgtgagccaccatacccggccagcaatttttagacattgaaaacaaccataacatatggagggtggtgtggataagtgactctctacacttggtgttcctgtatgctgtagccatcccttcctgtgcaggggattttccacaggacagagctgtggaaattccctatagacacacactcacaattcattcaacaaatggtcaagaagcatatcgtatgttcaaaacactgttctaccaagggtaaatcattgaacaaattatattaagaactcttccctcaaaaagtgattagttagctaaccatatattctatcagatggtaatgaacatctataggaaacattaagcaaggaaggaataaagaggcaatgtgagacattgcaattcttaacagaatggtcagggaagacttcactgtaaagatgggaattgagccatcccatctgatggcaaggagtcatcagatgcttaaggactgaacaacccagctacaggaagagcatatgcaaagggcctggggaaggaacatctctggcagtttccaggacccccagaaggtgatgctggtgtggctgaaatggagtgagtgcaggaagtgaaaggagatgaattcacagaggcaatgaaaacacattaaacatggcattgtaagccacaaacagtctttggtttttagggcgagtgacgtggaaagcgttggaaggttttgagctaagaagtatcatgatcacactagggctggtctgttgaaaatagactacagaaggtaagggcagaataagaaggagggcaccgcagtattccaggcgtgagtgatggtagcttgaggcagggtggtggctgtgccgactcagcatgacgggttagctttattcatcctggtccttcccatggtgactggtttgctacctctgggccttggccctggaagccattgaggtgtcagccaggtgtgagccagcatcactttctccatctgagttttctgagggagaaagcaggagagcaggtggctgaggagctcttcaagtgtgctcctaggggcactcttaccccagatgttctgtttcaaactaagtggatatttctggctgccttttcagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaaggtaaaagaggctgagtatggtggctcatggcttgaatcccagcactgtgggaggctgaggcaggcagatcacttgagccctggagttcgagaccagcctgggcgataaagtgagaccctgtttaattaaaaaaaaaaagaaaagaaaaagagtagaaggacagttcaccaccatagaaaggacacagctctcccaggtaccagcatacagaagagagaggaaatgcacagcagcagcaaggacttggaactctcatgtccttggaatgaatctctcagagctttcattctttcactctgcccaccttgcattcattcatctggctacataaagtactaaatggttgagcaaaagcaagtgtaacaatgtgctggtactacccagccacctgatcatacataatttctggtttctgacagtgccctaggcatgagggaagggagatgttgctgttcatagaaaggacggttcctgcattgtttactaaaaacccaacttcttttagttcttctgtcaaagacatgattttctttgtttgtttttcagagaaacttcaagaagaattgcgtaagtttagcctttccttaactacatgtacaatttgagttctgctcagcaacatctcatgacattcgtctctgtctgtcccttgcaggatggagaagaacattcttacatgctggtgagtgcctctgatgttccctcagatctcagctttctccacactagccagctaacaggactccttagaggagatgagcaaggggcccagggcaaggtggggacagcagggaacgggggtcagttcatcaacagtgtcccagcaatgatgcatcatgtctcttctgtcagggaatcccagcagctctcaatccaccctatggtttacatcccaggatcctttatcttttggagtaatttaatgcatgattaccagaggtgtcccatatatagtagccttcctaagagttacatttcagtagttgttgttctttgatcctggatgaatttgaaaaaagacaatgctatcttagcagcttatatcctggggatggtgtagactgtgccaagttgaagacccatgtagggaagaggccaggagggtccctagtaagcctgacataagggtgtaccaataggtggccagaaatgcctttctgctcttaagagaacactaatactttgtgtatagcctgccgtgggagggatttcaggtgggtgggagagcacagaacccaattgcccactcccagtgagcacttttcatcttatgattcagcccctctgcccataagcaccacagaatccaagctttaccagataccatggcacatggacctttcctctttaggtgaatttcaaaattgccactgtcaacttgggacaaaatagcaaattgtcacagccagacatattaacttggggaatggaggaaatcattttaacacaatagaaaagtagactgaataagtaagaataaatacagatgggagaggtctgcagaatgcccggagtctggagcatttcttgtacctacagaagtgatatgtgaagacatcagacccatgttgttgaagcaaaactggatgggaatagttactccctacatttgcccacagacccctcaggcaacaggttttcttttggggacatttattctccttcttcattttttgaagggtgcccttgttagtcatttaagtcagttgtgatctggtaaaaggaacacataggaccaatgaagagaccctttatcctccaggacagtgtgaagggaaagactcaccttagttgatccaccggggagaggaggagcaggacataaagcctttgtgctggtttaagccaagttggaaagtttctaagtaaagaaaatcccagagatcataggtcttcatttggggttttgttttgttttgttttgagatgatgtcttgctctgtcacccaggctggagtgccatggcacaatctgggctcactgcaacctctgcctcccgggttcaagcaattctcgtgcctcagcctcctgagtagctgggattacaggtgtgcaccaccatgcccggctaatttttgtatttttagtagagatggggtttcaccatgttgtccaggctggtctcgaactcctgacctcaggtgatccacctgcctcagcctcccaaagttctgggattacaggcgtgagtcaccacgcctggccagagatcatatgtcttggatagaaaagggaacacatcttagaatgctgagagaaagtataagaatgattgattttacttcatttgctaaactttccggatttcttagagctccaattcttctcaaactgagagaactgcttctgtctctggagagacagaagtgcagcttcagtaattctcagtgtgtgagctgcctaggatcagagagccttcatggaagtggccactacgtggggatcccttcagagatatctgagacctctctggggatcaggaaccacacaatccccagggttcctgagaccccaggcctaaacctgagacttcctctgcagttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgg

SEQ ID NO: 1888 - DNA, 12945 bp, Homo sapiens; identical to SEQ ID NO: 1886

SEQ ID NO: 1889 - DNA, 12945 bp, Homo sapiens; identical to SEQ ID NO: 1886

SEQ ID NO: 1890 - DNA, 11715 bp, Homo sapiens; identical to SEQ ID NO: 1887

SEQ ID NO: 1891 - DNA, 13436 bp, Homo sapiens
cttggtgagtaggtgagtttattgggacttacacacaggtcaatcctgggcagcgacaggacagctctagagatctgtgcttcctcccaatgctaaactgctttcatgctaatcttctgactgtttacttaccggctaagagcgatgggactgttttcattggttggttctcagatactctctgggaagtttgggttctcagggacacctgctcctcagctggggattgtggccatggcctaccacctgcctctcagggttcaagcaggggacatgcaccctttagtaacctggaggggacccgtcacatgacaaccaccccaaccaccatcatgaagaagccactggctgactgtgatacacccccagaaggacaagggagagtggatgctggaaagacagagcgagagaccatcaccagggaaagactttattcttggaaggacatcaaacctgggggggggtcggtagtggagctgctgtttcttctcctgtatccaacagttctaactctggttttctccattttcagctctttcttttcctggccttctcattgctggttcctgcaagctccccctctattcttcgcccaatatattctttagtccaaagtaaactacttcttcccattccccacactctccagtcctctctcctcccttattgcaggctccagtgttcctgccttctccttggtgcacttgccatctgcattaacccctcccttgctgtgctcagctacacaaatgccaaagtcactaacactcagttccataagctttaccttgccctccttatccccctaataaaatgtctgcattttggccaggcgcggtggctcacgcctgtaatcccagcactttgggaggccgaggtgggcagatcacgaggtcaggagatggagaccatcgtggctaacacagtgaaaccccgtctccagtgaaaatacaaaaaaattagccgggcgtggtggcaggtgcctgtagtcccagctactcgggagactgaggccggagaatggtgtgaacccgggaggcggagtttgcagtgagccgagattgagccactgcactccatcctgggcgatagagcgagactccatctcaaaaaaaaaaaaaaaaaaaaaaaaaagtctgcattttgtcctggcctgtgcccggcatttctgccctggtggctgcactgctctggggtcattggtcttggcctggctgcagcatctcatggatcttggtgagaaagttgagcttcccctccagctcctgagcccgcttcttcagctcctcagctgactctgactttgccccctcaagcaagtgctttgactcatatgcaaggctgaccacatccagcagaagcaagatgcctccagtggctgcacccacgatcatggttcctctgctcattgcctgggcggggccttcaacaaccctctcaacctgttcaccgccttcagctgagattcgcccaatgatatgcgggggtggggcatacgctcctaactgagggttggctctggctcgtctgatggcacggatgttcctcccaatcccttgtgtgacttggtaccaattgtcaactaaggtaagaacattgggtgtgttcccacccacaaactccttcatcacctttgctacattggtgccgctttggtccaagttgcgggcttgggctcgtgcccgcaatttgtttactagttctaccacactgcaggtaatcccagccacagcagctgctgctcccagacccatgccagtgtccaagagcacaaaactgattccttctgtgaagggtgccagacccaggccgaggagggtcaggatgccagaggtagtgccaacagagttggacaccacattggcaatggtggtgcctctgtggacctgctcaacctcctctgcaagggcacggagcttccttatgtgatcctcaagctcccttttcaaccgaggaaactctttcaaaaaccactgcctgtgctgctggtctttatcgtggcggtttttgtccttcatgaccatgtgacttgcaagcttgttcagagctttacggagctcatctgcctcatccctgcacaaggaaaggttaaaggattaagaaatgcagtttccctatctgtgaaatgagctccatgcgatctctatcctgtgtaaattgcagagctttcactatcaatcaaatagaaacaaattttacaaatggaattaattatctttcaaactcaaacacattttgttcatcatagatattcctcagtacttattccatatggaaataaatatcttaaaggcacctcagatgctctttcatggtaggtgtttgataaagatgcctcctcactcaagggcaggtcaacaccgtgactgccaaagtgtttggagagggaaaactctgcagatgaacaaagagcagtgagagtgagacaaagagaccttattaccaggatggcaggaaagtgaagcatgaactttacccaaagagaggccttccctttgtcctcagctcctgggaagtgatctccaggcccctggaatgtcctgcctggtaggaacatctttctttgcctggtgatttggccacgggacagtatagcgatgtgatggatgatagggtttggggctatttggtgtctttcctgacttccagaggacttggggactaaaggtgtgagatctcagggaagggctggagactctagccatgagggcagcttgtgatccagccccagcagatactctggacactaaggcatgggttgagaaagaaggactttctccttgaccaactccagctgggctcttcagagcttcttctccactaggcgccgaccttggccttccacactcacccactgctttctggacttgcaccaccttggctcagcaagaatctccccaaatcagtttagggagggtcctccccgcttgctgtctgagcaccgtttgttatctgatcatgctcctcacccccaccactggtggttgagggtctgacctgcctttggcgagaatcctgttaggccagtttagcaggaaccccccactctggcgtctcctgtcagtcctgttccatctcccgcccccaccctggtgttggctgtgactccccctctgtctttactatatttggagctgggctcagtctccctcccctgtaacaacaatcctgaataaaggcttcatttctggtttaatgtgattcacaggaatttttccttaactgggtgagcttccctggttggcaacaccgcatgtgttttgtcccacattcacacaggagaacacagcctcctgaggacaatgaagattcacacctgaaatcctcccagactctgccctgtgtgtctcttccttaggctgattttaatctgtgttctttccctgtgataaaccacaatcgtgcaatagcagttttcagtgagttacgtgagtccttctagtgaattataaaatctaaggatgattttaggaatccccatagatttgcaggtggtgtcaaaggtaagggtgccctcagacattgcagtctggctatctctgagtactttgaattcaaacaaaaacaaaacctcagaaagacaggagatcactttgcctggcatctgctcccttccaatgcctcatgccctttcacctggctgaaggctactgggtgcggccactgccccagctgactggagtgggagatctggctattcattctggctccacatggacgctccagccaccttactgcctcctgacctaccacctgcacccccaaccttccaggtctcactcgcaggtgtcaccagcctaactgatgccttagcagtgacagcttcacctgtgtgcacagcaaggccatgtgcaattttatggaaccactagaagactcaagacactttcagaaccatctatataaattgctaatgctgaaaagacctgaatttggtcaagatggtagaggaagtgttttcctcctcggttgggactttgtgagtctgctcagtacccctgaaattacacaaattggcagcaactcattctactttggaaatggtcactaaggcatgccatggtaaggagcttctctgtgtagaagagaagaaggtctgaaagggtagtccagaactcaccagttccaaggcatggggtgagagacacaggctaccatgaccctgtatgcccatgagtgttgggatcatccagacagggaagaaatatccctctcccactcacatgtcctctgcaagttcatgacctccttaagtttcaagcccttggtgcctctctttccacaccctagtcccagccctggtgccccagccttcctgcttgtcctaccaaaccaaggctgactcttactccatcctgactccaggctctgacactggtcccggtctctctgggcctttgagcaggatcttagtccttggttccccacctttgacctggagttgcctctaaggccttcaccacactcctatgacattgaattgctattcctattggacagaagacagttccaagtctccatgacataagcccagagcccaggaactaggcctctcaggatcctggaccagcagaagggtcctgctgtgtttgtggaattcttcagatgagaaaaaaggccccagccagcatccccaggaacacatattgtttaggttaggatttttctgacttttcccaaaggaagtcctgctgggctcccatcttcaagaagaagatccttaaccctggtctctttccaccaagcttgtaagatgttaacgttaactgtgcacctactatgtgtcagtcattatgctaagcactttacatgcatgatctcatttttctcataataaaactccattgatgaagaaaggctgaaagtgagaaagtaactggcaaagttcccatcaccagcagatggcagaaatgaccctgttcctgtgggcttcctatcccctcagcctgaggctactcactgccagcgaaggacatggaggaaatattcctcctggagtgccgagaaggtcatcctcaagcccagcagagggggctgcctggaggaggtgtgcctgtcagggacaaccagcccaggggagatctgagtggcatcgctggggcgccccatggagttaaccccatggagcttacctgggcagttcagcagcagccacgaatccattccaggcttcatcatcagtcagcagttgtagcagattctctctgctcacttggtcctggaaatacttaaggtaatcctcaataaagatactgctctctagttggaaagaagaaaggataaggttggaggatagtgtaggggagcataacagccattgcacattaggtggttacatgttaatttttcctggacaactgtgatgtgggacatgtttgatggagtcatcagtgctatagagggattgtgtgcccccaaaattcatatgctgaagccctaaactcgagtgactatatttgaagattgggcctttaaggaagcaattaagactgaatgagatcacaagggtagggctctaatcctactagagggctagtgtcctattgtaagaagagaaagagaaacaataaggccaggtaagcacacagcgcaaaggcagctgccgcaagccagcaagagagtcctcccaaggctccaaccccttaatttaataaaccatcaaagacagaaaccccaaaccccactgggcccaactggctcttctgagtccacctgcacttccatccctgagcctgtgcttctgctttgcagctgatttgttttttctttgactcaaattttttctctcagtggagtcaaaaacctggacaaggctaaggtctggtctctcctggattcggagaacttcctaaacccaccagcaccaatgtgaccaggaattttccaaaaaggtaaatcaaaacaggcagttttgtaactgcaaccaatcaaataatgtccttattgcagtttcatatttactcgataaatacttgtctctgacactttttcatcataacatgaagcctcttccagtttggttttctcaattcatgaattccttcttattcaaataaatgttactgtgcctcagatttttctttgacaaggggtatctgagatcatgggaatgaggccctgcctgaggcagtcatccctggtcagcaggtgcttgtgatgggcagtgcagggcgggtgccctaacacagatgaggggactgggtggcttccacctggaatcaacaggggatagatagaggagatagaggggatgcaaactaattcttagggaggccctactgtgtggcaggctttggccaggccaggtacccttataatatttaatcttcgtgacaacatggggaaatattattttcatggtacacgagaggggaggtaaggagctccaggtcacacagaagggacttggaaaaggccagaccggggtccatttaagttggaagctgggtcaagcatgatacattcccatagggccactcagaacagaggggctggtgcagggcaagagctggagggaggggaccggcctgtgctggaaaaaaccctgggtcagcagggagaagagcggtagataagagatcagggctgcaggtcaacctcctctcccacccctcccctcctcctggaccctgctcttcccccactcccctctcttgcttgttccacttcctcatggctgtcctgccccacttgagtcatctgctgggtgacagggtagggaggaagtgggcacctgggccgtgtcaccccgaggagaggtcaggatgcagatgacccccagacccctgggtcgggggactccacgtgacctcttctgctgctcggggcagactcattggcctcctagtccatctgggttcttctggggctcactcagctgtggaggtgccaccctccattctaggtgcgagtaggaactagccaggaaagaggaagcgagcctacctgggttcatggtgccagcggctgggttaccgaggggctttccttggagctctccagtcactgtccagactggaaggttttccttaacccttgagaacgagaaaacaaattgtgggatcgaaggtgagcctcctgtgtacagagggaggctggaggggctgggtctttgcagatccctctgtggtagcagcaaatgtccagagtgtttatctcctggggccctgccagctagtatttacagaaactcacctcgttccagcttcctcttccctcactctcacaccaaggcagggtcctcttgtcctgtaggggtatgagaagaagataatcagaggaggggcagccatctgatcattacagaaactacagagtctatacacaggaatagagatgggagggaacattctgacaatgacctgggcctgggaacatgtatgataactagttgatgatagccagtgtgtattgtgtgtctgtgatgtgcatggcctctgacatgtatctcattcgatgatcacacacaggacaggagatgggtaccactttcccatttgaacacagaggaatccacaaaagttagggaacttatgggtgttttcacaatagtgctagagccaggacttctgcttcaatcccatgtcttcaattactgtgctctactcccttaaatatacaatattgagtcatgtatacacgctcatggtaaatgactcctcattgcaaatccctgtctcacactctgtgctcaactcttcgtcttggtgaactcactggtgctgcagtggacagcctgtgtccccgttgcttctctaagattctttgtcccacaaagacctggatcctgctagatgccggcccagcccctgctgtggctgccgagccctcctgatgcttccccgtcccctctgctgtcctcccctagctgatggaccttagggtgtttctaattcttcatataaattatgctacaaagaatatcctccctcacgtaaaactgctcacatttgagattatttccttaagatacttttaagagtagaatgactaggtcaaaagctattaacatctcaaaagtttttatacctagagccactctgtatgaaaactgtacaaattcacactcaaactaacaggatatgaagatgtccattctttcagtcttactggctctcagtagtcttttcttcaggaaaacaaaacaaaacaaaacattattccttgagacaaggtctcactcctagtatgcagcccaggctgctggcaaaatcctggccttaggggatcctcccaccctgccctctaaagtgctggattacaaacatgagccacgacacccggcctgaataaatgctgatctttatatagaggaaagttcttcacattctgctcctgattatcttaccctgggaggtgagggaaaatagcaaatgttaatcatattaatcatctttaggcactgttttaagaagacagaagagcatttatcaacctcccctcctgagatcaaactacagccatagtcaaggcacttacaggtataatggcacttaatgttaatgtgggcaaacattggtggattttgcaccactaattgctctaagatgttataaatagtaactcacagaactcttccaagaacctaggaagtgtgtaccattggtatttccattttcaggtaagaaaactgaaacagatgttcagtgacttgcccaagctcagaatctactacgtggtaaagactgggttcccacccagacagacggactcaagaactcacgcactgcctctgcaccctctgctgccaatgaaaatttaaatgagggcaacaggagatcagagatgccaagagatgttggaaaacagaactggctgaagaaatgacaactgaataaagaggggtgaagggagctgtgaaccacagcaatgccaagagggcatccagccaggcagagtggtctactaggcagagcctcagagaggggaggagttcaccaggcccacgtgccatatgggattcatgccagccttgagtctacaccagtgaaaaaaatcagagagttcatgactgaagcaatatgccccagaaataatatctttgtattctgacacttcagtgggttcccattcaatcaccctacagggaagactgccagtagacctgccccccaccccgttcaatatgaatagatctaggatcagaaattggagaaaggtgaaagtggggaaacagaccaagatgaccaaatacaaaaggagtccagaacaaacaagtaattttttaaatctcaaacccatgtcctcagggagattaaaaaatattttattcataaacttaaaacaagatatatagaaaagaagaaaaatcaatgaaacaaacaaaaaaagagattttctagaaactaaaaggtgatgatcaaataaacaagtctagagagaccatgtgaaagaaagtcacggaaatcctccagaaaataaaccaaaaagatgacagaggaaaaggagctatatggggaatagaaaagttaccaggcacagggtcacagggtgttctaagaaagctacttgagaatgagccaccgggaggaagaaagggtgggtgggtgggtgtgtgtgtgtgtgtgtgtgtgtgtgtgtgtatgtgttgtgcatccatggagggcaggtggggataaccaagaaagaaaaagacatgggatccagaaaacaggaaaatcaacccagagagaagggaatctgaggatcacagtgggacatgcagtaggcctacaaaacgaccagtccaggatggaataaaaagggaatggttctgtgggaaaaagggactcaatagaatacctcaaaggattcacagtttgagagaaactgaggaaatgaagaaggcaagcagtacaagggaggaaaaaaaacaaaggcaattagaaacatcaggaaaaagtaaagctgtgccacaaaacatgtgcaaacatggtgtacaactcagctccacagtaaatagtatttaaaacatcacaaaatgtaaacactcttgattgatttttaactttgagaacagaacagagcatataaatatgagaactaaatatacttgttaccgattagtacaaacttaaagcacaaaggtagcagttgggatgtgaagcactgaacgaaggagaaggaggattaatattgtcatcttttaaagaggggagtcaagaaatactaggtaaaactgagagtataagaaagaaagttgtaagtaaattgtttacagctacaaagttgctaatggaggacataaaactggtgatacaatattaggaaaaggtggagaggagagatagagggagtgtacaaacaagatgaaaatgactaataatgacactataagtaataatgataataccgattcaggcccatcccagttaggggcggctccaaaatcaccattgttcttttctcaccttgtgtctctgcgcactccccggcacacccacttccagcagctggtctttgtttgcagactttattttaacagctcagtggttcccgggcatcctccagctcttatacaaaagccccctcctcaaaagccactcgcctccctctttccacttcccacctctgtttcagggtcgaggcatccagatatctgtcttctggggcccctacgcagcaagactaaaagggggacccagtcctgggcagcagttcaccaggggagtatgcagaggggcatctggacacttcttgctgtaagggacggggtgacgggagggggtcttcccttccccttcttcctgctttgttcactctgtgacaccctaggccaggggagctgtctcaacgccatctcatgagccatgagaaccaggaggaccaggagggagaagaggagcaggagggcagacagagctggggcctcggacctgcccaatacttgtgaggagctgcatccaggatcccatcctcctgggtcattgttggcctggctcccacctttgtctggagcctctgctgggggttgaggctggatactgcccctcaggcttgactaggacacagtgtgtactccatgggtgagcctgcaggctggtcaattccggtgtccaactgagcgacctggaagaggagccctccctcccacctcagctctgagccaagctctccagatgcagaggacagggactctcagcaaagcatctccctccaagtggttgtggggcatcctccttgggcagggaaagaggagtcgaaatgatttcctgagaaatcgtcattttcattttatttttgagaaactgtcttgctctgtcacccagtctggagtgctttggggctatcacagcttgctgtagcctagagcccctgggctcaagtgatccttctgcctcagccttccaggtagctgggactacaggcacacggcaccatgcaggactaatttgttaatttttcatttcagagagacagcatctcctgtgttgcccaagctgtcttgagctcctagcatcatgtgattctcccgcctctgcctcccacagcactgaattacaggcctcagccgtggcactgcacccttctgaggaatcttcagtgaaaagccacggtcaagttcaaaccccatagcagggcacacaggccctctgatgctctggaccccaccttcctcaccgctccctgccaccacagtcaccttaggtccaggcacccactgacgccctgcttcggtgcctcctggagcccatctactcctcccactcccatccccagcctcaggccttcactcagctgctccctcgccctggaatgtcccccccactgtccccaccatgtgcaagtcacctgtcctcagagacccacccaaagctgcctggtccatgcggcggcccccaaccctccccaggctccctgagcactctgctttccagagggagctctacctgtatgtggctctttgggcctctgtctcccctttagactctgaacattcaatggggacactgttgtgttcccagctgcaccccctacgactgacctggatgccctccgccctccctggcacagcctggctgaaatcccaggtgcaggaggcattacttgaactaaaagcaaccagcctctggatgacatggcccagcttcagtttcactttcagttgagaaattgaatttaatttttctttctatcttgatgggcatctctttttggtgaagaacaaataagaccatgactcatatttcacagaaattacccccctgatttcatggacttttggcagctctatcaagttttttagaggggaaaaatcttaggctgggaggggaggtgacttgcccagagtcacacagctcttggagggcagaggggaggccaacatctgcccttgtgactctgatattgaagcaaaaatgggtgattttaataatccaacagtgtccaggtttgattctgcttctacaaacacagagacctaagctctcactcctgtagttatactcacaattccacagtgtggcttttgaatctcatgattgcaaagctggcatcatgccacaggtaccattctgcaatgcgaccttctcactcccctgtctcagccatgtttcccattagggacacagcacagcctgtttcttctctatcagctcagaggtctgaacagagggacagaggtgagggccagagacgtgaagtcctatgatctgcctgctcagcctcctgacacgggaccctggcaagtcattcccctcccagggcctcagtttccccacagggcctggcacaagtaggtgctcagactcagggtgagtgagacaacctctgagttccttgtgtctcaaaagaaatctgttgttcccattgggcttcagcagcagcaccctggggccagcctgggtgtggcccggccacaaggacatgccgggctccaggtcacctcccctcctccaccttctttgattccttcaaatttcccaaagagatgggcacccccaacacctacctttcttctggggtcagctggccgtgtctgagggtgtcagaaccagagctgagcccggggagctttgtgaacccatctaagctgttttccccacctctctctacagtttacccgcccagcaggagggagggagcaatcagactcaagcctgggtgcaaatcccggctctgccactgctttcctgtctgatctgaaccagctacctaacctctctgagcttatctacaaaagctgaatgatccttcccttatagagctattgcaagaataaggacatgggggtagatcacactatccccaacttaccaagggatcttcctctgacagagactgagcaagatccaactgttctgagctgtgtggatcccacgtccagctgtgcatctgtgtaataaccagacacgtcctccggcctcccagatataccctggaattcgaaagggaaagtgaaagtcacaacttcccagcagctcatgaccaagcacagtaaacacgctgctccccagcac

SEQ ID NO: 1892 - DNA, 13747 bp, Homo sapiens
cttggtgagtaggtgagtttattgggacttacacacaggtcaatcctgggcagcgacaggacagctctagagatctgtgcttcctcccaatgctaaactgctttcatgctaatcttctgactgtttacttaccggctaagagcgatgggactgttttcattggttggttctcagatactctctgggaagtttgggttctcagggacacctgctcctcagctggggattgtggccatggcctaccacctgcctctcagggttcaagcaggggacatgcaccctttagtaacctggaggggacccgtcacatgacaaccaccccaaccaccatcatgaagaagccactggctgactgtgatacacccccagaaggacaagggagagtggatgctggaaagacagagcgagagaccatcaccagggaaagactttattcttggaaggacatcaaacctgggggggggtcggtagtggagctgctgtttcttctcctgtatccaacagttctaactctggttttctccattttcagctctttcttttcctggccttctcattgctggttcctgcaagctccccctctattcttcgcccaatatattctttagtccaaagtaaactacttcttcccattccccacactctccagtcctctctcctcccttattgcaggctccagtgttcctgccttctccttggtgcacttgccatctgcattaacccctcccttgctgtgctcagctacacaaatgccaaagtcactaacactcagttccataagctttaccttgccctccttatccccctaataaaatgtctgcattttggccaggcgcggtggctcacgcctgtaatcccagcactttgggaggccgaggtgggcagatcacgaggtcaggagatggagaccatcgtggctaacacagtgaaaccccgtctccagtgaaaatacaaaaaaattagccgggcgtggtggcaggtgcctgtagtcccagctactcgggagactgaggccggagaatggtgtgaacccgggaggcggagtttgcagtgagccgagattgagccactgcactccatcctgggcgatagagcgagactccatctcaaaaaaaaaaaaaaaaaaaaaaaaaagtctgcattttgtcctggcctgtgcccggcatttctgccctggtggctgcactgctctggggtcattggtcttggcctggctgcagcatctcatggatcttggtgagaaagttgagcttcccctccagctcctgagcccgcttcttcagctcctcagctgactctgactttgccccctcaagcaagtgctttgactcatatgcaaggctgaccacatccagcagaagcaagatgcctccagtggctgcacccacgatcatggttcctctgctcattgcctgggcggggccttcaacaaccctctcaacctgttcaccgccttcagctgagattcgcccaatgatatgcgggggtggggcatacgctcctaactgagggttggctctggctcgtctgatggcacggatgttcctcccaatcccttgtgtgacttggtaccaattgtcaactaaggtaagaacattgggtgtgttcccacccacaaactccttcatcacctttgctacattggtgccgctttggtccaagttgcgggcttgggctcgtgcccgcaatttgtttactagttctaccacactgcaggtaatcccagccacagcagctgctgctcccagacccatgccagtgtccaagagcacaaaactgattccttctgtgaagggtgccagacccaggccgaggagggtcaggatgccagaggtagtgccaacagagttggacaccacattggcaatggtggtgcctctgtggacctgctcaacctcctctgcaagggcacggagcttccttatgtgatcctcaagctcccttttcaaccgaggaaactctttcaaaaaccactgcctgtgctgctggtctttatcgtggcggtttttgtccttcatgaccatgtgacttgcaagcttgttcagagctttacggagctcatctgcctcatccctgcacaaggaaaggttaaaggattaagaaatgcagtttccctatctgtgaaatgagctccatgcgatctctatcctgtgtaaattgcagagctttcactatcaatcaaatagaaacaaattttacaaatggaattaattatctttcaaactcaaacacattttgttcatcatagatattcctcagtacttattccatatggaaataaatatcttaaaggcacctcagatgctctttcatggtaggtgtttgataaagatgcctcctcactcaagggcaggtcaacaccgtgactgccaaagtgtttggagagggaaaactctgcagatgaacaaagagcagtgagagtgagacaaagagaccttattaccaggatggcaggaaagtgaagcatgaactttacccaaagagaggccttccctttgtcctcagctcctgggaagtgatctccaggcccctggaatgtcctgcctggtaggaacatctttctttgcctggtgatttggccacgggacagtatagcgatgtgatggatgatagggtttggggctatttggtgtctttcctgacttccagaggacttggggactaaaggtgtgagatctcagggaagggctggagactctagccatgagggcagcttgtgatccagccccagcagatactctggacactaaggcatgggttgagaaagaaggactttctccttgaccaactccagctgggctcttcagagcttcttctccactaggcgccgaccttggccttccacactcacccactgctttctggacttgcaccaccttggctcagcaagaatctccccaaatcagtttagggagggtcctccccgcttgctgtctgagcaccgtttgttatctgatcatgctcctcacccccaccactggtggttgagggtctgacctgcctttggcgagaatcctgttaggccagtttagcaggaaccccccactctggcgtctcctgtcagtcctgttccatctcccgcccccaccctggtgttggctgtgactccccctctgtctttactatatttggagctgggctcagtctccctcccctgtaacaacaatcctgaataaaggcttcatttctggtttaatgtgattcacaggaatttttccttaactgggtgagcttccctggttggcaacaccgcatgtgttttgtcccacattcacacaggagaacacagcctcctgaggacaatgaagattcacacctgaaatcctcccagactctgccctgtgtgtctcttccttaggctgattttaatctgtgttctttccctgtgataaaccacaatcgtgcaatagcagttttcagtgagttacgtgagtccttctagtgaattataaaatctaaggatgattttaggaatccccatagatttgcaggtggtgtcaaaggtaagggtgccctcagacattgcagtctggctatctctgagtactttgaattcaaacaaaaacaaaacctcagaaagacaggagatcactttgcctggcatctgctcccttccaatgcctcatgccctttcacctggctgaaggctactgggtgcggccactgccccagctgactggagtgggagatctggctattcattctggctccacatggacgctccagccaccttactgcctcctgacctaccacctgcacccccaaccttccaggtctcactcgcaggtgtcaccagcctaactgatgccttagcagtgacagcttcacctgtgtgcacagcaaggccatgtgcaattttatggaaccactagaagactcaagacactttcagaaccatctatataaattgctaatgctgaaaagacctgaatttggtcaagatggtagaggaagtgttttcctcctcggttgggactttgtgagtctgctcagtacccctgaaattacacaaattggcagcaactcattctactttggaaatggtcactaaggcatgccatggtaaggagcttctctgtgtagaagagaagaaggtctgaaagggtagtccagaactcaccagttccaaggcatggggtgagagacacaggctaccatgaccctgtatgcccatgagtgttgggatcatccagacagggaagaaatatccctctcccactcacatgtcctctgcaagttcatgacctccttaagtttcaagcccttggtgcctctctttccacaccctagtcccagccctggtgccccagccttcctgcttgtcctaccaaaccaaggctgactcttactccatcctgactccaggctctgacactggtcccggtctctctgggcctttgagcaggatcttagtccttggttccccacctttgacctggagttgcctctaaggccttcaccacactcctatgacattgaattgctattcctattggacagaagacagttccaagtctccatgacataagcccagagcccaggaactaggcctctcaggatcctggaccagcagaagggtcctgctgtgtttgtggaattcttcagatgagaaaaaaggccccagccagcatccccaggaacacatattgtttaggttaggatttttctgacttttcccaaaggaagtcctgctgggctcccatcttcaagaagaagatccttaaccctggtctctttccaccaagcttgtaagatgttaacgttaactgtgcacctactatgtgtcagtcattatgctaagcactttacatgcatgatctcatttttctcataataaaactccattgatgaagaaaggctgaaagtgagaaagtaactggcaaagttcccatcaccagcagatggcagaaatgaccctgttcctgtgggcttcctatcccctcagcctgaggctactcactgccagcgaaggacatggaggaaatattcctcctggagtgccgagaaggtcatcctcaagcccagcagagggggctgcctggaggaggtgtgcctgtcagggacaaccagcccaggggagatctgagtggcatcgctggggcgccccatggagttaaccccatggagcttacctgggcagttcagcagcagccacgaatccattccaggcttcatcatcagtcagcagttgtagcagattctctctgctcacttggtcctggaaatacttaaggtaatcctcaataaagatactgctctctagttggaaagaagaaaggataaggttggaggatagtgtaggggagcataacagccattgcacattaggtggttacatgttaatttttcctggacaactgtgatgtgggacatgtttgatggagtcatcagtgctatagagggattgtgtgcccccaaaattcatatgctgaagccctaaactcgagtgactatatttgaagattgggcctttaaggaagcaattaagactgaatgagatcacaagggtagggctctaatcctactagagggctagtgtcctattgtaagaagagaaagagaaacaataaggccaggtaagcacacagcgcaaaggcagctgccgcaagccagcaagagagtcctcccaaggctccaaccccttaatttaataaaccatcaaagacagaaaccccaaaccccactgggcccaactggctcttctgagtccacctgcacttccatccctgagcctgtgcttctgctttgcagctgatttgttttttctttgactcaaattttttctctcagtggagtcaaaaacctggacaaggctaaggtctggtctctcctggattcggagaacttcctaaacccaccagcaccaatgtgaccaggaattttccaaaaaggtaaatcaaaacaggcagttttgtaactgcaaccaatcaaataatgtccttattgcagtttcatatttactcgataaatacttgtctctgacactttttcatcataacatgaagcctcttccagtttggttttctcaattcatgaattccttcttattcaaataaatgttactgtgcctcagatttttctttgacaaggggtatctgagatcatgggaatgaggccctgcctgaggcagtcatccctggtcagcaggtgcttgtgatgggcagtgcagggcgggtgccctaacacagatgaggggactgggtggcttccacctggaatcaacaggggatagatagaggagatagaggggatgcaaactaattcttagggaggccctactgtgtggcaggctttggccaggccaggtacccttataatatttaatcttcgtgacaacatggggaaatattattttcatggtacacgagaggggaggtaaggagctccaggtcacacagaagggacttggaaaaggccagaccggggtccatttaagttggaagctgggtcaagcatgatacattcccatagggccactcagaacagaggggctggtgcagggcaagagctggagggaggggaccggcctgtgctggaaaaaaccctgggtcagcagggagaagagcggtagataagagatcagggctgcaggtcaacctcctctcccacccctcccctcctcctggaccctgctcttcccccactcccctctcttgcttgttccacttcctcatggctgtcctgccccacttgagtcatctgctgggtgacagggtagggaggaagtgggcacctgggccgtgtcaccccgaggagaggtcaggatgcagatgacccccagacccctgggtcgggggactccacgtgacctcttctgctgctcggggcagactcattggcctcctagtccatctgggttcttctggggctcactcagctgtggaggtgccaccctccattctaggtgcgagtaggaactagccaggaaagaggaagcgagcctacctgggttcatggtgccagcggctgggttaccgaggggctttccttggagctctccagtcactgtccagactggaaggttttccttaacccttgagaacgagaaaacaaattgtgggatcgaaggtgagcctcctgtgtacagagggaggctggaggggctgggtctttgcagatccctctgtggtagcagcaaatgtccagagtgtttatctcctggggccctgccagctagtatttacagaaactcacctcgttccagcttcctcttccctcactctcacaccaaggcagggtcctcttgtcctgtaggggtatgagaagaagataatcagaggaggggcagccatctgatcattacagaaactacagagtctatacacaggaatagagatgggagggaacattctgacaatgacctgggcctgggaacatgtatgataactagttgatgatagccagtgtgtattgtgtgtctgtgatgtgcatggcctctgacatgtatctcattcgatgatcacacacaggacaggagatgggtaccactttcccatttgaacacagaggaatccacaaaagttagggaacttatgggtgttttcacaatagtgctagagccaggacttctgcttcaatcccatgtcttcaattactgtgctctactcccttaaatatacaatattgagtcatgtatacacgctcatggtaaatgactcctcattgcaaatccctgtctcacactctgtgctcaactcttcgtcttggtgaactcactggtgctgcagtggacagcctgtgtccccgttgcttctctaagattctttgtcccacaaagacctggatcctgctagatgccggcccagcccctgctgtggctgccgagccctcctgatgcttccccgtcccctctgctgtcctcccctagctgatggaccttagggtgtttctaattcttcatataaattatgctacaaagaatatcctccctcacgtaaaactgctcacatttgagattatttccttaagatacttttaagagtagaatgactaggtcaaaagctattaacatctcaaaagtttttatacctagagccactctgtatgaaaactgtacaaattcacactcaaactaacaggatatgaagatgtccattctttcagtcttactggctctcagtagtcttttcttcaggaaaacaaaacaaaacaaaacattattccttgagacaaggtctcactcctagtatgcagcccaggctgctggcaaaatcctggccttaggggatcctcccaccctgccctctaaagtgctggattacaaacatgagccacgacacccggcctgaataaatgctgatctttatatagaggaaagttcttcacattctgctcctgattatcttaccctgggaggtgagggaaaatagcaaatgttaatcatattaatcatctttaggcactgttttaagaagacagaagagcatttatcaacctcccctcctgagatcaaactacagccatagtcaaggcacttacaggtataatggcacttaatgttaatgtgggcaaacattggtggattttgcaccactaattgctctaagatgttataaatagtaactcacagaactcttccaagaacctaggaagtgtgtaccattggtatttccattttcaggtaagaaaactgaaacagatgttcagtgacttgcccaagctcagaatctactacgtggtaaagactgggttcccacccagacagacggactcaagaactcacgcactgcctctgcaccctctgctgccaatgaaaatttaaatgagggcaacaggagatcagagatgccaagagatgttggaaaacagaactggctgaagaaatgacaactgaataaagaggggtgaagggagctgtgaaccacagcaatgccaagagggcatccagccaggcagagtggtctactaggcagagcctcagagaggggaggagttcaccaggcccacgtgccatatgggattcatgccagccttgagtctacaccagtgaaaaaaatcagagagttcatgactgaagcaatatgccccagaaataatatctttgtattctgacacttcagtgggttcccattcaatcaccctacagggaagactgccagtagacctgccccccaccccgttcaatatgaatagatctaggatcagaaattggagaaaggtgaaagtggggaaacagaccaagatgaccaaatacaaaaggagtccagaacaaacaagtaattttttaaatctcaaacccatgtcctcagggagattaaaaaatattttattcataaacttaaaacaagatatatagaaaagaagaaaaatcaatgaaacaaacaaaaaaagagattttctagaaactaaaaggtgatgatcaaataaacaagtctagagagaccatgtgaaagaaagtcacggaaatcctccagaaaataaaccaaaaagatgacagaggaaaaggagctatatggggaatagaaaagttaccaggcacagggtcacagggtgttctaagaaagctacttgagaatgagccaccgggaggaagaaagggtgggtgggtgggtgtgtgtgtgtgtgtgtgtgtgtgtgtgtgtatgtgttgtgcatccatggagggcaggtggggataaccaagaaagaaaaagacatgggatccagaaaacaggaaaatcaacccagagagaagggaatctgaggatcacagtgggacatgcagtaggcctacaaaacgaccagtccaggatggaataaaaagggaatggttctgtgggaaaaagggactcaatagaatacctcaaaggattcacagtttgagagaaactgaggaaatgaagaaggcaagcagtacaagggaggaaaaaaaacaaaggcaattagaaacatcaggaaaaagtaaagctgtgccacaaaacatgtgcaaacatggtgtacaactcagctccacagtaaatagtatttaaaacatcacaaaatgtaaacactcttgattgatttttaactttgagaacagaacagagcatataaatatgagaactaaatatacttgttaccgattagtacaaacttaaagcacaaaggtagcagttgggatgtgaagcactgaacgaaggagaaggaggattaatattgtcatcttttaaagaggggagtcaagaaatactaggtaaaactgagagtataagaaagaaagttgtaagtaaattgtttacagctacaaagttgctaatggaggacataaaactggtgatacaatattaggaaaaggtggagaggagagatagagggagtgtacaaacaagatgaaaatgactaataatgacactataagtaataatgataataccgattcaggcccatcccagttaggggcggctccaaaatcaccattgttcttttctcaccttgtgtctctgcgcactccccggcacacccacttccagcagctggtctttgtttgcagactttattttaacagctcagtggttcccgggcatcctccagctcttatacaaaagccccctcctcaaaagccactcgcctccctctttccacttcccacctctgtttcagggtcgaggcatccagatatctgtcttctggggcccctacgcagcaagactaaaagggggacccagtcctgggcagcagttcaccaggggagtatgcagaggggcatctggacacttcttgctgtaagggacggggtgacgggagggggtcttcccttccccttcttcctgctttgttcactctgtgacaccctaggccaggggagctgtctcaacgccatctcatgagccatgagaaccaggaggaccaggagggagaagaggagcaggagggcagacagagctggggcctcggacctgcccaatacttgtgaggagctgcatccaggatcccatcctcctgggtcattgttggcctggctcccacctttgtctggagcctctgctgggggttgaggctggatactgcccctcaggcttgactaggacacagtgtgtactccatgggtgagcctgcaggctggtcaattccggtgtccaactgagcgacctggaagaggagccctccctcccacctcagctctgagccaagctctccagatgcagaggacagggactctcagcaaagcatctccctccaagtggttgtggggcatcctccttgggcagggaaagaggagtcgaaatgatttcctgagaaatcgtcattttcattttatttttgagaaactgtcttgctctgtcacccagtctggagtgctttggggctatcacagcttgctgtagcctagagcccctgggctcaagtgatccttctgcctcagccttccaggtagctgggactacaggcacacggcaccatgcaggactaatttgttaatttttcatttcagagagacagcatctcctgtgttgcccaagctgtcttgagctcctagcatcatgtgattctcccgcctctgcctcccacagcactgaattacaggcctcagccgtggcactgcacccttctgaggaatcttcagtgaaaagccacggtcaagttcaaaccccatagcagggcacacaggccctctgatgctctggaccccaccttcctcaccgctccctgccaccacagtcaccttaggtccaggcacccactgacgccctgcttcggtgcctcctggagcccatctactcctcccactcccatccccagcctcaggccttcactcagctgctccctcgccctggaatgtcccccccactgtccccaccatgtgcaagtcacctgtcctcagagacccacccaaagctgcctggtccatgcggcggcccccaaccctccccaggctccctgagcactctgctttccagagggagctctacctgtatgtggctctttgggcctctgtctcccctttagactctgaacattcaatggggacactgttgtgttcccagctgcaccccctacgactgacctggatgccctccgccctccctggcacagcctggctgaaatcccaggtgcaggaggcattacttgaactaaaagcaaccagcctctggatgacatggcccagcttcagtttcactttcagttgagaaattgaatttaatttttctttctatcttgatgggcatctctttttggtgaagaacaaataagaccatgactcatatttcacagaaattacccccctgatttcatggacttttggcagctctatcaagttttttagaggggaaaaatcttaggctgggaggggaggtgacttgcccagagtcacacagctcttggagggcagaggggaggccaacatctgcccttgtgactctgatattgaagcaaaaatgggtgattttaataatccaacagtgtccaggtttgattctgcttctacaaacacagagacctaagctctcactcctgtagttatactcacaattccacagtgtggcttttgaatctcatgattgcaaagctggcatcatgccacaggtaccattctgcaatgcgaccttctcactcccctgtctcagccatgtttcccattagggacacagcacagcctgtttcttctctatcagctcagaggtctgaacagagggacagaggtgagggccagagacgtgaagtcctatgatctgcctgctcagcctcctgacacgggaccctggcaagtcattcccctcccagggcctcagtttccccacagggcctggcacaagtaggtgctcagactcagggtgagtgagacaacctctgagttccttgtgtctcaaaagaaatctgttgttcccattgggcttcagcagcagcaccctggggccagcctgggtgtggcccggccacaaggacatgccgggctccaggtcacctcccctcctccaccttctttgattccttcaaatttcccaaagagatgggcacccccaacacctacctttcttctggggtcagctggccgtgtctgagggtgtcagaaccagagctgagcccggggagctttgtgaacccatctaagctgttttccccacctctctctacagtttacccgcccagcaggagggagggagcaatcagactcaagcctgggtgcaaatcccggctctgccactgctttcctgtctgatctgaaccagctacctaacctctctgagcttatctacaaaagctgaatgatccttcccttatagagctattgcaagaataaggacatgggggtagatcacactatccccaacttaccaagggatcttcctctgacagagactgagcaagatccaactgttctgagctgtgtggatcccacgtccagctgtgcatctgtgtaataaccagacacgtcctccggcctcccagatataccctggaattcgaaagggaaagtgaaagtcacaacttcccagcagctcatgaccaagcacagtaaacacgctgctccccagcaccacctgcagtccaggcccagcctccttgctgctgcacttagaggagcagccgcagaccagacatccgggtccctctcatccaacccacctgcctcacatcctcaggattcaaggtctgctgtgtcagctgcccatgtctcaggcagtcagaaccagagttgagcctggggagttttttgaacccatctgagccgcttgccccccaacccccgccccgatctctgcagtttaagggcacagcaggtgggggagagaagtcagactcaagcctcagtgcaattccaggctctgcccctgttttactgtctgat

SEQ ID NO: 1893 - DNA, 123951 bp, Homo sapiens
tttgtttgaaaaggacccattcatttattcttccaacacatctgtattataaaactactatccataaggcactgtgttaggtgctgtgttcctgaccctacagatcccattccaccatagcaaaaggtaaaagtgactctacagtgagcttggtagacatagacccatgcttatatactcagggacacctggaagagatataaaaacagaaacatctcacataggaagttttcaatgcatcgtgatcaggactcaaataatccccttctctttttcttcagtgtactaaagggagcacattgttgagaaggaccggttgcaaatttccaaaaaggagagtaaaataattaatgagtcaaggtctcaggagagacagaaggtaaggggagtccttcagtaagtggggaaattgatttgttttgtgtcctcatctctccagggccatgagcatgtcctttgctggccataagtcaatgctgatgacctcagttatagtgtaatcttcaaggctaatttacgcaaaacttcagaaatggtaaacatcctcatgaagactaatgatgacatattttaggagtgcataatagtaggtatagagaaaaaactgcagggtaaaatgttattgctgttcttattgctaaagggcatactccttaagaaccaaagttaattatcagtcctttgacctaagaggaaaacaaatttcagggactcccctaaagattcctatgtagtacaaataaaatgccaaaatattttggaacacattttggagcactggataggtcaataaaataatgtgtaaattgccaaatgtgatctaggaactccctgcaaacatcagattaggctctattctctatctgaatactgactttgctttgctttgtaactcctatcttcactaataatgccttttcccccctcttgtgtgcatcctagcctatattctctttcatcattctacagtggtcaatgtggttattgtacagcttcactttcaatgaaagctgagggaaaagaagcctcataccctgccccccacccgcccccgccaatacgtaaaagaagccatttaaaaaataaaagcagcaagctactaaatttgactcattcaaatcttggcaattagcatgtatagtatgttatgagagagagagagagaaaattagcagaaatggaggaaaacatattacatcctaaataccaccaaattgccaaaatacacatttgggtagtaatctccagagaactctctggaggcacagcatctatcatgctgatttccctgaacaatattacagaatagccctgtgtactttctcttggggggggaggtgtaaagaattatcatatggaacctcacaagtctctaaaacctttctgcaattatccctcataggattaccacactgatgagtttgttcaacaggcgctgttgtgacttcctaatttaactcctatagagatgatttgtgtggaagataaaacactatatttgaactcaattcccaccttatccctgagcttatgctaccaagcaattcttacaatgtttggagttctattagactacagagaagaatctagggtttcagctaaaccctttaatccacaggcctaggtaaaggactgtctcaaggtagtcgctagcccatgggttctcaaagtatggtctgaagacccctggaggagtccctgagacccttttcgtgggtctgcagattaaaaattattttgtataataacaccaagatgagttacattcaattaggcatttttcttttgaaattaagcagacttttggaaactaagatgtgcatagccctgtagtaggctaagtggaagttacaaaggcagtagtagctttttttccccctctcgttatctcatgaggatacagaggacttttccagaggctacatgacatatggttatgtcatctctctcatagctgagggatgtgtgcttctgtgttcttcttgagctttaaatatttctcagtcttaatacctaaaataattagtatcaatagatagaacccacacccaagaactccttggggccttcaataacttttaagagtgttaaggtgtcctaagaccaaacattttgcaaattgttgctttatcaggatttttgttatttctagaatgcatttctttctaactgatctacttgggaaaaaaatcgttacctcatggcaattattgctttcctatcaatatggagattatatttctgaaggagactgaccaaaattatattaaaaggtttaaatcaaacaagtggatccatgttataacatgaggaagagagctgccccactagatgtctgacattagataactcagagtcccgcctctccaacaagtctcccttactagagaaacggacagattctgttttgtgggatgggataaggagacaatctgaagtagagtttgacacaatattattctgcccatatgaaattctggtagccagggtgccaggtgtattcataatccagatgctgtcaattttaagcctgaagccccaagaggcgagcagtgtttaatacatcatctcttgttaaatagcagccacacagttggcggtagccagtgaagcattccctgccatgtaggacacgccagttgtctataaataggacctgtgaatgggccaaaaaaaaaaaaaaaagagagagaaaacactgtcagaagaaggacagaccaaaggaaccctaagtcagaagagatcatttaaaagataacctttaggttgttttctggttgcattaaatgagatatttttcttttgaaattaaacaaacttttggaaactaagatgtgtatagccctgtagtaggctaaatggaagttacagaggcaacagtaggtaatgggccctgcactggaggagcttctgtttctcaagtaattgttctcttatcaaagtaaatcagataattggtttgtttctttttctttttctttaattcttattctaccctttctcaaagggttaaattatctcatgacattttatgctaagctgaaggtatttttcatccagaggaaataccaaaaataaaaactatggaatcatgaagctggaaggacccttgggggtcatctagttaaaccccttcatcatacaaatagagtcactgatgccttagagatgggatgaggcttgcttccagagcattcagtgagtgggcggcaggaccataaacaaaaccaaggactcttttctctttttcctttgcaacatcgtgactcacatattaagtaagtacccgttcttcactgcttcagtattacaagcttgcttgacatctttagagattaggacccaccctgccaggctttagtttgacccaaaactcattctcaggtctcctcaactctatcgttagagtccggtgtgctgtataccagcgatggacgacatcataaggaacggtattgatgacagcccggtcatagttgttgtacctaacatggaatcatgagaagaaagatctcaaacacatgttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggcccc

SEQ ID NO: 1894 - DNA, 120428 bp, Homo sapiens
gttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggcccc

SEQ ID NO: 1895 - DNA, 9199 bp, Homo sapiens
aatacttagggaaatcttgggacactgtggaagcccagagaatctgatcccgggtcccacaacttcacatatcgcgagtaagtgggaggcaaagaaaattctttttctcctcttttgggacagtttgtgactagtagtgcctgtgcccctggaaaggttggagacttgggggacgactggagaattgccatttgaggaccaaaggagaaaagaaactacacgctaattctagaaggtaggaaagggagggtaggcgctacagctccggggtgaaggcggtcgatggaagtagcgggatccgctgtggacttgagagggggttctgggagagggaaagcccaccggtggggcggcgcctcctcgcctggctttacctccggtggcccggcgtggatcgcggggaggaggaagtgaagggaggagggtgtgatagaatccagcgacaactgaagaaaccggactctggccagagaagtgagccgaggagggcggaaaaaggcccccttgatcttggcattgatggcttacttcatggaatgtttaaggaatccctctctcaggagatacctgagccttcggatgcaggggactctctgaagttggggcactgatgagacctacttgagtgacgggagaggttgggcccgaccagcactgaggtgccaagactcctaggctgattctcctctgtaaccctaggcctcctgtccctgcctgctctgggtgctcatggaaccagctgctgccctgcacttctcccggccagcctccctcctcctcctcctcagcctgtgtgcactggtctcaggtagggatgtgtgccacttgctgctgtcacctatcagaaaggatcatcaaccctgtagtctgcaaaggcaaagaaagaaggactgtggagttgttgacttatcctttcattctgaacatgttcactgaatttataccagcactgtccaaaagaaacacagtgaggcacaaaggccaagtgcatgtacaattgcaaattttccaaaaaaattaaattttactttttatttaagaaagtaaaaagaaacatgaaataaatgtgtgtactatattttgtttcaccccaaataaccaaatatgaatatataaatgcttagtcaacattttgaaattttaaatcttcataatcctgtgcgtattttacacttacagttcatttcagttggaactagctagtgggtaggtgccctattgcacggctcaagtttacactacactcaggcacagcgctagattggggaatggaggaaattctcctcatggggcacagggtggacagagggtgctcagggagggctccccagggtttccttcatgaaccagaagcagatttcatagttactgctcccaggggtgctgttgactagccacagctactggtccccagaattctcagcccaaggagaccctatggccgtggaaagaatatgtttgtccctggaatacctgcttcctttcctgccttagagatgtgatggctggtgtctttgtctgattctgcccctttgttgaacagcccaggtcactgtcgtggggcccactgatcccatcctggccatggtgggagaaaacactacgttacgatgctgtctgtcacccgaggaaaatgctgaggacatggaggtgcggtggttccagtctcagttctcccctgcagtgtttgtgtataagggtggaagagagagaacagaggagcagaaggaggagtaccgagggagaaccacctttgtgagcaaagacagcaggggcagcgtggccctgatcatacacaatgtcacagccgaggataacggcatctaccagtgttacttccaagaaggcaggtcctgcaatgaggccatcctgcaccttgtggtggcaggtgcgttgcttcattttgctttgttactttggcactgtgtgactttgggtaaagcttctcttctaaattccagcccattgcagaccagcacaatcctctttcctggatccccattccgcagggacactctccctatgaaaagaagattccagggaaaaatccttcctcctgcacaagggccaccatgagtgagtttgccctgctaagccgtgggcttgacttcttgagaagcacatgcagaactcagttgaggccatgagccggggaaaatggtgaatctcggaagagaagtcctatgcctgccttagcactgagctgtgcacttctgagagtgagaggagacaccatcaataattgtcttgggacaactggaataaacagtgactgcccagagaactacgatatttgaaatcttatttcttgatgaatattcatcctgacttctttcctgaaatgctgtttgcaaagagagtgacttatatgtaagtagagcgttttattaaagcaagacttaatacagaagcaatattttttttgagacatagtctcgctctgctgcccaggctggagtgcattggcacgatctcagctcactgcagtcttcacctcccaggttcaagcaattctccctgcctcagcctcctgagtaggtgggattataggcatgcatcaccacacctggcatattttgtatttttagtagagacagggttttgcaatgttaactaggctggtctcaaactcctgacctcatgtgacccgcccatctcgacctcccaaagtgctacgattacaggcgtgagccactgcacctagcccagaggcaaaattatattcctgctgactccacagagaaagtgtaagaatttagctggcagggaatagacaaggtttcaacatagaaatacatttgaactggaatttctaggagtttgctaaaatgacattaagtgattacctcagtcttggggttagtttattgtgctttaaaagatatatttgaggactgaaaaagcccttcaggtgcaggataatctgtggtggcatttcactccatcagaccagaggaggtgaggactagggaattgggtccttcccagggggcctcaaatcataacaggtaggagaccccatctttgctactcacaaaggcaaacttgcatgtgattaaaacagaatatcatggaaggagggtttcttgatcttgtgtcatggctgtgtttgtagcagcactgcagggttggccagttatggtttctgcgtggcaggaatctactcctccctctctgtaaaactgacactggcctggcctttcccactctgaattgggctgcttaggactttttgtttgtttgtttattgtattctctatgttaggttggttggccggctgattttgcctttaaatctattttgtcatgcttgcctgtattgaacctcatggaatgttttgaagaactttgttctccaatttgctgagttattttaattcttattccactgagcctttaaatgtacaagtagttttatctcttgataaaaattaaaatgagcctgggcaacatggcaaaaccccatctcttttaaaaatatataaaaaaaattagccaggcatggtggcacatgcctgtagtcttagctacttgggaggctgaggtgggaggatcacctgaacccaggaagttcaggctgtggtgaaccacggtcatgccactgcactccagcccaggtaatagagtgagactgtgtcaaaaaataataataataattaaattgagccatagcaatagactaaagttattggcttaatttcctgtctttgccataatttgaagactttacaaaggaattactcagaagaagtttggatgttcacacatggcttaagggtctcctaggaccatgcagctctttcatacctggtattcacttttattgaagattcattaaacatggattgtagttagggtaagtctagattcttaggatttttggtgatgatctctgatattgaaaaagtgatatggttatcttaatcccaagagcatccagatctttctaataaatcgatgttctcaaagcactataagaaaattgcccacctgggcaacactttatctctacaataaaataaaatgttagccaagcatggtggaacatgcctgtaatcctagctagttgggaggctaaagcgggaagatctcttgagcccaggactacagggtacagtgagctatgattttgccactgcactccagcctggacaacagagctaaaaccctgtctaaaaaacaaaagagacattgcctaaaagacggatcctctgggaggtaaacagtatgaattagggttagagttggttttgcaggctaccatgttgaggctcctaaaaaccatcacctcctgtgggtgggagagagctgtggttatgtgaagccctaaactaaacagaaaagtaaatgtctttaggtcaaatggttgcttagtattctgcctgcctggcagatttttgtcctccttgttattcaagagcttctggaagctgaggtctactgagaagtcatcctgggaccagaaagtgaaatccaaaacctgcctgtttgaagtgggagttgacaaacccaccttaagtgagaaaattaatctggcaggataaaatgaacaagcatttatagcagacacatagatgcttggtgctgtgatggggcctgtaggtggaccacaaagaaaagggtgcaattggatcctttcctcttagagagctcacagtttgtgtggccaattggtctgctggtgttctccaacatcaatgttctttcttccttaccctcatccttttcttcttccttcctatttcttgcttcctacttccctctttttttcctttactttctctcttcacagaagagatgcaataggcactgagacactgccttttggctgtgccctggtatctctccccaggactggactctgagcccgtcattgaaatgagagaccacgaggacgggggcatccagctggagtgcatatctggagggtggtacccaaagcccctcacagtgtggagggacccctacggtgaggtcgtgcctgccctgaaggaggtctccacccctgacgcagacagcctcttcatggtcaccacagctgtgatcatcagagacaagtctgtgaggaacgtgtcctgctctatcaatgacaccctgctcggccagaagaaagaaagtgtcatttttattccaggttagttctctgctctctgagactcattgagtgcatgggggatcctcagcacacagatggagcccagagcggggatgggggcagcagtgtgggtggaatgaatggttctgggccctgaggacctggaggctgcagctgatatgaagcttctctaaccccttttcacaaaaggagaatcaaagagtcccaaaactcgggagtaggagcctcttctctgagggcgaacctagtcttttttttttttttcctgcaagatccttatgatgcagcaatttttaaacattgaaaacaaccatgacacatggagggagggtggtgtggataggtgactctctacacttggtgttcctgtatgctgcagccatcccttcctgcccaggggatttcccaagggacagagctggggaaaatccttattgatacacgctcataattcattcaacaaatgctcaagacactgttctagaaaccaagggtaaatcattgaacaaaatatatcaagatctcctccctcaaaaagtgattaaataattgaccatatactctatcagatggtttgaacatctgtaggaaacattaagcatggagggaataaagagaggcaggggcatgagatattgcaattattaacagaatggtcagggaagaattcactgtaaagatggaattgagtcattctgtctgatggcaaggaaccatcagatgcttaaagactgagcaacccagctacaggaagagcatatgcaaagggcctggggaaggaacatctctggcagtttccaggaccctcaggaggtgatgctgttgtggctgaaatggagtgagtgcaggaagtgagaggagatgaattcacagaggcaatgaaaacacatacatggcatcgcaagccacaaaaagactggtttttagagcgagtgacttggaaagcattggaaggatttgagctaagaattaacatgatctcacttgggctggtctgctgagaatggactaccaatggtaagggcagaataagaaggaaggcactgcagtattccaggtatgagtggtggtggcttgaggcagggtggcggctgtgctgactcagcataacgggttagctttatgtacactggtccttcctaccgtgactccagatgtttctgctttgctacctctgggccttggccctggaagccactgaggtgtcagccagggctgagccagcatcactttctccatccaagttttctgagggagaaactaatagagcaggaggctgaggagctcttgagatgtgctgctaggggcactctcacctggatgttctgtttcaaactaagtggacgtttctggcttccttttcagaatcctttatgcccagcaggtctccatgtgtggtgatcctgcctgttatcatgattattctgatgatacccattgccatatgcatctactggatcaacaatctccaaaaggaaaaaaaagattctgtcagggcaaaaggagcttgaacaggaaaggaaagaaactgcactaaaggaactggagaaagaacatgtggaaaaagagaaagaacttcagataaacagtaaaagaggccaggtatggtggctcatggcttgaatcccaacactgtgggaggctgaggcaggcggattacttgagcccaggagttcgagaccaacctgggcaataaagtgagaccctgtgtctaattaaaaaaaaaaaaaaaaagtaaaagagtaggaggacagttcaccattatagaaagaacacagctctcccaggtaccagcatacagaagagagaggaaatgcacagcagcagcagcaaggacttggaactctcatgtccttggaatgaatctctcagagcttttgttctttcattctgcccgcattgcactcattcacctggctacatgaagtactaaatggttgagcaaaagcaagtgtaacaatgtactggtactacccagcccctgatcatatatcatttctggtttctgacagtgccctaggcatgagggaagggagatgttgctgttcatagaaagggctgttcctgctttgcttactataaacccgacttcttttagttcttctgttaaagacatgattttgtttctgtttttcagagcaacttctgaagaattgcatacgtttagcctttcctgaactactccatgtacaatttgtgttctgctcatttagcagcatctcatgacattcaacctctgtctgtcccttgcaggatggagaagaacattcttacatgctggtgagtgcctctgatgctccctcagatctcagctttctcccgctagccagctaacaggactccttagaggagatgagcaaggggcccagggctacacagggatagcagggaattggggtcagttcatcaacagtgtcccagcaatgatgcatcatggctcttctgtcagagaatcccagcagctctcaatccaccgtggtttacatcccaggatcctttctcttttggaataatttaatacatgattaccagaggtttccatatatagtagcctccccaagacttatgcttcagtggtttttgctctttgattctggatcagtttgaaagaagacaatgctgtcttagcaatttatatactaggaatgatgtagactgtgcatagttgaaggcacatgttggcaagaggctataaaggttcccaatcagcttgacagaatggtatacaaataactggccagaaatgcctttctgctcttaagagaacacctatactttgtgtatatatagcctgccaggggagggggttcgggtgggtgggagagcacagaacccaattgcccactcccaatgggcacttcccatcttatgattgagcccctctgcccataagcaccacagaatccaagcttcaccagataccatggcacacggacccttcctctttaggtgaatttcaaaattgccactgtcaacttgggaccaaatagcaaaatgtcacaaccagacatattaacttggggaatggaggaaatcattttaacacaatagaaaggtagactaaataagtaagaataaatgtagatgggggaggccggcagaatgcccggagtctggagcatttcttgcactgacaggaaatgtacctaggtaggcacctacatttcctgtacctacctatatgttctttccccagttcttttagcagtttctttcctttcctattcaaatcccttttccctagacagaatcttttcttccttttggagtttgttgatctaataggtatacagaagtcatacctgcagacatcagacccatgttgttgaagcaaaactggatggaaatagttcctccatacctttgcctacagacccctcaggcagtaggttttcttttggggacatttatttttctcctttatcctcgaagggtgccctcgtcagtcatttaaatcagttgtcatctggtaaaaggaacacataggaccaacgaagaaaccctttatcctccaggacagtgtgaagggaaagactcaccttagttgatccaatggggagaggaggagcaggacataaagcctctgtgctggtttgagccaagttggaaagtttctaactaaagaaagtcccagagatcataggtcttgaatagaaaagggaatagattttagaatgctaaaattgtgaatgattaatttgggctcattccccaaattctctggatttcataaagcctcagttcttctcaacctgagggtgctgcttactgtctctggagagacagaaatgcagcttcagaggccaggatggtggctcacacctgtaatcccagcactttgggaggcagaggtgggaggatcaactgaggttgggcattcgagaccagcctgaccaacatggagagaaaccctgtttctactaaaaatataaaattagccaggcacggtggcacatacctgtaaccccagctccttggggggctgaggcaggagaatcacttgaacccgggagacagaggttgcggtgagccgagattgcaccactgcactcaggcctggcaacaagagcaaagctcagtctc

SEQ ID NO: 1896 - DNA, 13824 bp, Homo sapiens
cacagtagctcacacctgtaatcccagcactttggaaggccgaggtgggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaaggtaaatatgcaaatctttgcacacccttcttctctggaggggcgtttgggtgttttctctttctgcattcagccaggaaagcctggaggtcgggcaggggttggagaggtaagattcagccctggagccaggacttaggttgctttcttttctcagagctgattcaggctgcaaagctccaaggctggctttcccagcagtgatgagagcttctctagcaagtatcaaatttcaagcagctgttggacttaaaactgttttccagggcagtttctctctctggttctaggacacttaattgggctcaacgtttcccccaagtcttggctgtgggtttgttgtgggctgggtggttgaggagaggatgcagagcccgaagtccttggcacccctttgcagatcacggtgtgagacttgggctagcagcatccctatgacctggaaacttgctagaaatgcaaactggccaggtgtggtggcttatccctgtaatcccagcactttgggaaatccagacgggagggttgcttgagcccaggagttggagaccagcctgggcaacatggcaagaatccatttctacaaaaaataaataaattttctgggcatggtggcacgcacctgtagtcccagccacttgggaggctgaggtggagattgagtgttgagcctgaggggtcaaggctgcaatgagcagtgattgtgccactgcactccagtctgggcaacagagtgagatccaagaaagcaagaaagagagaaagagagagagagaaagaaagagagacagagagaaacaaaatgcagagtctcaggctccaacccaggctacctaatgggcatctgcactttaacaagatccctacgtggttcctgtacacattgaaatctgcaacatgctggggctgcagagagcctgggctgggagtcgtgagcaccacccggctgtgttaacgacagctggcaaaatgtggtaaggcacatccaggactcagtgaggcaggttcccgagcctctgttaggctaagtttcaagttgttccatcaccacctccctctgccttctttgccatttccatccatgatagcactaccctaactagtgatgagaagcagtctttggagttcctcttctctcctgtccctcatggctaatgtccctgctgagacttctgcctctggctctctttccttctgtgcaccctgatttttcttctcttctgtcccaagctagaggttaggaccctctgctgcagcactgggtcatcctcaggatacattcttggtgtatctggaggaacagatcacttccagcttgattcatgcagagcgtctcttgcttgaatagcaagatttgcccaaaatcagaccttcaatcctgtataaacagaataaataatcacttccagatctccagggaatctactcaccctgggtgagtttaccagacagtttcataattttggaattgaatgaaagaattatgaagggagctgtcttcaacacgtggggatgatagactaaaggattatgaacttagcagtggaggtgaagaagggtgtagcgtagcggttgggggcacagggctgcttctgggtgcctggcagcagctcgtttcttgtccaggtggtagggtagctgtgcatctctgttttgtgtactgttcaatgtttgttatctcacaattgaagaggtttaaaagaccattttgtgagagatcaagttttaagtgcttttttgcccccatcattggcttggctaggttagaacaaaatgtgataattctatttcccttcttttctttttttctttcttttcttttctttccttcccttctttctctccctctctgtcattcccctccctctctctttctttttacaggagtggaaaacaaactctattcctataaggttttctatttctcttttttttctgaaacgatcattgtataatgatggcctctactgaaccttactgtgtgtcaggtaatgtgcaaaaagcttaatattcattgcagcatctcatcaccacaaaggcctcatgaggctggtgctatttttttttccattttgcatacaaggtttacagagattgaatcacctgcttagacccacacacccagtaagtgatcgaatccagattgatggtgtaatgaccattatccagatccttatcaccatttggggaaattgtctgaaaatcccttggggttatttagagtcaagctttcatctgggtcttcagaaagttgtagtggagcggtctgcacccccacacacctgaagacatttcaggactaacctggatgaaaagggaactgacttttagctaggataggacataaggacataatcataaaataattcactttccttcttttcttttgaaaagttttgtaaagtgtgtatcctcccagagatcccctggcaaaggagaccccagtgaggccttggtttggagaaactgggccttgtggggcagcctgttgaaggtggcctggggataagagaatatgatggttgctgagagtggtgtaattccagctactcgggaggtgggagggttgcttgaacctgggagtgtgaggccagcctgggcaacacggcagggccccatctcttaaaaaaaacacatatgtgatgagcttttcttttgcctttcagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaaggtgcaatggtgcatttggtgggaggccttcacttcaaggcaggcagaagtatctgggtcgggttggcagcaagaactctgtcagccttttctacatgtaccccttttcatctctgccttgataacatccgtgaatacaacactatccatactccaagccattattgatatttgaacatgtcgtggctgccccacctgcctgtaggttggttttcccatagtgggcttggttccatggaaccctgcactgccctgggcctccctgttccccatcagagggatctaccatctgcccagaggcaatcagaggccaagggtgcaggcgggtcttgatctgaagcctccctttcagcactgtgatctcagtgactgtgcccctgagactctcagccagggggaattttagaaaatggtaggggcatttttctattgtcacatatgaatttctttattcattctagtaaaaggtgagggatacaatgttataaaaaagaagaagatgttgggtgtgagagggctgagaatcactggatctatattatacataacttgctgaaaaaaaataacactagttctaggtacttggaaaatgcatacatctggtaggacaaatagacctcactgtgtagcagccaagtctggataaagcctttgtaaaattatcacttggggccttataggcttgataagggacctatcagataggtcagataaaggaccatctgctcccaaaggcctaagaatgcttgacatttaaaagctacacacaattcctgctctcagagagcctacagctgaggaagagactgagacaggtaaacaaatttcaaatctgtggccacatttacttcaatgatctgagacacgtatagagtactaggacagttgaaaaagtcaattgcttttaacacttaagacatgtcattgaggtgctgagccctggtgatgttccacactgtgtcgtggatcttaatcagctttgttacaaatggcttgtggtgggttagatgaggatgcaaatcaaaaagcagggacaatgagtacaatgtggcccttccttttcccagtattaatagctcattgctacactctttgcagttgtggcccactttctttgagagaccccttgtgaggaaagcctttgagaagaccctcaaggacctgaagctgagctatctggacgtctatcttattcactggccacagggattcaaggtttaagacactctctttctcagcctctagtttctgagcaggtgccagaaaatagtagctgcaccagggctgtggggtggtgtggactggggcaggaggccttgcatttcataattgggaatggcaggtggtcaggaagagaccttggagaagaaacacactggcctggaagggaggttgaggccatgtgtgctgctgaggtggccacatgcctgggttttcttgcagttatgtctgagagaagacatgatttctggcagcccagacaagttgcaactgccatatcacctttgtcttgattccacgccccagggttgccctcccaggaaatctcttgggttactcttgcataactatattccagggcataattatcttattaagcaaagtacacctgggagtggcatcttggagaaaagcccaagtatggtgatgctggaaggaagccagtagtgatccaggcacccattgcctggggctctgctcttacctgctcctgaggggtgggagagacaaatttccagctctctcccctcctgaccaactggagtgatgatggcctgccacccctaattccacgcctcttctagaggctgcaaggatagaagttggccaatatcttctccagaaaaccacagcttggatatctaatccttatccagtaatattgaaatgaaagtttgcccttggttgtatatgggatctaggtgtatgaggttaatgtccatggtgataatgaacttctggaatgtactagcagcaaatcttaaagtcaagccagtcgtttctaaaatattagtatgctacagtagatacagagattttaattaaactcacattcctaaagtatgtactccagaacttgaaaaagtggtatgcagatgtggtatttagcaagagtcaggatcctgaaaccttgttgaacagaaccaagtgtcctgatgcagattccagtaaacttttcattctgtgttcacagtctggggatgaccttttccccaaagatgataaaggtaatgccatcggtggaaaagcaacgttcttggatgcctgggaggtaggttcccagcttcctctaagtgtgctgggagagaaatcttcagttatccatgagattcgcatggatatgaatgaggccatgtgcctgatgctttctaatttcatcattgtgattttctagctcttctaatatcttcctcatcacctttggcttttgggtacatctgatactatttatatttcaaggctaatagtcttcaaataagactggaaatacaatgtaccccactttggggaatacacatgctgttctcaaaccagggcgaggcatttggaacaggaggtttgggcctgggtgtgctcatagcagctgagtaacctagggtcagttttgtaactcatgtagggctcagttttctcttcttaaaaagaagttgtataatacatactaccaatatatatcttccagtgtgtgataaagattaagatggtttacatgccaggaacattagtcataaagcccatttaaccctaggagacagggttaacatccccatttataaataatgacatttgaaacctagattgtttgatgacttgcccaggtcttgtcacaatgtgtgtggcagagctgggattagacccagactcatctgaatcacaagtccaaccaccaaagccatcagcatggtgcttggcaggcagtgaagacacatccagaaatcagggagcctgagtgctctgcttctcagatctaaccatgacctgtttcacgtcattcacattcaaaatgaatgaagggatgaacattttctctggtcattttttattatttatacccttttgcaaatgctagtagagaatgaagtggaggaataagttataaatgaacagtggcttatgactccaagagttaatcgtgttattttggtagctgtctgtgtaggtgtgcatgtagttgcgagtttgtattgtgttttacaagcaaaaatatattatgtttcaactttctgaaatgcttataattgacatgattcaatgaaatgtagctttttctgtgtattgtttgttcaaaagcattaatccacaagcacagctttttgttgtttttattgtcttagacactctcactctgtcacccaggctggagtgcagtggcacaatcttggctcactgcaacgtccctctaccaagtaaaagccattctcctgcctcagcctcctgagtcgctgggactagaggtgcatgccaccacgcctggctaatttttgtatttttagtagagatggggtttcaccatgttggccagtctggtctcgaagtcctgacctcaagggatccacctgtcttggcctcccaaagtgctcagattacaggtgtgagccaccacacctggctatttgcattacatatgataagatttttttatcttaactcttatgatgccatgaagtatggcaagtatgtcaatgtagcctgcttctcgcagtgctgttttttgaatgaatacaagaacgactgctaaataaaacatttgaaaggcatgaaaagatagcagtgatcaagatcagaggctctgatttgaaatgagcaggcttgaatatgtaagcgttggatgtttatgtagacccacaaccagttcagtagaaacctcactgaccacattgaagcagagaggaggaaaaatgtataaagaagtcaagttctaatacaggaaaactaacctgacctatgtgcacaaaaacttttaaattatctaattgccccatctgaaattttgggaaacctaatgatttcacagcttctaaattctactgcccaatttggataacatcatatatcctagtggttctcaacgtggctatgcattagaatcacctgaggagtttaaaaatcccaacgtctaggctacaactcagagaaaatctgtaagaaactctggggggtgaaatccaggcactggtaatttttttttttaatttagagagagtctctctctgttgcccaggctggagtacaatggcatcatcatagtttagtgcagcctcggactcctgggctgaagcaatcctcccaagtagctggaatcaaaggcacatgccgccacatccagctaattaaaaaaatttctttttgtagagacagggtcttgctatgttgcccaggatggtctccaacacctggcctcaagcaatcctcctgtctcagcctctggtaatatatatcagaaacatatatattattagtaggtattataagactttttttaagaagagaaagctaaggcctacaagagttaaaaaacttaccctaggttactcaaacctaggcccaaaacccctgttccaatcctcctgtcacctcccaaagtgctgagattacagtcatgagccactgcatccagccagtattttttaaagctccctggtgattccaaattgcagccaaagttgagaagggctggataaagtgttccctgaacatgtcgtgcttatccctgcctctgagctttgctcctgccttcctgtgtcatatgctcatgttttttccctcttttctgtctttttttttttttttttttttttcttttgaggcccagcttatactctacctgaaggactcccctgacaactgcgggctgtatgtatctcttctttctctgccctttctgactctgtctatgccgctgtgatgttatctgaggcagcctcagtgtcatgattgatggctccatagaagggaactctagcactttaattggactataagaatcccagaaaaagggagcacattgtatacatttacatcctgacaacttctgggcaggatctggaacatgtaatagatggctactaaatacatattgcactggaggctgctgctaacatgtatggtatctttgggcaagtttggaaaatgcccaatataggctaaaaattatacaaagattcccttccttgcgtgtccatgcagtttctgtaccaggaagcatggctggatatgcaaacagtgggtcaggcttcagtcccacacaactccatggccgggtgcccctatcagggtgtaatctgaatgcatgaccttcctgcaaaccaaagcatgcttagtgtgggagagagggactcaggacccacaagtgaggcttctccgtatgctgcagcctcttcctgactaacacagcttgcccaggtttgggtgtgcaatgcacacacacaacagcagctccctgctatcatttggattcattaaaaattaaatcatctcataagcttacaaatgttgatttttatttactttttatttttttgcattacaaaactttcatatttcccctgtgtacaggaagtttaattttttatgtgtttcttcacgtgtaaggtgagagtggcaagaacataaaatctttacctgttactcctagtttttcttgcgctggggaggggcagtagggctggaaccagtcactgatgggcacccaggccctggactaaaatttcctgtgaatgcttcggctaaccctgttacggtggatcctttagcaatttctgccccagggaggactaaggcaagccagggtccctgtagtccctctagagctgcccataaggtattcctttctatgataggccatggaggagctggtggatgaggggctggtgaaagcccttggggtctccaatttcagccacttccagatcgagaagctcttgaacaaacctggactgaaatataaaccagtgactaaccaggtaaattctattcagtttaagggtaagggtcctgccctattacttcttaaacattgcgggaggaatgttcaatgctatgccctgagtctcatctcaggggtcagtgatcaggacactttggggaggtgtgaggctgatctcacgggtgatttagcaagtatctcagtgggcaggtgtttggcctttgcttggtggactttttttgtgtgtagaactccctaggaacaatgcaaaacagagccggctttccccgtgatgaggattgtttgctgttgcaggttgagtgtcacccatacctcacacaggagaaactgatccagtactgccactccaagggcatcaccgttacggcctacagccccctgggctctccggatagaccttggtgaggcttccaagtggtgggtctttctcttgataatcttaaaaacattattttataattggtaaatgttggtatgggtccataagttactggaaagaaaaatgtgtgtaaggtaacacgtttggtacacacaaatgggatggcagtgggaaaaaatgggaattaaacaacaacaacaacaccaagggcgacatgcttgaccctctgggaatatttccagttcagccacccaagggtgaaccaggctttgcaaaatgctgaggcttcagagcccggggaaaggacccaagcttccaggtcctcctgcctgtctcccagatggagaggctctgatgatcagtcttgagaccctcattggagtggtgtccttctgtacatggtagccatggtgattattcacatcagcatctttctgcccctagggccaagccagaagacccttccctgctggaggatcccaagattaaggagattgctgcaaagcacaaaaaaaccgcagcccaggtgccatatttttatttttcttgttatccaacaactcattcttccagtctcgtgtttcatatcctgtgttgtcctcaacaaactccttaaaggggaagaatataggagctgaagccctctaaagtgtttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtctttggagctgagtggaagcctgatgtcccctttccgcataggttctgatccgtttccatatccagaggaatgtgattgtcatccccaagtctgtgacaccagcacgcattgttgagaacattcaggtaagtttccggctggtcggccctggtattcctcagtggagtgggggacaggcagaccttctcactaggcttctcacctcatcgctgcattgtcttttgccccctcccttcccaccaccctatcattttccagcccagggagctagggtcagtagagctgagatgaatgacccatgggctaaggacatcctgggggcagtgcctggtaaagccctatcaggtctgagcacagttgtgcctcacaccactgagaagaccctcagttgcccctgagcagctaggccctgggccacacacaagaacagactgtcctggcctccctgctcacttcccggcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccgtggacagaatgggaaaaactcctgtggccagtttgtgctgtgaatgtgagctccctccctgctagaatggccggcagtctccagccacagctagaatggccttactgatgatgtattggaactcctacctttccaggtctttgactttaaattgagtgatgaggagatggcaaccatactcagcttcaacagaaactggagggcctgtaacgtgttgcagtaagtggcatggagttaactagaagcattgccaggagtttttctaaactaatagagggttagttggaaggattggaaggctgctgggactacttgtgtcttcaaatactattttggggcaattttgaaagttaaaattggggtacctgggaatcactgtgagggacacatctctaattgctgctcattgtctgaacttctggatgtagagctagaatcataacagaaggtgggttgtcaataggcgggaggcagaacattcatttattcattcattcaatcaatatctcacggtcatctatgtgccaggcattttctaggtgcttaggttatcatactgtacaaagttgctgcctccataggcttagggagggagggaagaagagacaacagaaataaatcaactcaaaatatagatgtcagacagcaacaaatgctagacagaaaaataaagtagggcaaagtggataggaagcggtgggtggtagtgggactgatcctttatacagggtgtgtaaagggaggctttgctgtgagggatataccatatgcatatttgggggaagagcattcttggcggtgataacagcaggtgcaaagtccctgaggtgggattgtgtttagaacattcaagcaagaaggccagggaggctggattaaatcatctccaaatgcctcttaaaggaggtggtgctaactttacttaaaatcttagataagtggtgaaaaaaagctttcactctggctgggcaggcattctaaatcatctctttacaagcaatactttctgaataatgtatctaattaaatgtatcaaaaagagttgtctggcatttattactgccagatctgtaattcaatgaggatttgaatctctttcaatgtttctatagccaaaaacgatttttcaccttttaaaaatgatttcggctgggcgtggtggcccacggctgtgatcccagcactttgggaggccaaggtgggctgatcaagaggtcaggagatcaagaccatcctggctaacatggtgaaaccccgtctctaccaaaaattagctgggcgtggtggtgggcacctgtagtcccagctaattaggaggctgaggcaggagaatggtgtgaacccgggaggtagagcttgcagtgagctgagattgcgccactgcactccatcctgggtgacagcgcgagactctgtctcagaaaaaaaaaaaaggtttcagtatctcaagcgctgcttgcatgtcatgatattccatatctatcctgcccaccctaagtatcataggagcctttcctcatcttacaatggcttacttttattggagcttaacaaagtagtagctacttagagcaaaaaggaagggtgaacgtaaagtgggactcaccccccaaactaaactgcttaccttcctatgagcatcatttctggcaatgggtagcaatggaggcaatgggttggtgggctctgcagtaaatccacctggcctcaaatccaactttaacactggtttattagctgtgtgacattgggcaaatttcctagtttttccaagttggtttcttcacttataaagtaggatgataatactaatcgcagctaacatccattgaaccttagcttagaatgtgccagggtcctgcgcccttttccggtggtattatctcatttaatactcagaacaatccccaagctgtcaattctgctgttgtttcctacttcatgatgttgtgagagtggattgggacaagacttgtctgtcacctcgcctgacaccaggcttactatgggttgtcattacgagtttattctgctgccctgctcactgtctgccctccttccgagcaaagccctcatatcgatttgagggaaggtcaaagtgtgggcaccctccttatgttcttgcagggaggaggctaagagagcacaaatatgatagagtccaccagggaagaataccttctcaaccagagttgttgttttgatggaactcagtttctctgtttttgttttttgttctttcctgcagatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaccaaca

SEQ ID NO: 1897 - DNA, 16353 bp, Homo sapiens
cgtaggaatcgcagcgccagcggttgcaaggtaaggccccggcgcgctccttcctccttctctgctggtctttcttggcaggccacagggccccacacaactctggatcccggggaaactgagtcaggagggatgcagggcggatggcttagttctggactatgatagctttgtaccgagttctagccagatagaaggttaccgggagctggggagcgttggatttgctgctgggctgtgccggtgcccagaaggcaggaccttgcagaaccagccaggtccctgggagactgtcagacccaccaacctggtggcattcgcagagctgagatgcattggaaattgccttgggcacatccccaaagatcaggatgtcccaccccagtctgaaggagataaagttgggggtaggagagacgcagatgcaagtgatcagtctcagtcccagacattgccttgctctgcgggtaggaattcaggattcattttccagggaagttcctgacctctgaatgagaggggctgtgtaaggccaatgcctgggaggaaggcaaggatgagtagaggtggggggaaacaagtgtcaggaagactcaaaatcttccagagaaattgtgcagggtcttaccagatctgtcctcaaagccatgcaaattgccttctttgcaatgcatacaatgaggtgtctctgggggtcagaactggttattagggaacttctagccaggactgctaaatacgcgctgttggcccaccaggctcacctatagccttccttcagtctgggcttggtttggatttcactgtgggtgccatcgcctttacactcctgtttctatagtttaaagatagtggtgctttgggaaagtgactccttaaatacagttaggtccaagtgagacaagtggcctggctgtcatttcagaatagcagcttccaagaggtgattaatttctgttggaagggtgatctttggggaggtgggtgaagagcagagacttggtggtaccgttccaggagcacaggctctcttcctttgcagtgcagaatgacctctggcagccggagttgtgtttgttctgtaggattctgaggtgggccatgggcagctggaactggggaattttgccaatctctttcatattaggattgtctgcagaaccagatatggaggcttctagcaacgtgagtgctcctgttctaatgcccttagaaacaagaaggccacactgatcatttctctcacttaggcagggagacaaggcaagagagaaacagtggatgcttttaggttctttcccttcccaagcagttgtggacattgggctgaggggaacatttccacattggctaaaggagcgtcctcctcatattttgtacattttatacccaaaataactcttcttggtatttggggaaatattttcctccccgtccattccaggaaatggctccaagtgccaaggacagagccagggaagttgcaatgaattcctgcccgtcagccccaggcagatgccttgcacgtctgagtggcccatgcagagcgtggaggtggccgccacggaacctgggtcaatgtcccacccccgcttagatgccaccaggggcgtgggagccaaggagagaagaggggctccaggaaggtagagtccttgtgtcttgtgcatctgtgaacagcactggtatgatttaaaggaaaattgagccaaattttccggcagtcagttaccccatccccaccggggtaggagtctggcagccgcagctccattctggccagtcggcagagagccttgaaattcttctttgtccacacagttgtctcagagaaacagagaggttgtttctgcttaaaaacaacacacttggtgtctgggcccacagactcctttgcacttattccacgtgtgacagccaatgtgcctcgttgcttagcagacagcatgttaccgtctttcctgctcagtttgttagctctatggaatggaatttataatcaatgcccataccaacatttcactaatatcataggagatttagtctccatctgggtgtacattacatttgctctggggtgctccaggctggggggttgccaaggaagagaagagaaaccgcagagaagacgggagggcagggcaggggtctctgagaaggggaggggtcccagagtgcaggagcaggagccaggctcatgaaaggggccacgggcgggagtatccagggacggcagtcaagatggagcacagcttaggaagctgaagggaatcctggcccacctgggtgctagagggcacataggaagtgcaggaagcagaccaaggtccccaagagagggagacctggacgctgaagcattttctgtctttattaagacaactccgtaagaattcctgctgggccaaagtgaattctaggatgcgactttaagatgggagcaagcgaaccattgaggaggcaggttaccctagttagccaatgcagatcgagaatgggaaatctttcatttattcatgcaacagatatttaacgaagccctgccgtgttccaggcctgtgatagatgctggaacaggtacagagatacaggtgtcattaattgatcagggcaacctctccttctgagtcttgctggagcttcagatgcccctcacacagagctcgagggagcctcaacaattgatcagaagtcaggcaccatggctcacgcatataatcccagcactttgggaggccaaggcaggtggatcactggagcccaggagttccagatcagctggggcaacatggcaaaaccccatctctattaaaaaaaaaaaaagtaactggatgtgatggtacacacctgtagtcccagctacttgggaggctgagaggtgggagaattgcttgagcccgggaagtcgggggtccagtgagccttgatcacaccactgcactccagcctgagtgacagagcaagaccctgacacacacacacacacacacacacacacacacacagattagagctgaaacaggagtagaaacctatctgtatctctgatgagatcagatctttctgatgaacagaaagaatgtaacccctgtactcacaccctctctgctggttacatatgttaacacgatttctcaaatgaggcttttggttgcaaataagagaaaatcactcacgctggccctgtgtttttcaaattgtttattgtgatcaacatttgaaaaaagagccgagactctcaagagtgcattacccacggtaagggtgaattttacttcttgacacttatttctcttacatgtatctatctgtctcaaatgaaaaatatatttagaaagttgaaagctatccaagtgagtataagaaaagagtatctcaccctgaaggctaaggacagggagggccaccaggcctcacgaggacccaggaaccacaaagaaggctaggaaggagcacaggcggtgaccatactctggctcagtggctatgtgggctctggtctctctcagctgttccatgcatatgaggccaaatgtggctaccctagagcttctgagccctcaacagagatgaactggactctctgcagccccactctaaattcctaagagagaagttgattgacccaatcagggtcaggagaaggaagggaggaggaaagggaggagagaagagcctcttcgtctcttgcctaccactggccaggcaattgtagccaagggggctggagtgtaaatgcaaacatagccatcaagggttgtgtatgtgtgtgtgtgtgtctgtgtgtgtgtatgtgtgtctcttgggtaggttagatctcccaggaggtccctactaaacagacttaagcccgcaaaattttagctctccagcctcacacactccacccctctaccatattgaatcttcccaaaccaactatggctttccctaactccggagcttggcctggaatgccctgcttcccctctttcccctggggaacgcctgtccttcaggcctcagttcacacactgcctcccttgcaaagctctcctcccatccccggagtccctcttcccctttgttctttgggttctatgcttcttccctcataactcccaccaggttgtgttaaaatgagttgttcaaggtcctgtctgttccactagattctgagcaacttggagaacgaagatccaaacttcgctgcctttatttcctcctttgttcttttctcatccccaagtcccttccaacttggagttatgaagaaaggaaggaaggaagggtgggagggaagaacaggaggggatcccacaggagaatgtgtatagggagaggactcagactagctaaagcttttccctcataattaatagcaaataccatgttacctgaatttaattcacagtagcatacaaaagactcgctttgttctccccattgatgtcatcagagggctgtgggcaggcctaatcttggctcaggaggccctccagcctggatctaaagagcagcagatgggccaggctcggtggctcatgcctgtaatcccagcattttgggaggccgaggcgggtggatcacgaggtcaggagtttgagaccagcctggccaagatggtgaagcctcgtctctactaaaaatacaaaaattagccaggtgcggtggtgggcgcctgtatttccagctacccgggaggctgaggaggctgaggcaggagaatcgcttgaacccgggaggcggaggttgcagtgagccgaggtcacgccactgcactctagcctgggcaacagagcaagactccgtcaaaaaaaaaataaaaaaataaaaaaataaaaaaaataaagaggagcacacatctctgcccatcctaactcccactttgacattgaggtccccaggatggagggtctgcctccatctgccttgtcccctgcaatggtgggaaggtgatggagctcaagtctagaggccaccagcttcttagggaggtaggaggtggagggtggggtgcgggccctgcacacaactgccaagtgaggatgggggtggggtccacctgaggataagtaacagtgaggctggtgcagaggacccaggtggaggtagacagcagaatttgtggtggggtggatggcacattatataagcctctcttgctgccctgtttactgagattgtttcattatcttttttggcttttgtttttaagagatggggtcttgctgtgtcacacaggctggagtgcactgtgtgatcatacctcactgcagcctcgacatcctgggctcaggcaaacctcccaccttggcctcccaagtagctgggaccacaagcgtttgccaccacactcagctatttttatttttatttttattttttttagagatggggtcttgctgtgtcgcccaggctggtcttgaactcctgggctcaagcgatcctcctgccttggcctcccaaagccctgggattataggctgagccaccacacccagccacatttcatctgtgcagctccaggggctccacattctactcttctcatttcttctccagggtacccatggcaagggatgagggtagaagatggggcagccaggccttgattaaaggagaaggaaggcagcctgtggagagggcagcccagggagtgcagagagaagtgggccatgagggagacagcagagtgcaggctgcgtcccaaatgagcatacagcccactgtgagcccaccatcttcctagagacccctctcctctccaggagctgcttcagtagcactcagaggaaagaatgatgctgtatcaacatttcagcagctcatcttttaactctaagaaaatggcagctcctaaatgttcaaaactgctttggaaacttctggagagaggttttgcagctcaggcagacagctgatcgcggcctttcttccaccccaacccatgctctccccatgctctcctgccacagctgcagcgggcccctgggtcctacatttgcagccctttgtctctgagctcagacttccaattccaagcggcagctgggcaggctcaccagcatgtccagccagtactaggacatcagcaggagcccaaccacctctttccaaaatctctcctcatgtctctcctagtttccatctccatccttctagtcagccaggctgaaaacatttgctcctcagggtgcagaagggaaagctttgcctcccttcctggtgctcactgcccctgcgattccagcccaagccctccccggctcctcaccctggtgtcagctggaagccaccatctcctaaacccacctgtgttcttccacctctgccagggctgccctctcctccaccttcacaaactcaattcctacccattctcaggtcccttatcaaatgccatctcctccatgatgcctccctgattcccctgctggaaataatggtgataacagctaaggcattggggttggctacgtgccaggcaaggagttggcactttacatgctttatctcatttcagccacataacatcgacaggtggcattatgattcatatcatccccatctgatagccaggaaaactgagtcccagagaggttagccactttcctagggccctgtgctctgactcaagcatagctctgaggaactctagcattcatcagtttaagcaccatgactttctttgctgagtcacccaaggcatttcttcatttaaatgttcttccttggccaggcgcagtggctcaggcccaatgcggtggctcacgcctgtaatctcaacactttgggaggccgaggtgggcagataatctgaggtcaggagttcaagaccagcctggccaacatggtgaaaccccatctctactaaaaatacaaaaaaatgaggctgggcgtgatgactcacacctgtaatcccagcactttgggaggccaaggcaggtggattacatgaggtcaggagttcgagaccagcctggccaacatggtgaaatcctatctctattaaaaatacaaaaaattagccaggcatggtggcaggcacctgtaatcccagctacttgggaggctgaggcaggaaaatggcttgaacccgggaggtggaggttgcagtgagccaaggttgcaccattgcactccagcctgggcaaaaagagggaaacatcgtctaaaaaagaaaaaaaaaaaattagccaggctgggtggtgcatgcccgtaattccagctactcaggaggatgaagcaagagaattgcttgaacccaggaggcagagattacagtgagctgagatcacaacactgcactccagcctaggtaaagaacaagactccatctcaaaaataaataaataaaaataaatgttcttccttgcaatgaagttaaatatgtaaattctcaaaccagttgcttaagggcacagttttgttctttacctatatttttaacaaatattttatgtaagtagttgacaaaatcaaatactgtgtacactaccgaggcttccctgggaaagccatcagcctctgccccatcccttcccactcctgattccactttcctgtgtttccatatctttttcatgtctgtttctggcccacagtgggcgatcaatacatgttagccaccaaccatcaaacctatattgagtaattatggtatgtcaggcactatgctcaatgaaattgtattaggcttgtacaaaagtaattgtggtttttaagagtaatggcaaaaacggcagttactttcgcaccaactatttgctgccttgaattattcctcctctcctcatccctaaaccctgctcctcccagccattcttcctccccttcttgggccatggccaggccccacccaggtactaagactcaggtgaaccaaggaagacttaatgcccactcttttctgatgcccatgttggcatgtgttaagtcggttagcattaagtttggctgcatttagcagagacccaaaagaacagtgccttttaaaaggcagaggttatgtctctcacacacacccagcacaagtccaagaccagcatggcatctcagctccatcaacctcaggaaccgagctcctgcagctccctgccctgcagttgataaggtgaggtctttgtcctcctggttcaagatggtgctagaatgttggctaccatatctatagtccaggcatcagaatggagcaagggatgaaaaaggaagagatgaaggcacacgacaggttcctgagagctggcacaggacacttctgcttatatttcactggccagaacttagtcacatggtcacacctagttgggagactctgagaagtaaagtatttattctagatggccatatccctacctaagacttggagttttctatgactggggaagaacggaagacaagatattgggaaagactagcagcctctactaaaagggtgatctgtgttgatgtgcgtgtgtgtgtgatgtttgtatgagcatgtgtgttatgtgttgtgtgttggtggggcagattcttgcgagcactttggtctcagatggacctgctaccagttctctctgcagacccccataggtttctcctaaacctggcctctcctattaggcagccttactcagcggcagcttctcagctccatgttttcaaggaaccacaatttatttccagcatccactgaagcatattatcagtggtgatagagggggcttgtaaaactgtttttccacttaggtattagagggtggccattatttgagagtgactatgaccacagttaatctggtaataaattctcttgggtaggaggaaaggaaaggatgctttaaggaagcatcttgccaggagacacaaagctaacaagagtggagcctgcagctggagccgcagagcctaatcactacacccgcccatctctgctagggtttcatgacttcgtatcggggattagcagtatttaactctgttgcacaaacatttggtgtattattcaggtaacaagtagctaatagaggaagttttacttttttaagacataaatttgccttttcccaaattacttggtacatagtacttttcatgtttgaagttgagatgtgggtacaataccatagctttattccagagcagggtatttgtttccaaatgccatgttcccagcagctgcccttgactgggaattggggtgtgatttgggcttttccttaaatccttgaggagctggaggggtgggtggctcgcactcctgctttctggatctgaatcctgactctgtcatggacctgtttgactttgggcaagttgactcctattcctgagccccatatttttctcttctgtgaaattcagattaaaaaaacatggctttgatcaaacattataaataatatatagacagactgcttgtttttattgtattgccagaaatgaatcctactaatattgccatctatggacagaaaatgtattacctgtcttcatcaagacccagacgaggaagaacacgaaaagcggagattaattttactgccatctccagaaccgtcatcctaatatttacttacattttattattatttcaggctcatgcacatatacttagcatggatcattggccacagactcgcatacatttaactttattaccttttgcctcatgtatctcattaaaattttgctgcttaatcaaggatctgcatattattttaattttagaattcacagttccaagactttgaaagtttcaagcgttctgggtgaatgtgttatgctctctcccgccaccatgtctttataccccctgatttctcagccactatggcaaccactttctactcttagtagcccatatttagtccaatccccagctcaggagacacttcttccagggagccccctgtgccttccagtagtatcttgtacctgccctttttgcaaagctctttcctcctggcttagaatggcccattgacctgtttgtttctcctattaaactgtaagccactcgagggtagagagcatctgttgttcaccattgcatcctcggtgctgagcactgcgtctgacatattatttagaaggtcagtaagtgctagtgggattcaggctcccagtgggtgggagagaaaggacgtaaggaagcaagtggtaaaggccctcacagagtatcagcaggctggtgtgagggagaaatgcagaggatgggtgagtagcataatcgctaatgatagggtaatgatagagcacatttcacaacacctttaagccctttcacgtgcatcagataatttgatcctcataaaagcctagagatagatatattacagggatgaaggtggagtattttgtggttatgtgatatgtttaaaattatgcagtgagtaaatgactgggttcaaaccagaccttaaaagtctgttatctttccctcgagcatgcaatgaagtctacatcatccctaccatgtccatttgatcacaccctggcctcacagctctgtggtctacaggatacctcatggtggttttattgaccagacaataatcctctttctaaggggatgcatttcattaatacatatgtagatcatgaattgtctttgactttgaggggatggtagccagagcagaaagcaaagctgattttcatccccgtctggtaatgtggttggtaatgtgaagatgggtgtattctgagataccggctccttgcagtgtgtggttccttctgttttcaggcccaagaagcccatcctgggaaggaaaatgcattggggaaccctgtgcggattcttgtggctttggccctatcttttctatgtccaagctgtgcccatccaaaaagtccaagatgacaccaaaaccctcatcaagacaattgtcaccaggatcaatgacatttcacacacggtaaggagagtatgcggggacaaagtagaactgcagccagcccagcactggctcctagtggcactggacccagatagtccaagaaacatttattgaacgcctcctgaatgccaggcacctactggaagctgagaaggatttgaaagcacagggctccactctttctggttgtttcttttggcccctctgcctgctgagattccaggggttagtggttctaattctaaaccactccaagaacatttgattttgctacatgtttccatttaaaaatcataggatttgggctgggtgtggtggcttgtacctgtcatcccagcactttgggaggccaaagcaggaggatcattcgagcccaagagttcgagaccagcctgggcagcatagggagaccccatctctacaaaaataataaaaaatgttagctgggcatggtggtgtgtacctgtggtcccagctaggggaggctgagatggaaggatcacctgagcctgggaggttgaggctgcagtgggccctgatcatgccaccgtgctccagcctgggtgacagagtgagaccttgtctcaaaataaataaataaataaataaaagtcataggatttgatcaggcatgatgggtcacatctgtaagcccattgctttaggaggccaaggtaggaggatcagttgaggccaggagttcaagaccagcctgggcaacatggcaagacctctctctctaatttttaaaaaaataaaaattaaagataagaaaaaaatcataggattctcatgaggcctcacgtgcttattttcaacctaccaaggggaaacccaggcctcagcgattagctgagccacatgcaggcacagccactgtctctttccttcctgtcccctctgtccccaccttctgcgctcgccttcctccctgacttcacttccttgaatcttagtgcctacgaccagagggagctgtgaagttccttgtgtcccattggcaggaacaagacccccagaagcatctcctcagggcctctatcccatctctagatgtgcttgtcattagggttcttgtagttccagctgatctctggccctgccgctcaaagatacccaaaagagcgagtctaccctttttcacattcaaccctctactgatttgcaaatagcagtcagtgcccaccctggtcttttctctggggtccagcaggcctagaccttcagccattttcctgatgaggtctgtatttgaaattaggaagattaagtttgaatcttcacacttctgatgtctgtgagatcttcagcaagttccttactgtctttaagccttgttttcatcatctggataatggggatatcacacactattcacaaggttgttatgaggcctaaattagctaaagcaattgaatcctccttaccccctgcatggagctctctggagacttccacgtctcctggtcattgtgggtgtcttatggtagtcttgggcagttagggagaagttaggtgtctggaagcaaagatggctcagaactagatagagtcttgggcattttatagataaaaactcttgtctcctttaaaaataataaaaaaaaattagctgggcatattagccactcagcaagactgcacgtgatagatcccgagtgccccaccttgggtggtgtaatacacaatatcacgggagccccgggtagtaaccacggaggtgtcagcctcagtgctgtgggcagatggatggggagagcctcccggaactggagtcactggagcagggttggggggcctcactgagggtacggccttgatctctaaggaggagggactgcctggaaaagctgactgggagggaggactcggctgggggtagaagggactagggaaggctgggggtgggggtgcttatggaggacctcagatgcctggggaacagactccactaaataaaacatatgaaaccatggctggttcttcagcagaggccatgtagagaaaggaatgacctaggaaagttggcctggaagtggagggaaggatggtgtgggaaaagcaggaatctcggagaccagcttagaggcttggcagtcacctgggtgcaggatacaagggcctgagccaaagtggtgagggagggtggaaggaggcagcccagagaatgaccctccatgcccacggggaaggcagagggctctgagagcgattcctcccacatgctgagcacttgttctccctcttcctcctgcatagcagtcagtctcctccaaacagaaagtcaccggtttggacttcattcctgggctccaccccatcctgaccttatccaagatggaccagacactggcagtctaccaacagatcctcaccagtatgccttccagaaacgtgatccaaatatccaacgacctggagaacctccgggatcttcttcacgtgctggccttctctaagagctgccacttgccctgggccagtggcctggagaccttggacagcctggggggtgtcctggaagcttcaggctactccacagaggtggtggccctgagcaggctgcaggggtctctgcaggacatgctgtggcagctggacctcagccctgggtgctgaggccttgaaggtcactcttcctgcaaggactacgttaagggaaggaactctggcttccaggtatctccaggattgaagagcattgcatggacaccccttatccaggactctgtcaatttccctgactcctctaagccactcttccaaaggcataagaccctaagcctccttttgcttgaaaccaaagatatatacacaggatcctattctcaccaggaagggggtccacccagcaaagagtgggctgcatctgggattcccaccaaggtcttcagccatcaacaagagttgtcttgtcccctcttgacccatctccccctcactgaatgcctcaatgtgaccaggggtgatttcagagagggcagaggggtaggcagagcctttggatgaccagaacaaggttccctctgagaattccaaggagttccatgaagaccacatccacacacgcaggaactcccagcaacacaagctggaagcacatgtttatttattctgcattttattctggatggatttgaagcaaagcaccagcttctccaggctctttggggtcagccagggccaggggtctccctggagtgcagtttccaatcccatagatgggtctggctgagctgaacccattttgagtgactcgagggttgggttcatctgagcaagagctggcaaaggtggctctccagttagttctctcgtaactggtttcatttctactgtgactgatgttacatcacagtgtttgcaatggtgttgccctgagtggatctccaaggaccaggttattttaaaaagatttgttttgtcaagtgtcatatgtaggtgtctgcacccaggggtggggaatgtttgggcagaagggagaaggatctagaatgtgttttctgaataacatttgtgtggtgggttctttggaaggagtgagatcattttcttatcttctgcaattgcttaggatgtttttcatgaaaatagctctttcaggggggttgtgaggcctggccaggcaccccctggagagaagtttctggccctggctgaccccaaagagcctggagaagctgatgctttgcttcaaatccatccagaataaaacgcaaagggctgaaagccatttgttggggcagtggtaagctctggctttctccgactgctagggagtggtctttcctatcatggagtgacggtcccacactggtgactgcgatcttcagagcaggggtccttggtgtgaccctctgaatggtccagggttgatcacactctgggtttattacatggcagtgttcctatttggggcttgcatgccaaattgtagttcttgtctgattggctcacccaagcaaggccaaaattaccaaaaatcttggggggtttttactccagtggtgaagaaaactcctttagcaggtggtcctgagacctgacaagcactgctaggcgagtgccaggactccccaggccaggccaccaggatggcccttcccactggaggtcacattcaggaagatgaaagaggaggtttggggtctgccaccatcctgctgctgtgtttttgctatcacacagtgggtggtggatctgtccaaggaaacttgaatcaaagcagttaactttaagactgagcacctgcttcatgctcagccctgactggtgctataggctggagaagctcacccaataaacattaagattgaggcctgccctcagggatcttgcattcccagtggtcaaaccgcactcacccatgtgccaaggtggggtatttaccacagcagctgaacagccaaatgcatggtgcagttgacagcaggtgggaaatggtatgagctgaggggggccgtgcccaggggcccacagggaaccctgcttgcactttgtaacatgtttacttttcagggcatcttagcttctattatagccacatccctttgaaacaagataactgagaatttaaaaataagaaaatacataagaccataacagccaacaggtggcaggaccaggactatagcccaggtcctctgatacccagagcattacgtgagccaggtaatgagggactggaaccagggagaccgagcgctttctggaaaagaggagtttcgaggtagagtttgaaggaggtgagggatgtgaattgcctgcagagagaagcctgttttgttggaaggtttggtgtgtggagatgcagaggtaaaagtgtgagcagtgagttacagcgagaggcagagaaagaagagacaggagggcaagggccatgctgaagggaccttgaagggtaaagaagtttgatattaaaggagttaagagtagcaagttctagagaagaggctggtgctgtggccagggtgagagctgctctggaaaatgtgacccagatcctcacaaccacctaatcaggctgaggtgtcttaagccttttgctcacaaaacctggcacaatggctaattcccagagtgtgaaacttcctaagtataaatggttgtctgtttttgtaacttaaaaaaaaaaaaaaaagtttggccgggtgcggtggctcacgcctgtaatcccagcactttgggaggccaaggtggggggatcacaaggtcactagatggcgagcatcctggccaacatggtgaaaccccgtctctactaaaaacacaaaagttagctgagcgtggtggcgggcgcctgtagtcccagccactcgggaggctgagacaggagaatcgcttaaacctgggaggcggagagtacagtgagccaagatcgcgccactgcactccggcctgatgacagagcgagattccgtcttaaaaaaaaaaaaaaaaaagtttgtttttaaaaaaatctaaataaaataactttgccccctgc

SEQ ID NO: 1898 - DNA, 55122 bp, Homo sapiens
attcctttttctaaaatttattgagaattactatgtgatttgtacctggtcaatttttacaaatattatatgtgtgcttgaaaaaattatatttttatgattctacattaatattttaaacttgttagtcatgctatttagatcttctatgtatgcaaactttttgcagcttgatctatccctttctgagatgaacatgttaaatctcattgagcataaataaagggtacattatcagatacatatacgttcatgattattgaaacattttgatctgttttttcctttcctttcctttcaaaccatatcagtatctgaaggtcacagaacaagggagtgggagagtgaggtttgaacccaagcctagtgatgaagagtgcagcacttaacctctattctctactgtttacatttaaaaaagttttaaacctctggataaaataattgggaaccagttgacagagtgacaataacaaaagagaagataaatgagacacttacagagacttaattgatcaaacaaagaatactggatttccttcttgcctgcctcagtaaagaaagttatttttctttagtttctcgatgtccgcaggaaaaggattaagagatataacagaagaaattttggacgtacatccactcactgttaattctgttcattctggagaataaattgggaggaaattctcaattcataatgtcctttactctctgaaggggattaatatttgtttccactcttcacaagcatgctagaaaatactatgcttctcataattactgtagtaaaaaatgctatcgattattggcacatatcgtagggcactaagctggctagccccaggtgtgtgcagcattgcagacatatgtcccataggctgtttggattggtgcaaataaggttttggtgtcaataacactttgttttgttgcattccgagcagaccaatgtgattttcttctcttctccaaaggcaaaattatctgggtaacaaatgcaggagaagaggtcccatcattgcctagaagccaagaaaccagaaacaattccaattcagaacaagcagcagaaaccatggaatgcttagcaaagagaatgatgcaaaacacataatccaaatattcagctcacatgacagtggtctcatcggcgggtgagaaaatgcagaagtgggacagagaactgcttgcaaaccccaggtgatgccgccagctcccaaattacctttttgttttttctccggggctgctgacctattctgaggattggtcaaggcatatattgagtttcctttctccactaccaatgaaggtctttatcctctctactaattaattcttccaggaaataatatataaaggaacaaaaaaagggtgaaatttcagttagccacatggctggctgatttttaggagactggaagctggctgaaaatactggccaaaaagagacttctgcattcaggcaggctccagatgatatttcaattatatgcattccattgtcctgccctggcagcgttaactgcagatgtcaggaaaaagagaatagcccctatctgcctcctaaaagaacccctttttcctacgaagcaaaaacacaccacacagccccagcaatggggagccatttgtggtgccaaccgagggggccacagtccctgactggccacagatgtctgcctgcgagtcagcccaacccataaacatcctcaatccttctggcttcagtgtttaggaaccacagtgctttatggctcaatctttcattctctgcagtcacacccataggatctcatccaatttgtagccttaaatgtatgctgataatgccccaaattatatatgcagcctagatgtctcttctgggctccagattcttataccccattgccttctcaatgagataccccaaaggcatctcaaacttaacatattgaaactcagttcagtacgacctcctctcctcaatccctctcctaatctactcttcctactcctaatctactcttcctataacctttctactcttcctataacctttcctagccttccagttgcttagactaaaacctcacagttaaccttaactttctcacccctcatctaaactgttaccaattcctgttagatctgcctttgaagcagatccggtatccgaccattacttgtatcactgccattaccatttggatgaagccagtatctactcccaccaggattgctacaatagtctcctgtctctcagactctctgcttccaccctttccctctgccctccagcctattttcaacacagcagccaaagaactcctccaaaaaatagtcaagggctgcacaccatggctcatgcctgtaatcccagtactttgggaggctgaggcaggaggatcactcaagcccaggagtttgagaccagcctgggcaacatagcaagaccccatctccacacacaaaaaatgagaaaatcagtggggcatagtggcacatgcctgtagtcccagctacttgggaggctgaggtgggaggatcacttgagcctggcagatggaagctgtagtgagctatgattgcactgctgcactctaacctgtgtgatcacataagactctgtgtctaaataagaaagtcagatcatgctatgcctttgctcaaaacccttcaatgtcttcccatttgtatcagtttccttttgctgctctaaccaatgaccacaagtggtggcttaaaacaacagaaatctagtctcttaatgttctacagtgcacaagtccaaaaattggattttatggaactaaaattgaggtgccaatagggctgcattccttctggaagtttcagggttgggagcagaaatctggctgcatgcccttccagtttctggaggctgcctgcctcagctcgtggcccctttcacgagtgactcaagcctcttgctcctgtcaccacgtcttctactcctacctctgaccctccttcctccctcttatgaggacccctgtgattacattgggctcacctgggcaatccaggatactctccccatctcaagattccaaagcccataagcaaagtctgtttccctacataaggtaacaaattctcatatactggtgattaggatgggagcatctatgggggtgtccatttcacacagagtaaaagcccaagtcctgacaatgtcctactagttcccaggtgaaccagaccccacttcctgtataagctcattggttacaactctctccccttcactcactgtgttccagctacactggccttgctcttcctcaacacaagcccacccaggacctttgcacttactgttctctccatcaggagacctctcttcttcctttaagtctctgcataaagggcaccaccgtatgagtgagggtttctctgattaccccttccccagccggacactcccttccatgctcaattttttcccagaactcttaatatcacgtgtctgtcattcatattctctcttccttttttctgtcctctcccactagaacatcatcaataacgggtgttctgtctcttgtcataacccttagcaaataccaggggctcaacaaacagttgttgaataagtgaatcttagtttactggaaaagaaagttccttggactcaaaggtctgccctaaagtaggaacttaacctgaataaataaatgaatgaacggctacacaagagactcaacttacatctcatttttgataggtataaagactaatatgaaagcaagtgctttactacttagaaatcagacataacggtttaagtagcttattcaaggacatacaataaagggaaagtaacacaatcacatattaaaactccagctaagcccctgactttattttgctgtgtccctgcatgttctcagacctgacaaatcagaactcatctagattctcttgcttggctgaaatactagtaccaaaaaggttacaagttaataaactctggatttattatgaaaggaaatttcacagaaatctcaaaagcatttatcttgtatattcagatacataaaaaatatacagggagagatcatcatccatgctttaaaacacccccagaagcaaacctgtagcataagcttcatgtgcatcatcagtgcccggcactgcccatcagccagcccagagcagcatccagatggtcacctcaggtgttggggacacaaacaaacaaaagacgttcccattgggggtcatgtttgttgaggggaaagagacatggggacaatgcaactgacttggaatgggacagcaatttgtcttccagaggccatctcagttgcattttgcaaagtgttatgctagccttcctcacacaccggcaaagcccatgccaactcaccatccagcaacgtctctctgcctgctttttttaggggggtgtgctggggttgtgttttgttcaaactttaaaactgcaattctaggaatccttttaccagcatatgggtgggaaagaggacctcaccatgatcaggaagctggacccagaggagggactgccaggttcggatctcacctctgtgactcactagctgtgtgtcccccacagacatgtcaccaaccaaccctgtctacacctcaatgtcctcacctctaaaaagtctgcttgtaattcttatggtagttgtaggcgatattgcaggaaaaacacttatcttactgccttgcaattccaggccttaatacatactacctattattataatagctgttactatattagtattatattaatgttgactttttaaaaaaatcaccattcaaaaataaatagtacatttgtcttcatcttgagtttagcttgtaacagtgacttctaaaggtttatcatttacttacaactaagtgtttgcctataatcaggaaaaactgctatcaggcaaatgttaagattaagcttttctacatatggctgtcaaaaataaagtcatttaaagcctgccccctcaattctacacctgaataaaaatatacatgatttgttaatggaaagcttaacagaaatgttgaacaaagatgacctcatatagtatttaaataagataagcaaaatgagtaagattttaaaatatatacataggcaagtgtaggttcaactagacattttggtggcaaattattgtctgataaaataattgtttaatatcctacgttgcctcattgcttgaaaaatgaaataagatcaaatgacgtcaaaatatacatttatttttctgtttctactaaccatgctaaccaaggacacatgtcagaggcattaaatgagctttacaccaagttacacaagaattcacctcacacctggagatcctgatttagtaggctggggaggaagcaagtattggagttctgtagaagctccgcagctattactaatgataacatctgtggttattaaccactgtgcaagatctctctctctcttttttttttccccctttcgacagggtcttgttctgtcacccaggctggagtgcagtggcacaatcacggctcactgcagctttgacctcccaggcttaggtgatcctctcacctcagcctcctgagtagctgggactacaggcatgcaccacaatgctcagctaattttttgtactttttgtagagatggggtttcaccacgttgcccaggcactggtctcaaactcctgggctcaagcgatcaccctcttcggcctcccaaagtgctgggattacaagtgtgagccatggtgtccagcccaagatctctcctttgacaagaagttttttgccttgaaattgtttgcaaaaagcgtttcttgattttgtaaccctgctcccaaaacaaaacttgactgcttgcaactcagtaaagagaaatgttgagttgctcctcagcccttaaaaatcattaaataatcatctggtcttttaacactaacaagagagttaagggaaatgggaagggaggaggtgggattttccatctgttccaggaaatcacgtgactgccttctctttagcctaataaggctgccagcagaactctgggtgctgatgggtgtgctctgtgtctcagtcttcctatgcgtaaccattagccccatcggcctcctcataaccttcctaacctcttgccatccaaggtccttgcttctttcattcattcagtcaatgttttctgagcaagtactgcaccccagggaacaaatgcgaaaacgcccctgccctcctggtgcttgcattttaatttctaacaaatggcctcttgaaacggccagacttgtttaaagaactgcttcctctatgtgtttcttaaaaatgatggtattttggggcagaaaagcaaataaccgcagtttgagaaaacaatgtggttcaaaggattaaagaaattagaggctattgagggtctgcacaggaaaagataagggaacttgggaaccttttgcagtggaatgaagcagtaacagaatgactggcttggagattatttccggcaggggacataaacccactctgcaaataggaacgacctggcagagaattaggattcagtggccagaagtaggacctattcccagcaagaacatatttaacaattcctactagaaatgggatcaggagagaggcaaattcacgaccagcagaggtatcaacaacttcaagtagccgtaacaactactttaattctttggtaaaagtttttctaggtcaataaaaaagtaaggggttaaaaagtaagagtgatacttcgataaagttatcaataacaaccaagacccagaaagcttacccagctagtcaacgaggacccatgcataaggctgttactactaaccccatgctttttccactacattatgcagggagctgagcagggtcatctttcatcagcagtttctaagacacgggacactacagctgcagaacacagcatcggggaaggtcaaacctataacagctgaactctggtcaatgacaaatgtttctcaacatttgtcattgttgagacattgggtgtctaggtggagagtagttgccaagaagaggagggaggttgttcagaattgctacattgggataattgttattcatgaaacccagaactaagttcattcatcagcaactttacctagttctgggcgtagaacagtgaggcggttcctctgaatgtggagctctttaagctgggtaagctccccaatttccttaagcagtgagatcaggtctttatccctattgctgagctaaacagaagaaaacaaggagttgtcaacacattttcacattaaaaggtgctccacagaaactctcatcctcctccacgtcctctcttctaccacagctcagtcctttccatttatttacaagtgctggcggataatcaagaaacactatcagaagtagtggtttattcctgcaaaacaaaccttacttctgctcagatttacttgattctacccctacaaggctgcagcagtgaattgattttctaagaatttagataacttacttactatctgcaactttgtgagcttcccaatatctggtggcaggatttcaaaaccgttgtcacttagatagagtgcacacagggtggctgcaaattaaacagcaatatataaacagggtggcatggaacccaaccatttgaggtctgatcaatacgagggagtcagctttgattaataaccctggcttggtgaaaagcctttgacatacctagggctcccaataataacaagcaggtcaaacttacatttactggcttattgtgtagctggtgtgtccaggaaaacatctatatccaagaggactgatacaattaacaacgtgggcactagcattttggggcacagagtttcaacacattttcaaaaaagattgctatttttctcacagattacttttgattcacatttatttctccattttcatccaaagtaaaacaaagaaaactactgtgccacttttatggatacctagggcaaaaagtttctttcgagggaatacaactatgttaaaatagaccttttcctatgtaaatagcactgtgttaaaaattaatgaaaggctttctggtgatggaggctataaccacagctcatcagttccataatctgactaattattactacttgtttctacagccttaaggccaaaagtaaatgaagaaaaaggggctaaaataatggcatgaagttaacagagtaaatcctaacttcagcggaatatcagcagtcagaaatcctaacttaagcagtaatatcagtagtcagaaattaagcagaatatcagtagtcagaaatttgttcacaattactacacaatgataatatgattacaaactactgaaggctaaaattctaaagcatctgtttatcctcaaccaaaaaagctgagtataattagaggtatgttttgtttatcagtatttatttattttttagagacagagtctcgttctgtcacccagactggagtgcagtgggtcactgcagcctcaaattcctggcctcaagcaatcttcctacctcagcctcccgattagctaagattacaggcacatgctactatgcctggttaattttttaatttttgtttctagagacagggtctctctatgttgcccaggctggtcttaaactcctagcctcaagtgatctttggagctcagactccagaactgtatgttaatgtaacataataaaaacaggtgttccactgcccaagaaaatattttacagttggtttcatgtgcttgagaaagtcatagagataatgtatataaggtaaaaagtgaaattttagagaccagctcagaaaattcagattttctgaatgccacataaattactaattgaagaaatagaacactcatttaagagaagcaaactttgtctgaaatagtgcatgagttcccagaggaaaccattttttaattttcagaagcatcttcagcaagaaatttgttggcatataaaagaataaagtgtgttcacctatggccaataatttcttaatgcctgtgtactggataaataggtcaataagagtactttttaaaaggctggaaataagaatcctggctagaaaatttaagaattctgttagtgatttattaataaatatttttataaataactgattcggacttcctgggcaaatatcctgcaaagaattaataccaacatgggaggatacttttttttggcatgctatttaaaaagaaagtcaagtctcttagctaaatgtgaggcttgatctcatttaggtatataatctctctcagaatgttaatatgatgttactaagtccacttcagcccaacggtgtcacataacgatatatcaaatgcacatactgctgagctactaaggaatattcaaaaggagtctctaaagaaaaaattatctctgtccaataatttctcttggagtttaggtcctggcaaataaatttcactctgagaaggcaaagtatagtgttgaggagatttatagaactgaaagtttcttactcaggtagaagtttccagggggccgggcgcggtggctcacgcctgtaatcccaacactttgggaggccgaggtgggcggatcatgaggtcaggagttcgagaccagtctggctaacaaggtgaaaccccgtctctactaaagatacaaaaattagccaggcatggtggtgcacgcctgtagtcccagctactcgggaggctgaggtaggaggaggcagaggctgcagtgagccgagatcacgccattgcactccagcctgggggacaagagtgaaactccatcttaaaaaaaaaaaaaaaaaagaagaagtttccaggaagagaatttccgttcaagttgtaagtcaagtccagaacctcaagagctggcagagagcagaagcctcgtggcaaagtgttcagcctgttcatgctgttgcagggggacaaaaatctacatcaggacaccaaagacacatttatacagactatcaagagcacctctgtttcacaggctgaaagtgtaagagagtgccatgatcctagagtcactttatttttattttttatttttttgagatggggccttgctctgttgcccaggctggagtgcagtggcacgatcttggctcactgcagcctcgacctccatgggctcaagcaatcctcccacttcagcctcccaagtagctgggaccacaggtgcacaccatcacaccccactaatgtttgcattttttgcagagatgggtttttgccaggttgcccaagctggtctcaaactcctgagctcgagccatcctcctacctcagcctcccagaatgctgggagtataggtgtgagccgccatgcccatcctattttttttaattaaaaaaagtatttatttaatatttacattgacaaatgaagattgtacatacctatgatgtacaacatgatatttctgatatatgtatcatccatcgtggaatgccttaaatcacactatttatatatgcattgcctcatatcatatgcttgtcatttttttgtcttttgtggtgagaacgcttaaaattcactctcttagcaattttcaaatatactacatattgttattgactgcagtcaccatgatgtacaatccatctcttgaacttacttctcccgtctaactaaaatttcgtgtcctttggctaacatctccacaattcccctctccctccagcctctggtgaccattttattccctgtttcaatgaggtttacttttttacattccacatataagtgggatgatgtggtatgttgtcctatttaaactaataattttagagagcttatatattcctgaaacatttggaaatttcttagttgtcatttttctccagtggtgaaatttaatcattcttttacacaaaaactcaaaccatcacaaaatatctgtccttgtaaagaaaaacttcctgatgaatgtagtaataatatctgaaactacacacatgaagctttgtagttttcagatttttgctttatttcatttcattttttccttttaggagggaaaatcatgtttttttttttctacaactgttaaaattcaaagttatcttcaattagaatggtgatggccaggggctggagggaggggcaatggagagatgtattttagtgggtgtaggattcaggtttgcaagatgagaaagttctggagattgactgaacaacaatgtgaatacgcttaacaccattgaactgtatactacaaagacagtaatttttttttttttttgagacagagtctcgctctgtcgtccaggctggagtgcagtggtgagatctcagcttgctgcaacctccacctccccggttcaagcaattctcctgcctcagcctcctgaatagctgggactacaggcatgtgccaccatgcccggctaatttttgcatttttagtagagaaaggtttcaccatgttggccaggatggtcttgatctcttgacctcgtgatcctcctgcctcagcctcccaaagtgctgggattacaggcgtgagccactgcttggccagacagtacattttatgtgcactttatcacaacttaaaaattttttaaatcgtacaattgactcttgagcaacatgggtttgaactgcctgggtccaatgacacatggatatttttcttctgcctctgctacccctgagacaagaagaccaaccctcctcttcctcctcagcccactcaacatgaagaagaggatgaagacctttaagatgatctacttccacctgaagaacagtaaatgcactttgttttccttatgactttcctgataacattttctgttccttagctgactttattgtaagaatgcagaatagaatacatataacacacaaaatatgtgttaatcgacatttatgttttggtaaggcttccggtcaactgtaggctatttgtaattaagtttattcagagtcaaaagttatgtgtggattttcgactccatggggggtcagtgtggtgctccctcaacccatgtgttgctgaagggtcaattgtgtttgggtgggtgcgggggtgtgtggtgtgtgtgggtgtgtatctggtgttgtgtgtagtgttatgtgtgtgtgtacgggggtgttatgtgtggtgtgtggggggtgtgctgtgtgtgtggtgtgtggagggggtgtggtgtgtgtgtgatgtgtgtgggtgggcatggggtgtgtgtgttgtggtgtgtgtggagggtgtggtgtggtggtgtgtgttgtatgtgtggtgtgtgtgggggtatggatgtggtatggtgtggtatgtgtatggggtgtgtgtgggggtgtgggggtgtgtgtgtttacgcagtatgtgtgtgtggtgtgtgtgtgggtgtgtgtgcgtgtttgtgtctgtgtgtgtgtctccgatgaagtctaagggaatttttttcttttctttttttttattatactttaagttctgaggtacatgtgcacaacgtgcaggtttgttacataggtatacatgcaccatgttggtttgctgcacccatcaactcgtcatttacattaggtagttctcctaatgctatccctcccccagccccccaccccctgacaggccccggtgtgtgatgttaagggaattttttttctacactatcttttatccttttctttaagccccttatttttcttaatgccgttccctttgagcacacttaaaagccaattaaaaattaaactttaataaaagttgacagatattgaaaggtggaagggactgtgacaataaaaatcattctagtcatcgatgcttctcataacagatccagctcggtccagtcctaccaagtgggcctcaccagaaacagcagacagcagggggaaaccaaaatggaaacgtgggttccccctctcaggcagaaaacgacccagacagactacacccagcaaaactacctccacgactatctactgcaatgacagcaacaacgaacattctccatgaagtcacaaatttgtgaagcacattatggcaagtacttggcttgttgtattaccttgtaatacaggcaagatggagcttgtaattaatgctatcttgagatgaaaaaaaagcctaagagagagtaaggagcaaagatttcagaagtgactgatgaaggtgacatgtgtctggaagcaccctgtacctcatggaggtcctccctataacttgccttactgtgtgagtataattctttatgccatttgaggacagaggtatcctttagtgaaacccatcttagctcctttcccaaagaactgggaggttttttcaaactttgacaactccgtctatgtagctgtgtagttaaatacaaaaagctttacacaatcaataaagcaccaatagccccaaatgcaaacaactccaaagagaacaagaaggcaactaagatgcattcattgaaaaagaaaagtttagggctgggtgcagtggctcacgcctgtaatcccagcactttgggaggccaaggcgtgtggatcacctgaggtcaggagttcgagatcggcatgaccaacatggtaaaacggcatctctactaaaaatacaaaagtagctgggtgtggtggtatgcacctgtaatcccagctactcgggaggctgaggcaggagaatcgattgaacctaggaggtggagattgcagtgagctgagatcgtgccattgcactggagcctgggcaacaagagcaaaactctgtctaaaaaaaaaaaaaaggaaaagaaaaagaaaagtttatggctctgtcctatggtgcctcaaaccaaacagaaaaaaacctgagcttattattttcttcccaaacctgtctccatctgttctatttttcagctgtccgacacagaaacgtaggtatcattccatcccatcagttactgtctgtcaatgttaccacctgtatatttttcatataaaatccctccctgtctccactgtcactgtcctagttcacatgggacatgaagctcatgttcttactggtctcctaacctctagtttccatccctccaccctcttctccacactgatctttcataggaaaatctgaccatatctcatatccaccacttggctatgcaaatttctcaatggtcagcatgataaaattggagctcgtttatttatttacttatgtatttttgagatgcagtatcactctgtcacataggctggagtgcagtggtatgatctcagctcactgaaacctctgcctcctgggttcaaatgtctctcctgcctgagcctcctgggtagaatacctgggatcataggtgcacaccaccacacttagctaatttttgtatttttagtagagacaaggtttcgccatcttgacaaggctgttcttgaactcctggcctcagctgaccctccagcctcagcctcccaaagtgctgaggctacaggcgtgagccaccacgcctgggaggagcttgtttatttagcacagaggactttcattagcacttttgattccctgccattattataaacatttatttgtttatagttggtttcctcaactgtaatggaagctccatcagggctggatggccagtagctagaataatgcctggtacacgattgggaacttggtaaatcctcattcactgaacagcagatatccaggattccctgtctagcctgacctctgaccttacagccacctgcctcacactttatactcaacagtgccaaaaaaccgacaattcctaggccccaggcaggcagtgctgtgagtgtttaaatatgtcattcgcggctgggcgtggtggctcatgcctataaccccagcactttgggaggccgaggagtgtggatcatgaggtcaagagattgattgagaccatcctggccaacatggtaaaaccccgtctatactaaaaatacaaaagttagctgggtgtggtggtgtgcacctgtagtcccagctacttgggaggctgagacaggaaaatcgcttaaccctgagaggcagaggttgcagtgagctgcgatcgtatcactgcactccggcctggcgacaaagcaagactccgtctcaaaaataaaaataaaaataaaaaaattggcaaatatctgtccagcatctattgccactccacgtcaatcactaatttaaccagagcatttagtggctacaatttaatgagtatacgactttgcacagagactgaagcatgagtgggcagtttcatctaatagctgtgccaatgaagatggaattctgatgctgcagttccgcttggggtctatggatgtattcgtctgttctcccattgctataaaggaatgcctgaggctaggtaacttacaagaaaagaggtttaactgactcatggttctaccggctgtataagaagcatggcagctactgcttgtggggaggcctcagggagcttttactcgtggtggaaggcaatgcaggagcatgtgtattacatggcaggagaaggagagcacgaggggtcttgcaataactcactcactatcataaggacagtaccaagaggggatggtgctaaaccattcatgagagctccgcccgcagatctaatcacctcccaccaggccccacctccaacaatggggattacaattccacatgagatttggtggggacacagatccagaccatatcaatggagtctgatggagcctttagacccagaaccatggggttctcttcccagcttggccactaacctcaggggtgaccaggacccagtcccttagcccctttgaaaaggcttggcttcctctgtataaaatgaaagcactaaaacctgctttccctacctcacaaatgttaagaggatcaagtgctgcaaagcaatacacgaagacaggttatcattattattatttaccgctccccggttctgcaacctcagttgaaccaaaactcctctcttcacctttgcataaagaaagacagaggattgtcacctctcaactacagagaagaattgcaaaaatgaatgaagcagcattagggaatatattcttccctccatggcatgaaggtgctttataaactattcctatttaacacagacagaaaaaaaatcaaccatactacaacttgtctgtcagttcacgttatgcaaataagtcccttcttggtcaacagaactgagataaaattttactggacacaaaatacagtaaaaatttaacttccttattgtgccaactattagcttctcaattagctctcaaatcttcactaatgtaggccaccaaaaggacatattaaaacaataaaactttttttaaaacccaaaacacaaaaagaaatcagaaatccacttctgtgtaatgatataaatggaatccctcccctggccctacccagcacgccccttccactctctttctctccatcctttcctctccactgatactcacccaaggttcaggtgtttgagtttttgaagcctgctgatctgtgttggcagctcctcgatctggttatttaaaaatttgagcacttccaaattcttcagttctgctgtgtttggtggcaccaccatggaaacataaatgctgagtgtgaatctgggaacggaactcctagcaagggatggcagcagcacactttgtttttcttcaaagctaagaaacatataactccaaaaggaccatcgaattcacctatcggtcttacttattttttatgggtttttcataagcagtcactcacttctgagtggccgctgaaatgctccttcgtatatcattagctaagtgtttggcatagtttgtttcagacagacaatgaagagggaaacagagcaaaaaggcacaaaagagaatttctgtaccatagcagcctataaaagtgaatattacgaagcatatacacttatagctgtcatataggatcttttaagtgcaattgtttttttctttcggttttcttgcattgccaccagaagaaagacagcaacctccaaatcccttcctgggtgacatacattgaagctgtttaacccagtatctgaacagctgtcctcttaacattgcattatattagctcaattttaaataatgaaatattcaatctccctagtttctgattttggcctctggagtaatgtatcttgaacaataccacacacacatacaaacatacacacatacatacacatacacacacacacaaatgttacatcagattagcaacacatcgatatactgttattatatggaaataaaaaagtcaactcagtaacatgctatgaacactagtgtgcagatcaaaggtgaaaatcaaccactggggacctgaaaggttcctccttccctagcatatatatacttgaaaatacaaatgtaaaagccaaaggcatctttatctcaaaagtacaaactataaattggcagtagaaggactttccataggctgtaattcatctatcccatttgctattcaatcattctacaaacatttgtatgggcgataagcttggccatggttcatgtaaactctgataccaagactatccaggtaactaaaaacatgaacagggacctggagcccagtctgaaaaagtgtgatatctcatatcagtcaggtttacttcccatcccatctgcttcctccaggggtgccccaggaggccagaaaaccaacctgcttgcctgcagtcagacctaaactcagacccaagagcacttgtgatcagaaccagcacaaaggtgagtgtaaaatgccaaacatacatctaaaatatttaagcagctagccatttcaaggacaccaattgataactcctagggcaacaaaattaaaaggacaggcacattgctaattatagttttgagtaatcattttcagctttctgaaatgtctacagtatcgctgacctgatttcttttagagtgaatgcttggtgaaaggtaaaagaaatgttttcactggaagaagggactgtgaagaatacggattactctgaactagggcacatgggcagggagcagtggtctagtgagcagtccctgggtgagctcctgaagtggctgttgataaaagaacaggttttcatggggtaatctagacagctggaagttcctccagaaccctccctcttggatacctgcaggaattgaaaggaatcctacctgtacaatatggacacaaatgcacattcttaggtgcacactccatggaacacttctgtggaaatgaatggtattcaccttgtgtaagcaattatcaagaaaatcaccagggccaggagtggtgccttatgcctataatcccagcactttgggaggccgaggcaggtggattacctgaggccaggagtttgagactagcctgaccaacacggtgaaaccccgactctactcaaaatacaaaaattagccgggcatggtggcaggtgcctgtaatcccagctactcgggaggctgaggcaggagaatcacttgaacccaggaggcagaggtggcagtgagctaagatcatgccattgcactccagtctgggtgacaagagtgaaactctatctcaaaggaaaagaaaatcaccaggctgtgtcttctaggtcactggatgtcatctcctccccccagatcataaagtatatacagtgcagctgcccacagacctcatccctcccctgtccaccctccagctaccactaagccttcatctgattagtttgaagagtaataacaaaagttagtgaaatcaggagaaaacgatgatctcaaattagccacaaaccaagaataatgcagccagaattactgtcatcttcccaaagttactctgccagttgaattaaatgctcgtctaaaggtatcgcctttttgacaggatgagagattatttcactctccttgctaaatcagtccaatttaaaaccacaaattatgctaaatgtggtttagggctttgtcttgtggatgcaaacaataacctcatattcaatttacaaaacctctcccagccttttggtgagcatgtgaattttttgcttaagactccattcaagctagatgagaaaaaaaattacacagctaatattctccctaatatacagaattttttaaacccccagtcatagtgaaaatctaaagaaattaacatgcagacccatctggatgggatggtattcactctttgaaccaatacttagagaatgctgattaggtgcacagcaccatactttttacacatagcatctcaatactttggggataaagtaggagaggaatgttacttaaggaaagtaagttacaaaagatagggtatcaaagtcaataaactgaaacaggcctagtgcttggaatataaactactcccaaccaaactagttgtccagaaaaaataaccagttagcaatatgaattgtgtcatgactaaatcatatacatatgtggcaggaacaattttagctatttcaaaaaggccactgcgatatcttaccagtcaaaatattttattggaattttccaaatagctataggatgcatgagcaagaagcatttaaaacctaatagcgtgcatcagtatatttcttatcatgtctttgaaacgttcctttttcatcaatctatccagcttctgacctatgaccccagctgacctatgacatcaaagaaactgaagagcaatgtggtccttggccctacagtgctgtgtgtgcccttactcaactcataacctctctgggcctctgtaaaataagaagactggattatgaccatttccaaggtctcttccactttgttttaacattctaggattctaaaaggagatggattatgaaaatcaatgatatggctttaaataattcaacaaatggggccctcaattaggaagcttagtcatgtagaactttgcttttgacaaagaattgagtatcattttctgcctagccaaagacggttgctttaagtttgagacttcagttgctaggtttgggggaacagtcccaaaggactcagacattccctggctcctcaatgtcacattttgctctagccgcaggatcacaggactgctggggatgctctcgtcccagagcatctgctggtgttttggaaaggtgacaaggatgtggtcacatcaccccagagacaaatctcaaagtttcttctaggctctgcagcagttccacctaacacacctggcatgaccttttttccttcaagttctcctaaactgaagaacctgaatgtgattcaagagttttgtccatctgatgtgccagccctagacttggcaattcagcacccctgactcctgcagcacagtttctggaaggttccacaagcagcccaaagtgcctgaagggctcattaacttctctttggctggaagcacctccactttgctggacaggctggagaaaccacagtccatctgtgcgaaacactggcacagccccttcctgagcaacagctttactcctaaaaggacatgtatctacggccattggttatatctgcaacaggcatgagccacccggcactgcacagttgatgcacattcacaaaatcaacaatcaatcagctcaagaataggcttcccccaaccagccagcagcccgcaaactatctcccctccacacgaagaatcaaaatcaactactgttataacaatagtttcaattctgttgaattgagtaaggaaaattctgttctatgatctaaaattaataattccacaaccaacaacttaaagcattttaggagtttacacaataataattagcagggtgtgttctggggctgggctatctgatggacagccactagctatatgcagctatttgaatttaaacctagattaatcaaaaataaaatgatgaatgctattgtttggtcacagcagccacatttaaagagctcaatagccacatgtggtgtctagtggcttcactactgcatggcagggatactgaccgtttcatcaccacagaacgttctattagacagccctgctctatggcagtgggtctcaaaccacggagacatcggaatcaccagaggccttgctaaaacacagatggaggggtatcccagagtttctgatttagtagtaggtttggggtaaagcctgagaatctgaatttccagcaacttctcaggggatgctgatgttgctgttctgggaaccatattatggctcagaaaacttttaattcattggcagcatcacgattatcgatccaacacatatgtcccttaccccatgcaataatgcgatgagtataataatcaatcttatccaaatgaagacgcctactgagcctggggattgatgagaagtgaaacaaatgatactctagatagctaacacgttcaacgtgggtgccacaatcaaaccctttctagtcaacttctgcttccccacacaggattttatggtaagatcagtattgcttaagatggacaatgttccagaggagaaaagccttgaattccctagcacactgaattaagtcacttggtggcaaattcatcatgaccaagggtggccatacaaagagatgtcacctgctatactgctcagcttcaaaacactgaaccttaacggcaggatgctgggtggtagtgatggcacagacagaccggcttgggtgcagctgattagggggctttttgagcaaaagcatcttgtggcccttgaggcaaagaaacaaagctgtaaggagcgacagactctgggagcagcaggcacaatgcaaaaacataaggacaggaggtctgcttgggtgcagcccacgggagggtgagggggtcacactttggtctttagagtcatatggttaccagcaacagtcaggttctcttcagctccagaagggcagcactagaccctgcaccatgataacgcatacccacggctgccaggaagccagaagctgctccaaacacatggcactttccatccacagcacgggcatgaaatctggcggtgacctccacccaccatctccaccaaacttctggggagttgggggctgcactacacccaactgtttttgcagaagcaccaaaggatgtttttagagctagtgattcctgagctagggctggcccagagcatgaaagccaggggacaaagcctctttgaaaaaagtgaactgatgtctgaacctctgcttccagtgatggatggtgaattacagcaagggaatgaagaggaggacttagggcaggcaattgctcacagccagggctaggacagcaggtggcacaggggcatgcccgcccttgtgctgcaatggaggcaacatactgtgctgtgcccatttccaggatgcaaaaatgccacctaccctcaggccaaagggtccccaaagaaaccacatggaatgagtcacagcaaaatgaagctgagtagcattgcttctaaaaacctgacatactgctattttaaaaaaaggaggtttttgtctgttgccgtaacaaatgaaaatgcctggtcagatgttcacaatgtcgtatatttctacagctttttaaaataaagcatagaaggatagaggatggtagaggatattaaaatgagcttgtcacttagataacttagtatgttacattactacaattaagttactagaaaaaccactaaaaacctgagaatagatgaaaatgagtgagattattcattatatatacgggagagggaaggaccacttatgagaaaatggtgaaagtaaacatttccttgccccagcatttgatgaatatgatactgaaaaacaagtgcccctctttggcctgaatgaagcaagggagaaaaaaaacaaattagcagaaacgtgatgaaatatgacttggggcatccgtggtcaaagtgaaagcacaggctttttaatctctagccataataactggagaacattagtccattcacagcacaaaggtggtgtctagactaattatagacatgccaagtctttcagcaaatcatagttctcgatgccattttaatgattttacataaagaagaatcttctcactctcgcgtaggaataattaaactattcagcactttatatgcaaaaaaggtcatttgtagttatactgattaattaccttcaagtcctcctaagcactttatatgcaaaaaaaggtcatttgtagtcatagtgattaattacctttgttttctggccaaaaacacaaggtggataatgaacttattacatattaccataagagtttgaaattcgaaagtatactaatgataactggcttcacagattttacggaatttcacccaaagcagctattaaagcagtgaattacagtagttctaggttatttaaagtttatgaaacagtgaaacaaattctcatttaaaaggttctacatgttcctcaaggtaaacataaaatagcaaaatatcgaagcatctaccccaagaaaggccaacaaatattattagctttataaataacaaagttctccaaatattattagttttataaataacaaaggcaatgctactttcagttaataaacaacaagtatttactgagaacctgtgccccgaaagcacatgctcactctatgctattatgagccgcctcaggattctatagcctaagttatttagtaaacaaaaatgtccctggcttaactcactgcaacacaatggtcctactctttcagcagcaatgtgaaaatgaattgcatgaaaattagagaaaaaaggtataagcaagtaataaggtagattttagtgtataaagccaaacgtgcaaaaatatatgttcctgagctataaaaaggtgtatgcataaccaaacaaatctcctaaaaaactgacaagcatagatttcttctcctctgagcatataaaaattagttaatttctgaatcttgtgttaacttccaaagcatcttcaggaggacatatgaactctgaattcttgcaggaacaccgcttctaaattgcactccagttctgatgcgctacccctccagcaaagccatacatgaataaagagctttaattggggagctgggagggagaagcagcgctgagaggaaaggaagtggcattcaatggcattcagtggcctggggaggaagtgacatccagcgaagggtaagaaaaggaagggtaggaaaaatgcccaggaaattccaaaacaccgggaagagagagaaagagaatatgaaaaaaaacttcaacccatcaatggagaataacaagctcagtgttataaaaggagtgatctaggctcttttatatgagtacatgtctttattatgtataatatatatgaatgtatatctatatgtaagcctcgattattaacattacgaggtagacagtaagcaagtcacattctatcttgcactctcttacacgcacacataaaaagcatgttttgtcattagtttctgtcttcttttacaattaagaattaatctaggctgggtgcagtggctcacacttgtaatcccagcactttgggaagctgagatgggtgggttgcttgagcccaggagtttcagaccagcctgggcaacagggcaaaaccccacctctacaaaaaattagcttggcatggtggtgcatgcctgtagtcccagctactcaggagcctaaggtggaaagatcacttgaacctggaggttaaggctgcagtgagccgagattgcaccactgcactccagcctgggcaacaaagtaaggccctgtctcaaaaaaaaaaaaaaaaaaaaaaggaattaatccagcaagaggccaaaactggactgcttcttttcctactggaccttatctttagggtcactgcatgaggagggcaggaatgggagggaaaggaagaggcccagggctgggaaaatccaccaaatccacatgggagctttgatcttcccctttgaactaacacagctatggcttttaaccttaggaaatgtccctgttcttctaatggaatgagtaaggatccagagccacaggaacactttgtccatggcgttcctagattgacctgatggggcatctcaagtgcacaagtgcacacacacatcacttgcagagacagcaggggacatggtggagcagccacttggaagccatgcagaaagctctgtcgttccctcgttctggtcacttaaccactttacacctgtttcctccacgtgatatagagtgggggttcaacaaatttgctcttttccctttcatctcctgctgaagttattacataggtgttgttcttgatggtccccaggctgtggggtaccttgtatttctttccacacattgctggttcagttggatgaaaaggagggcttcacagagaaagatgagcattcatctcaactttctgaaggatgagcaaaattcagagagaggggtaggaacttaagattttagaaaaaaacaggtaactagaacaaaaaatatataggcaggggaaaagaagctaaagaaatagcaaaaaattagacaaaagagggttcagactgaaaacagcaaaatgcaaggtccattagtttgttaactggttatcaattgtattcaagtggttttggcctatgaggctgactgacgaagaaagcgaaaaatggaaatgggaaaggtattccatttaaaagtatctgcatgtgtccacaccatgttccattcaagcctgggagctaaagattacaaattcttatttaaccaaatgtaaatttaagcagataaataaggtggcacttatcaacaatttttaagaagccattaagaatgagttctgtgatgcattaaaaattatctaaagttttaaacaaatttccaagaagcatctcctttaagaaatagcatcactaggccaaggcagatagatagcttgaggccaggagttcaagaccagcctggccaacatggtgaaagccgtctctaccaaaaacaaaaactagctgggcatggtgatgcatgcctgtagtcccagctactagggaggctgaggcagaagaatcacttgaacctgggagacggaggttgcagtgagccgaaatcatgccactgcattccaacctggatgacagagtgagaccctgtctcaaaaaaaaaaaaaaaaatagcatcactatgtccacactgcgtacaaacatactagtgttatcttcacccaactctggagtttctaaatctgagctacgtagacctctaaaaaattcatggatgaacacaatgggatccataagcctgctgaaattagaaccatcacgtgcacttctctatggatcagggttgtagttttcactctattatttaaaaaagtcagtgacttaagaaaagttaagaaggccaggcacagtggctcacagtggcctgtaattccaatactttgggaggccgaagaaggaggatcacttgagcccaggagatcgagtccagcctgggcaaattagccaggcgtggtggtgcacatccatctaggaggcttgcttgagcccaggagtttcaggttacagtgggctaggatcatgccactgcactccagcctgggtgataaagacactatctctaaaaaataaaaacataaaaaaagagaagagatgctctagaagaatgtatgtacctaagtatcgcacttcttagtgtatctcctctaacatcctgtacatacactcacatgtacacacacaccaagttatttaggagagagtgcatcaactgaaaatctatgtataatattttgctattacatcaattctgtttgatagacattctatcatcaatagcaaaagaaatctttttcaggatcagccgtgcacatgggctaactaggagttggaaagtgacagacttacactcccccatcttattttctccacagcctgccaccgttctgaagttctcacgattggggtggttccatttaaaaatatactgtggaggaattagcatgttagctagctgccacttagcacagtacaggacctcaagaaaaaggattctggaacaggtacattttggttggtggggccgagaacaaagagaatgggggcaagggggtggccacagtctacaagctgagaatagataagatgccatcgggcggacacttcttcaacttcacccgctggccttgggttgcactggttctgggtccctgggtcaacagatcctcccatgggacaatctcaggagctcactcactaaagacaaaaatagcaacacatgcccaattgccagtgatttctgctcctctcccttctgccaccctccaccctattaaatgaaaagaacattccatgctcatagataggaagaatcaatattattaaaatggccatacttctcccccagatttacagattcaatgctattcaatgcattgaatgttaaaacccagattctcaccgtgtgcaatttgtcagtggccaatgtggaagaactcagaagtgctccttaaaaaatactgaggtctcggggcaggcacagtggctcatgtctggaatcctagcactctgggaggccgaggcgggtgctctggagttcgagaccagcctgggcaagctgggcaacagagggagacttcatctcacaaaaaaaaaaaaaaaaaaaaaaaggcagggtggtaaagaaaaggacaggcagcaccattgcaaggacaggtagcaccattgcaagctggagccaaaatgatatcacccctgatgggtcctcctttttgagaatcccattatctcctatgaatcctgatgttctgaaaaaaatgtgtgagctgcttggctaagttgcaaatgatggtagagtagattctcaggactgtattttcatgctgtttcctttctttcaatgtaggagacaatgacttggcccagcagctagcagttctctgtggcagagagatccctgggcccatccggtctactgagagtacacattcatccgcttcaccttggactccagtgtaaccagggcaggcttcaatgcatcctttcacaagagtaatgagtttaaatatttttttaatcccatgttatcccatctcctctcctttcctctctctttctctcttcttaatatagttttctgggcaccaggacgcaaggcaagtcagaggacatgggtctctgcccaggttctggatggctggctccccttatgtcaatgctgagtcctgatccaaagcactgtggccaagtagtacaaaagtgtcctgccttaaggtctctgggtggggcatcttcactccagaggaggtgtgtccatggaatgcatgagagagagctttaaagcaatttttcagcctaactaagggctggaactagagcacagctcatatccataactcatcgaaggagcaaaacatcatcatttatccttataaattacttggttaaagtcatccatttgagggttggcaggaagagtttgttgctcttgaaatatgaacttgatgagtcaaaaacaggcaccatatatgggatgccatcatgcacaatatgattgagacttttaaaacttgacatgtgaagtccagtaacagccttaaatccaaatcaaatgaaaagtaataaagtagtccatggaagagtgaaagactcccatgtttttaactgtaaaacataattttaaagtagattctcaatctaacattaaaaattaatctaatatttcctccatgcttatatataccttttataaagtagggagcaactgacgataaattgtgttcctcacgctcaacagaggaaggctgcatagtggcttaagagcatgggctttggaattagacctaagataaattttcacctctgcaatttaactagctctgtgagctgtctacctttccttgctgatgagcttctagtccctgaaaactggagaattaatgcctgctcctttcatcctcttccttcatctcctgccctctcactctcatgtatatattaatatgtatggcagttcattatacatacatacatatgtatatgtatatagtgatggtagaaccattgtaatttatttgtatgtgtgtatatatgtgtgtgtatgtatgtatataatatatataaatatgtgtgtgtatctatgagtgtgtgtgtgtatatatgtgtgtgtatatatatatatatacatggcagctcatggtctagaatatatttcaaatttaacctgtgatataatggactttggagactcataagcaaggaggatgggtggggtatgagagataaaaaactatatgttgggtgtaatgtatactagtcaggtaactagtgcactaaaacctgagacttcaccagtatgcaattcatccgtgtaaccaaaaaccacttgtaccccaattagatagatagatagatagatggatagatagatagatagatagataattcataacaaaaaaaattaacctttgaaaactgaacacttaattcccacccttttccatgccactacccccgcccccagttctacactcctcacaatgttagcaaatggaaagtacatttttctcattatttaaggcaaaaatcttgatgttatttttgatgtttctgttggtctcatacttaaccatcaacaaatcacactggctctaccctcacaatgtatctagatttcaaccacgcccctccatttctgttgctaccagcctagcccatgcgcctatcatctctccttggcctcaggcagtcccctttttattggacactctgctcctgccctttgctgccctccactccttacagtttaaggactgcacatagagtgatattttcaaatgtaagtgagatcatgccattctgaggcccaaaacactttgtcttcctcttcttactcagagtaagtcttttcagtttccagcatgacctagacatgctgctacctttggaatctctcattctgcctcatccattctgacttccatgatgtacctctaccacatcaagcctttacactaactgttttctgaactggaatgttttctcccacatatccatctggcttgattcttttatttcattaatgtctctgctaagatgttactccaatgacgtggcttttccaacttaactctgacaataaagtacccttctccctcctcccgtccatttttctttatagaatttatcaccatctcacatattatgtatttgtttattttatgtcttccccatctataaagaaatctttatgaaagtaggtaatttgtcttcattacttacctctatatcccatatctcagtcaaccaccacaaactgagtagccaatagcatatgctcaatacatgcttgttatactaatcatttcctacactctggctttattttcaagaatttttattgcctacactttgaaaaccccccaagaaaactaagaaagcataaaaatccagttgccaatcctatttaaataatctacctttgtttctttgtgggaaggctgcggcggatatttgcatgcagacacgggatcattacgtcccccaagtatccggagacctacccatccaacctcaactgttcttggcacgtcctggtccaaagtggcctgaccattgctgtccattttgaacagcctttccgagattcttcttgcaaccagggggattacttggtggtaggtcttgcttgctaccctttctaattacgttttccatagacttcattcagaaaacaaaatgataatttttctctcctgggacataaatggataagaattatgtactctttcttttgcaatgtaaaggagttgatgcaattttaatttgtctttccagctaagaaatggtcctgatatctatcctccacccttcggaccctgtggaggaaatgttcatttttgtggcagtcgtgcttcatcgactctgttcacctcggataatcaaatgtttgttcagtttatttctgattagagtaatgaagggcaaggatttcagatcaaatatggggaaaagagtttacgtaagtattttcactgagaattatatatacttttcctgcaattgcttggtcttctttgattaaatagatttgagaaaaaacatataaagttttcttttctgaactaacagtaatagaattaataagaatgcctactctcaagtacttattatgtttgatacattcaatatctcatcgtgactacttttcaagtaaagtatcattatttcgattttaaagataagtaaaatgaggcttggacttttccaaggccacatatctaattagtgaccaaagtgaaatgttccatgagtataagatacgctattcttcttgatccctgaaattccttagacctttccattataagatgtctaattgtaagttaaatctagttatagaaacattataagaattacatttgccctattttgtaataatgtgtatgctgtttttaaaagaatacataatcttttgattctattattactgatttaattatatattacctaagatctttacttaattgcttgtacttaattacacttgattataattgcatttaattttactgtaatgatttgattttggggacatttactttttagtaatgtttaattgaataaataaataaataaataaataggcatcacttccaaaaaacggagtaatgtcagtagaaagcaatataataataaatttttgctctgtcccaccagaagttagataatatagatttcaaaatgatcctattacttgtatcccagattcctaaatgcatttatatatatatatatatatcagtgaaatcatgttttattgcacattgtatgaaatttaaagtcaacatcatttcttcattttgctaaaagaaatgagtaagagtgtttaccaactgacacacaaaaataatcgaatagctggagtaaggtccaaaacaccagagaaggggctttggtcacttcccagtgcacagagctgtggcacaaggagggagctttaatgcagctctgtgggcatctgcactatggctttctaggctgggaccttctcatccctccctctctccatgctgagctttgcagctgagtcatgaattggcaggttttcacctggtaccaaagcatttcaagagtagcagtgtcttgagtctagtgagtagatgtcagcccatcctataggactctacttttctatttttatttatgataaactcagtctttttttctttcttgagacagggtcttgctctgtcacccaggctggagtgcagtggtgcaatctcagctcactgcaacctctgcctcccaggctcaagtgattctccttactcagcctccctagaagctgggattacaggtatgtatcatcacgcccagctaatttttgtatttttggtagagatggggtttcatcatgttgcccaggctagtcttgaactcctgagctcaggtaagccagctgcctcagcctcccaaagtgctgtgattactggagtgagccattgtgcccagccaatagacttagtcttgatttaaatttttaaagtcaacatttaatggtaattcagatacactatttgacattgcacctcttctatttctttgtggactcactgttcatgcaagtatggtcatggctgttgctttctccctatctttcttgaagcttgttatgactgccgttaacatcagacttaaacaaaagtattttgatttcacaacctattgttggcaacctgaaacaacagcatcactcttatttctctctacttaccaactcaatcatgttccataactatagtcagccttctacttcccacatctatctggctatcttcccaccatatctacttccatgccactcctatttctcagcctttaacataggtccttttgtgaacatctttcgacactgaatcacctagttttataccgtttttctccagagacactccttcgctatggttgattgagatttctaggatcctgtggtagatgccttttattctcaccagattaataggcctattaattaatcaatcaaacatttacaaagtgtttcacatcatgaaaactactagagttctggcaaggagttcacagcttggtagacgagacagacaagcaaaggcacagttagaacatgatgtagggctggacacggtggttcatgcctgtaatcccagcacttcaggaagccaaggcaggaggatcacttaagcttaggagtttgagaccaacctgggcaacacagaaagaccttgtctctaccaaaaaattttttaaagtagctgggcatggtggcacacttctgtggtgccagctactcagtaagctgagttgggaggatcacttgagcccgggcaattgaggctgcagtgagccatgatcataccatggcactccagcctgggtgacagagcaagaccctgtctcaaaaaaaaaaaaaaaaaaaaaagaacatggtatatggtatatggtataataagcgctacgtacagaacagaaacacctacttcagcccaggacatcagagagggctccagaggaagtagatgaagagatttgccaatcagtgataaaaagatgtgagtgcatagaaagtctcaatgttaaaagtcatatttaataatttgaaagaattcaccactgctttggaatagagtcaaaaagaggtaaacataatagtgatgaagcaggcaggaatcactgtgctcagggccatggatgccaccgtaagttagttagatgttaatcaaaaagtaatgggaggcattggaagattttactccaaagcctgaacagtgtgatcagattaaaaacactaatgtggctgcaacactgaaaacattggaggcagggaagactaaagagagagagaccagatgaaagagtaatttaggaaaaaatattactccctgaactaaggcaatgccagtaagaaagtaggagagagggcatatcaaatatattatcaacacgggatggagtgaatttggaggtcagctggatgtgaggcaggagggaagggatgggaggagccttaggagcagttgttaggtttttggctgggtggatccattcatcccacagacatttattaagaactttccatgggacagacactgtattaggtcccggggatatagcagtaaacaaacaaaatccatgtcctcatggagcctaatcctagtgttaagacgtagacaataaataagtaaaatatataacatgccatatggtgaaaggtatccaggagaaaaataaggcagtaagggtggatacagagtgtccataggaagaggggctgatgctgtcatcagcagactcaggtatggaactctggatgatgagcaaatgagagtgttcatttgagacatcttcagtttgaaacttctgaattacccccattggagatgcccagtaagtggtcggaacaggagtttggaggacagaacaggggtctagactgaatctgtaaatatcaacagaatttgaattatccagaatttggaattatcaatagactgcttacagtttaagtcattaggatgtataacagcaattggggaattatttagagtgagaagaaaggcctacaggaggattcctgagggccttcagcaatgtcagggaagccctgaagagaggcgcccaagaaccagaggcagaatgatgcgaggagtaaaaggaggagaagagcttggtgtcacagaagccaagcgacaaaaatgtaaagaaagacaacgtgatcaacaatgttaaatgctgtggatataaaataataatttaaaaagtcatttgggcatataactgcgaggtgacttgggagaacatgagtgctttcatagggttgaagaaagaagggcgaaaagagagaaagagagagacagacagacagacagagagattaaatagaccaggatcccggaggagacaataggatgggaacttgatccagagatacaggaagataatatacagaggagaaaatagagtgtagagatgtggatgaatttattaaggatagtaacaaatgaaggctaaaaaatggaagggattattatgtaatttcttctattttctttgtaaagtggagcctaatgtagtgtgctgagaaccaaaaggaattggggaaagtcaagggtttatggagtaaagttacaaaaggctgttgtagtttatatgaaaagaaatgggtgaattgcttcgcagtgttgagatgggagaacgtatatttgcagaggcatcagtttccatgaatgaatggattgacttgaacacaaccacggagttggtattttgcaagggaagtctgaaggaaagacatgaagcaagggagctggaggtcatcaaagggatttgcaatttagagtttcagagatgggggagttggaggtattgacagaattcaggatgtgactgtaagtggatgagtgacagtggacataaatgttgctagagttgagcagatcaagtatctgtgtggctaagtgattggacaggttaatttcactggcattgtaagtacatttactcctgtctggtttgtttgttgaaaatgccaaagaatatttattgataatagaaaagtattttttgataatactttgtttttttttagaaaagaagtattaaaaagctcctttatcttctggcaaaacatggctaataaattgtctgatgccattgatcttgtttctcaaatgcatctaaatcccgaagaaatgtaatgaatgaatgctcccagagttgtgcaaagatatatctgcttagtcttttaaatataccaagatcatagctctgcatcattctgctgtactgaacgctcagtgggaagcggtaactgctagcatacttacatgcttatcgaagtgctggatatttattcatgcttctgtgatgttctgccccatgcacatgtgccataatcatttggttggttttaagaaagaatgaaatttccaatgagaatagatagatggtctggcaaattaaaaagtgtcacacctggtagctccctccatagcaaatagagaattcatttgctgggaaaaaaatgaggatcataacagatgaaaggaaattgagacaagttacagagaattcgactttaaaagatgatttgtgtccattaaatgcatctccttcaccagatcgtagactgatttaactgtgtttgctgacagcctgtgggggcaacatctacatccatgaagctgattctgctgggtatgtgacctcccccagccaccctgataattatccccctgcacgctgattgcatttggatcttagcggttccaccggaaacacgcatacggctgcaatttgaaggtcaattcgatattgaagtaacacccaagtatgtcacttccattttcatttttttcctacccgaagttagtattttttaactgtcatgtctcagaacaattcatttctttcagtagcacatactgcaagcaaatctagggaaaaagggaaatgcttaataactcaggcctgaaaacagtctgccagcaactctctcatcagctgagcaggttatgtacatgggtactgtcctttgtgaacctagacacttcctgcaagggacgctgagggtggctacttgagattgatgtttatccattcttcctcccacaggaaatatatcgtgtttctgagagatgaatatttatttgcccagcctcgtattcagtgtcacaaatgataaaatgtctgtttaacaaatgggaatttgtgtggtatgtcaccaggggtcaccagtgtcagaacagtactaaagcacttacagtataatttcccagtctttatttaataagagttctgaaagtattacaaaacagagagtaactcttactatattgaagagaaaggaaaactatatagattgtaaaaaaactgtttttctctttcctttaacaaagtgtgtatacgtttgcatgaatgcagctgtggtgcaaaacttagatataagagcttttgttgctatttctggcactggatttaatactactcttccactcatggagcattaattagctgatgtaacttcctcgagaaacgctagatacatgcttgtctacttttacggacacagaaaattccggttgggactctccgttagtcccaattacagagctgttagagaatttatctttgtcatgtgaaatgtatcaaatcactgtgtggaacaaaatactcgttgttttttgaaattcgtagggattaatttgaaaacaacatttatatttgtaaaagcaatacagaatatggaagggaagtaaatattcttcaatgtaggacatgtaaaccctgtctttttgagctgctaatgaaagaatgtattactatgaaaaatgtcatacagcattttaatgtgacacgtggcttacgctgattctatcatagtcttttatgctaagaaatgatgatttaataatatcgtcaaagaaagtaagtgaagttgtcattatcaaaataagtcaaggcaattgaccatgtaaatttaacataattttgtttccgctttaactgtacttctaactacctctagttgtgggatggagtggattcagatgcaccaatactttccaaattttgtgggacatctttgcccagcagtcagtggtccttaggagaggttatgtatttgagatttcgatctgacaacagccccaatcatatgggattcaaggtcaagtattctatagattatatatattttttaacttttattttaggttcaggggtacatgtgcaggtttgttatataggtaaacttgtgccatggggctggttataaagattatttcatcacccaggtactaagcctagtatctaatagttattttttctgctcctctctcttctcccaccctccaccctatcaaatgaaaacaacatcccatgctcatagatcggaagaatcaatatcattaaaatggccatactgcccccccaaatttacagattcaatgctattcctatcaaactaccatgacattcttcacagaactagaaaaaaactattttaaaactcctatggaccccagaaaaacccaaataaccaaggcagtcctaaactaaaagaacaaagctggagccatcacaatacctgacttgaaactatactacaggggtacagtaacgaaaacagcatggtactggtacaaaaatagacacatagaccaataaaatggaatagagagctcagaaatagggcctcacacctacaggcatctgatcttcaacaaagctgacaaaagcaagcaatggggaaaagactccctatccaataaatgatgctgggagaactggctagcaatatgtggaagattgaaactggaccccttccttataccatatacaaaaatcaattcaagatggattaaagacgtaactgtaaaacataaaactataagaaccctggaaaacatttttatgttaaataaaagagtggttatagaatgaatatgttaaaacttttttttaaaccatgactttttaaaaagaagtcattctatctgcctaattttaaaaatattttaatgctagaaataaggagtgtaaatgtttaaaaccacagtcatcaactttaatttctcttttaatttttattttaaaatgtaatcttagtaaacctgaatattttatattttttctaacttatctgggaagaaatatgtgtagttaaatcaaactcctgtttctcctgcttactatgaaattcagtagttctctcttatccatggtttcatgttccatggtttcaatgcacttggtaaacagaggcccaaaaaataggtgagtacagtacaccaagatattttgagagaccacatttacgtaacttttcttacagtatattgttatgattgttctattttattattagttattgttgttaatctcttactatgtttaatttacaaagtaaactttatcataggcacatatatatagaaaaaaatcgtctatatgtctatatagggtttggtaatatctgaggttttaggcactcactgggggacttggaatgtatcccccaaggaaaaggaagaactacagtgtgtttattactttaagtaatacaactatttaagaaccagataactatatttagaacaatgtctttgaattcctcatcatatataaaataattaagctttttttttttctctgagtctctagtgccaaatcagtcactggataaaaagcaaatatatctcttcaggattttgatttccttatttaaaaattgagcagtaactttgcttgttgaagattcactatagtatggtcacaatagcacagaatttagtatctaataggtctagacacaaaccaaacaaatatttaatatagcaaaagttcagaaagcctagttgtaacaatatttagctacaccatagatcatgttatatcccgagtcaagctgcatataattcaattagctatcacatccagctaataagacataattgaatagtaattttcaaggccttgagatatcagttattgtagtgaacagtttaattgatagtaaaactagaaatggcaggtgtccccccttccagctaagcttgggttcagtctttagaatcaacacagggttctaggcaggtcagatgagtctaccagtttgttcttgagatgaaacttgcttgcaactaatagctcttatatagtgtcccaaaagaattaatgtgacattacagaatatgccatttggccgtcatcttgtttcccattattggattggacttgtggtatcatttctgtttatatcaaccctagaattcaaataatgaggaaagcactaaccattttcagaattttaaaaacttcaattcatagtcacttggcacctaagttttcacatgtgctggtgaaatgaaaaaaaaaaaaaaacaaaatttgtaatagaatctttctttctttctttctgtgtttctttctttctttctttctttttctttcttttctttcttttctttttctttctttctttctttttccagctcagtgtggggggaagagtaacagggcaaagtggtgttgttgaaagcattggccatctaacgcttccatatagagacaacttattctgtgagtggcatctccaggggctctccagacactatctcaccaactctttcgaagattttaaccttcagaattcctctggctgtgaaaaagactttgtggagatctgggactatcatacttctggttagtgaaatatatctgctctctttggggtgtttattttcgcatgtacttattcagcctctgaagtttctgcacttccgagaaaggcaaaagcatgtctatactctgcagagaagtgcagattaatgagctttgggcagtaccagtgattctctacctcaattctaccattacaatggatgtccagagcccaggtgtcatatagcctaccctggaggccacctggggagagcaatggtagtgggaaggcaacctgttgctgctgaggcatcccattgccacatgccattatttgaggggtgttctatagcttgaggcagacagagggtcatgcatgtctcctggcagtagcataaggcagatatttgtcactctgtttgtctcagaccactttttcaaccagataagcaagccttcctcattgtcctgagatatccttcccctaactggttgcatttttttcacttcttcatatatttgaacatgttaattttcattcatgttttcctgttttcttgacagagagtaacttttcttcatgggcaaggtcttgttttttattattttctttgtatacgcaggacacctcgaatagaggttaaaagaaatcaatcacctggacatatatatttaattatttgtctctcacaggaaacatcttgggaagatactgtgcaaacaccattcctgacagcatagacacttctagcaatactgccgtggtcaggtttgtcatagacggctctctgactgcctcaggattcagactgcaatttgaatccagcatggaaggtgatttcattgattaattcaaaacaacattgagcacctgcattggacagacactatgctaggcactggtgttacaatagtttgaaaagcaaaataaaacatgacctctatcttcttggaccttaatcaaaaagttacactgacaaatgaaaaattacagctgtgatcaatgctataagggaaaactagttataataagaggatgagagttatactgcaatgcttgccttaagaaagtcctgtagttactcagaatttgctttactgcaaatccaacaaactcagatgaaataaagatcttgtttggaaaaactggatacttacattaacctcctgattttcctgattttttttttttgtaaaaatagggtcttgccttggcctcccaaagtgttggggttacaggcttgagtcaccactcctggctgattgccctgattcttttttttttttttttttttttgagatggagtctcactctgtcacccaggctggagtgcaatggtgcgatgtcagctcactgcaacctctgcctcccgggttcaagcgattctcctgcctcagcctcctgagtagctgggattataggtgcccgccaccacgcccggctaatttttgtatttttagtagagacgggattttaccatgttggtcaggctggtcttgaactcctgacctagtgatctgcccgccttgggctctcaaagtgctgggattacaggtgtgagccaccacacccgacccgattttcctgattcttaagttcattatattcattggtctcttatatttcttgggtcatgatgataattaaattgctgtctgtggactatcatccatggaagccagggttaaatattaatagagataggaaatgaatgtatatattcactaaaatcctcacacacataaatatggagaataattttgtctagaagggtaatttttaaatacctgaattttgagagctttcccgatggaaggagatattttgatttgattggaagttttcttggctttttttcccccacaccagagtgtggtggggatctcagggctctgctggaacatctacttctcccaactacccgaacctaaatcctcatggccggatctacgagtggagaatcaccgccccagaaggaaggcagatcaccctaacgtttagcaacctgaggctggccacgcatctgtcctgcaacagtgagcatgtgatagtaagcgttccctgtggcctgagatgttatattccatcatttaaggagtttactgacccataaatcatagtcagaaaactaggtcaggaaaattgctgtctatgcaactataactcagacaaattctaagtattgttgagagaacaaaacacggtaaactgtcaaaataattgtaaacattgttttaagagactatcagctatcactccatgcatgagggtcatagatagaatacattttaagagtgaatgataatgacaaatggcaaaaccggggaggctgtgggaagctaagcctacaggagcacatagatgaatgggaccagagtcacagcacaagccaccaccgaaagttctgagcagatgggttgtcctgcataatgactgctctttccaggggtgcagagggactcctggtgggagagcactactacctgacctccatgtcgccaacctccagtggtttcagatgtgccctcagcactctcagcttcctgcagtgaaagaaagcaaatgagatccctgagtgtgaataacaaatagattgttaactgtgaagtgctatacatacatatgtgtgtgtagataggtagactggattaatattagtacatttctccacccaacttgccccttctgcagtatatgctatctcagtaaataattccaaacttctggttgctaaggtcaaaaatcttgatgtctattttggaatacttcctctcacaccctatatggcatctacaagcaagtcctctcacaccctatatggcatctataagcaagtatctttaaaaatattcacaaactacttgttatatctactactgccacccccaccgttcacttggattattttataagttccctctggtgcccctgcctccattctcatctccctacattctcaacacagcagcatgtgatggttttaaacctcaatcagatcatgttgctccctttgaaaatcctctaatggcttctcatctcactcagaggaaaatcccaaattgcacctgtggcccacctggccaacattatctgctgcccctccctcttctacctgtctgtgttatctcaaactcccctcttctctgctcgctggggtccaggcacctggcctccattccgttccttgaatgtgctgagatgctccctgtccagctgttgccttcatctggaatgcccctgttcagatggcagcccgctccacaccctcacttcattcaggtctctgcttgaatgccttttaatccatagggtgtaagtatcttatattacagaccccaccctagcctgacacttctctgccatgttgttttatagcactttacaactgctgccatacatcattttgatttgttcatcagtttattgtctgcttcccccactagaatgtaagctccttgagctcaagccatagtttcattcactgctggggactcactgaatccccaatgcctgtatataatagagataaataattgttgaatgaatggatagtagaggtactatcattatccctttaataagaagccacttttgttttcagtttaattgtctcctgttgggtggtgaatctcaaaaatatgaaatatatttgtaacttatgaccactttgtatcaccctaaaatgatctcattcaaccttcagattttatttccaagttctaatatctgaaggacggaactattgtctttcagatcttgaaaataagaaaccaagtgtgttttcttttatttgagagccaggaaattttggactaaggttgtttattataaagaaactttgtttcctattattgattgaatatatataaagaaagatgaagtagaaaaaatactaaccactcccactataccatattttgatgcattttctcatctcttcttggcaaagcatattttaggtacttgtaatcatgtgatataaatccacttgaattctaattttagtctatttttctggttataaatatcatggatgcttattgagcaatatttggagagttcagaaaataaaaaatataaagatatttttaattctactcatctattactaaaatttagatatatatgctaacagttgttttttacctttgaaattatttttatagtttaaatcatactgaatataatgattattaggaattttacaagcagagtattaacatgtcctttaggaaagagaatacgaacagtcatagttttggaactcaaataaagataaaagttatagccacaaccacaaattccaaagcagatcttacttgtcatctctctataccttaattatcaacttataactcttgcagctactgctggtgggttttatgtccttatttctaaataatattcctattctactactccttgctttttttggacattatctatccacatcctactctggaagatgagaattagccctctgccaccacaaatgcacatggggtatacacagtttatatactttcccaaaagtcccccaaaatacatatgtcacagcttttgctgaaattgtcattcagttgacattaccatgattatgtaaacaccattcacaactgagccaagtagtgtactatggcaacatttgcttttgttttcccaaggaataataataattgtgccctctttacattttcttgggttttacgcattgatcactaattcttccacaccctttccaccctaggtgtgcatcttaaccttctgtagtaaaacatgtcagttccatttcttttcctcagtaatatccttccttgagcctttgtccatcagctgcaagcctgatgatagctgtcatttcagaatttccctttgccatcagatttgcaagttccttcattctgctcctgggctagaaagctggctttgtgttgctatgtacatccctttcttggttaatttcctcttttgtgaggcataccctcttgtaactccccaaggaaatgggcaagggcaatacatattttaagaaatgatatacctgaaattatctttattttaccatcgttcttcgaaaaatatatatttaaatattttatatgttcactatattaatatatccatgaatatattaataattttgaagttttgtgtggcttatctggggtcagttttcttcatgttcctatctcgtgtttacttatattggtctctgccttttacattagtcacttccctaaatatctgctgatccttggctattcattcatatttaagaatgaattactgaaaggatgactggcatctctgtatgcatgagggtgccttgactctttaaatagggaaacctacaaacctacaaatctcatatccacaggtcttttctcttggggaggttaaaactccagcaaggaatcactctaagaactaatttttttctgaatctttagcataatgtccacattcctttttctaaaatatatttttatatgttcaatgtttattttggttcctctttactctgctccaaacaagggcatgtgggttggcctttgcccccactctatttgattgagaacttgccaaaaaaaggaagaagaaagatgaaagagggagaagaaggagaagcaggatgagaaggaggagaagaagagggagaaggagagggagaaggagacagagggagaaggggaaggagaaaaaaaggagaaggagaaaaggggaagaagaagaaggagaaagagaaggaagaggagactgagaaggagagggagaaagagaaaagaagaaggagaagaaaaaaaaagagtaaagaagaaagaagatctgctggtgcagaggcagctttaactttcattgcactgcttcgtggctaatgccttatccagctggtctgagcctaaaatttctccaaagccacctgcctatctgactctctgtacagacagagaaaatgaaaagctatgccacccggtgtgacctacaatatgacctatatctgattttgtcccgttcatagcaaattttatagcctgtcctaaatctcacgtacctacagcctatccatttgtattctgagagttgtagtttctgagtacaaaagggattagaggacaatgatgggaattgcattctggttgcttctaacagcagaagtccatgtgataaatggatgactataacatgttcagtcattgtgattctacgccaaaggcagactcagaggcaggataacagccattgatcatggtttccaacatgtactgttaaccttgcagttggttctaataccttttgattttggcaatgtgatgcccattcctgttttcagcattatagaaatatttgtcctcatctgtttctttatacactacttcatggtttggaatcagaaggatggtttgaatcccagttctattattactaattatttgaacttcagcaaattacatcatctttctgaattctggtatcttaatctggaaaacagggatactattatctgcctgggagggtgttgtgctgattagataagacagactgagtagatgatgagcaaagactggcatttttgcctgctcagtaaatgatagcaaactcttcttctggtcccatgagccggaagacactttagaccagaagcctccagacagctaaatttaattaattatagtaaattttaaaagctgacatcttttgttgtggagtgcattctcctactgcataacttttagtgccatagtctgagtcattatttctaatcttgagtcattcaaatccttttaaacactggaatatcaatcactcaatcaatgaattattgtttagttatttcatctaaatgttttttttgattttgtacagcattggaacaatgtttgccaattattgtaactatgtgaatgactacagttattatttaatattttggagtcaataataatccattcttaaaaactcaactgagtaagaaaattgaagctttgaatccataactaataaggaaagaactattatgtttaattgcatatggagattgatttttcaaattacttttcaaggtatttaaaaatatctgcttgctggtcatggtggctcacacctgtaatcccagcactttgggaagccgaggcaggtggatagcttgaggtcaggagttcgagaccagcctgaccaacatggtgaaaccccatctctactaaaaatacaaaattacctgggcacagtggtgcatgcctgcaatcccagctacttgggagggtgaggcaggagaaacgcttgaacctgggaggcagaggttgcagtgagccgagatcatgccatcgcactccagcctgggcaacaagagcaaaactgcatctcaataaataaataaataaataaataaataaaaattaaaataaacaaaaacatctgctttattatatacatcaaataatcagaaactaacatttaagcttcctttccaaataacgaaagtcctgatgcattgttaagaaaaactgcccatcagtgagctctgcacaccacattgtaagcacgatggcttatctcctttacattgggagctcggtttccagttccaaactgtatagcagcttttaatctatgaccacatggcaggaaggcattactgcaatactttcattctagtgaaatcaccctgaggtcacaaaatgtgttcagggtaacatagtggcttgtggcactgggatagaaacctgcattgttaggtcattcattttaggggagggttcccatagaaggaagtaggtctgggctgggaatatcacctcctaggaaatatgcagtaagatggattgtgtgtctaaaggttaaactctttttccaacaggtattcaatggcattagaagtaactcaccccagctagagaaactgtgtagtagtgtgaatgtaagcagtgagattaaatcttcaggaaacacaatgaaagtcatttttttcacagatggatctaggccgtatggaggattcactgcttctcatacctccagtgaagatgcagataaagtgggatgttgtaaatgtacttcattttaatcaggtgcattgcagatgccccccagctactgccaatggcagcagagccatccattttccctttagtgatcaaagttcacttggaatctttgacataagacaaacacatataagcagatcaaaaacttactgcagacagaaaaaaagctttctgatttcaggaagaagctgctatggtgaatttaaaacttgtaatgccattagatgagcttctagcacagtttcagtcatgttaccatgaggattggtgtgacctgttccatattccgtggtccattatttggtgctgaaagagaccatctacctcctagaaggtaacttagtctcggagagtaattaattttgctggggacagaacaggctttattgtttctggtcgtctattcacacacgtatttccagtgaaaataaatgggaggtttgatttgatatagaatatttcaaaattaagcaagatatggcctctaattataaatatcctcctatttcctggattggtgctattatctaagggttttaaaatttagaagtgggagtgaatatttaaaaaaacccactaagttatttcactggtacaggaagcatctgttcctttattaaaagggggcaaattcattggtaggccaaggtcctattatctgtctgatttaaattaaattattagatcaagtggagaattgctaatcaagccattaggacctgccaccgttatatttgggtattcctctaaattaaatattaatgagcacagggcctcaatatttggacaaattgatacagagccaaaccccagccacctgatctacaccaacaggaaaatagagaagttgttgatttttgcacatttttcctttttaaacttgcagaaacttccataatttgcatgccttttacccataatcctgattgcatctagaaaaacaaatcaaagcagtaatgttgatgttttagttactgttcctatattgtttatctcttctgttgtggcctgaatcttactactactttctgttgccttctgttttcttagtgtgtggtgggtctcttccaaatactcctgaaggaaactttacttctcctggctatgatggagtcaggaattactcgagaaacctaaactgtgaatggactctcagcaatccaaatcagggaaattcatctatttatattcattttgaagatttttacctagaaagtcaccaagactgtcaatttgatgtccttgagtttcgagtgggtgagttctaagaacacattctcccatttatctacaatattctttttatctttttgttgttgtggctgctgttgttgttttgagacaggagctcactctctgcccagactggttgtgggcagtccaaaccttgggataatttgttgtaggaagattgaggtaacctcttttgccctcttggtggtggtgggaaaggcttcaatctgcctgttgaaagtggtcaacaggggtgaggatatagtcatgtttcttgagagggggcatatgaatgaaatcaattttccaggtttgtagtggcctctgaacactggaaggtgccctttagcttgatttctcggctaagtgggtggtctgagtgctccctggaaagaaacttgtttgcagatggtacgggcctgcgtgagttgttgaaaggtggtggccatggcaggagactgcaggtgaggttataaaaactgaagcagaggacgatagctggtgtgaaagaggctgtgaatgtgagtgagtttggattttttctgggacatgggcaaaacgagcttattgtctagaaagaaccagccctccgtttttgtggccccagccaaagaaagattgaggctttctccttgtgagtatgagggctgttgagctgggaaacaggtagtatgggatggggcttaagggctgactgtttagctgcagaaccagctaatgagtttccttctgataacaggtttgttaagagcctggtaagaagtgcaagattgacaaaggtaaggttagtagcggaggtaagtgaaagcttgaatataggaaaccttggaccacttgccattgcagtggataaaattttcaagatttcgttgaatttgaaagtcaaagattccattttaaagccattgactaccattgtccagtcgctattggggccaggccatgttacaaaggatattgaacgtttgggcttaatgtgagggcttgtgacctagagtctggaggttgcaagggagacagccaagtgatgtgtcatggggaaaccttcttcaggtggattttgaggcttcactgcaatactagcttcctgttgctgctgcaacaaattattattattattattattattattattattattattttcagatggagtctcgctctgtcactcaggctggagtgcagtggtgcgatctcagctcgttgcaagctccgccttgtgggttcatgccattctcgtgcctcagcctcccaagtagctgggactacaggaacccgccaccacacctggctaatgtttcgtatttttagtagaggtggggtttcatcgtgttagccaggatggtctcggtctcctgacctagtgattcacctgtcttggcctcccaaagttctgggattacaggcgtgagccacacacttagtgtctttaaacaacatatatgtattctctcacagttctggaggccagaattctaaattccctcccactgagtcaaggtgggagcagggcaagtgccttcggaggctctgtgggagaatccatttcctggctctggaggcagcctgcactcctcgacttttgatgccctccttgaatgactccaatttctcgcttccatcactacacctcccaccactctcccatcacctgctctgctcttacaaggatcagtgagtacatcaacttgccacctaaagaagccgggataatcttccctgccaaaggtccttaacttcattacatctgcaaagcttcttttaccatataaggtaatgttcacaggttcctggatcaggatatgggcatattgaggggccacttataagcctaatacagctaggctgcaaaatactacaagtagactgcaaaaccattacaccctctggtgttttaatgattgggagaaaaacagttgggattttttgctttggggtacttcttaactttgaatttttaaggtctagggtacctcttaaacttgtatttttaaggtctagccctcatcaaccctctcttccaaccagagacacccactgcagtgtttccttgaaagtctggtgacatgtctaaatctaagttctgatgagaggcacagggccaaccagcagcccccacggcagcccccttggccagagggtgcccacgtaggccaaaccaagtgactgaaacaagctcatggctgggaaggaacatagagaagggtctagggcctggtgagggcaccatggaggccatggggtgagcgaggtctgctaggacagtgcaggtctgcggagctgaagtgaggctgtagagcctggcctagtgccacaggagccggaggaagcagctgggggctatcgtcccggtccacagagatgctggagactgtggcactaggagtagccctgaggctgtggggagagcatctctaccccacagcatctgggggtgacggcaatttcctcacctgacaagggcagcttccaagtcccagatgctgggctttttctttgtactcggagactagtgggggcagtgacaggaagccagggagcctctcttgcaacctcctccatgctctgtatccaaagactgagggaggtggagctggctgggaggtcgggcactttatccacctgctctttggtactggtcatctggaggtgggtgcagaggtggtccagccattccagttgttcacgtcaccataggtgcaccgggtacttcttgagcattgggatgatctgcttcacctccagtcacacagcttccaggcactgggagtggtcctcctgcaggatgttcagcttcgacttggccaggtatggaggcatatggccagcttggtccagggcatccaccaggcccctcgtcgcagcagtatggtgatgacagagttgtggttggtacaggccagaatgtggtcattaccattgcaggagacagagtgtagagctgtgtggcccttgtcagctgcacagggatccgtgccattttccagcagctaccgcactttttccacatcgttggcactggtagcattggcattgtctccctcattctcttcagagctgcacctctttgcccgagccaccagtgaggcctggcagtgagcctcagccgccagcagcgatcttgcagcacagctcctggtgcagctctgcgtcatactgccaccagtcgtgtagtagtgcaatggggacttggcccaggaggcctcctggcccgggaggcccatgcagctgcccccgtgcagacccgaagtcagcgaaggagaagaggccccaggtaccttgcagcttttgttgttgttgttgttgttttgttttttgaggcagggtctcgctcttttgcccaggctggagtgtagtggcgctacctctgctctctgcaccctctgcctcctgtgctcaagccatcccccggcctcagtctcccaagtagctgagactacaggttcactccatcaggcctggcaaatttttgtatttttggtagagatgggggtttcactttgttgccctgagctcaaagcgatccgcccgcctcagcctcccaaaatgctaggattacacgcctgcaccaccatacctggccactctaaagtcttatttccacacagctaagacatgttttaggaagtctgctaaaatacccctggagacctccttattgtggtctcccttttgtcgtgttaatttgattgatcttttctgccctcctgcttttcagaaatttaaaggctaaaaagaggacctaaactttaaaacttctcttttagtctcccattaaactaattgtaagaaccaccaaaaaagggaaaagttctttggaaaaattatttggaaagcagtaaaatgatatggactgttaggatgtaaaacataggatataagtcattatatgttagtggtgctctgacatagggacctattactgagaatcaacttttgctcaattttcagagaaatggaatggttgcatcacttatctacgtaaacaattgaagaattgtctgaaagaaaatatggtatgtttaaactggaaaagtcctgtaatactttgttcatgagcatttacacagtggagttactgttaattttgggggtactgtggacaagcccagggctgccagtgaatcgagtcatccttacacgtctctctttgtaaggtgctttgcagtgtctgtctaagtactagaaacattctttgtttctagattactgcaaagctaaggaaaagctatatttccttaattatcagctagcatttcttttaaacttttagcatggatatttggggatttatttacatatttattgcaaagccctggattacagagatttaattgaagattttttaaactaatagtttctctgaatctgctttgttaaaatcagtattcaccaggatgcccctgttgtctctgtttttatcttaatgcatcactgagttgacgttaaatttcaaattcttctttgcccttaatactattctatcctgaagccacctttatatactgatgaaagaagtaagcaatctgttattatcatctgtttgtatatatcaaatgctcacctcacaatagcatcaaccagtgaaaaacttcacgttttactgtttttatttggataactatttactttgcaatcaactagcaaggtataaaattgtatgatatgcagaactttaactggattgctttaagtgaacatttaaatatgataagccatattaatgatatttaatacacttaaaatgaacatgttttattcatcatgagtaatacaacctaccactcaatgaaaatctaaagttagagtaaatttgctcatgaattcaataacttttccataatatttttagttatttggttaaggttctcttaatgtttctttcactttttaatagtttacgccttttttgcctgtgttttttattggtttgtttaaagcaaaatctcataccgtgtgctacctggaagcactgtaacctagtgacaagatcataggctctagggacacactgccgggccacgtctcttctcctgtctgaaacttggtcttttgtggtcatgagaactgaagatctatcctgaagattggataagatagtaaagtgcttcacattaattcctggcatataaatacataataaatgcttccactttatcttggctcactgcaacctccgcctcccgggttcaagcagttctcctgcctcagcctcctgagtagctgggattacaggcacttgccaccatgcctggctaatttttgtattttttaatagagatggagtttcaccatgttggtcaggctggtcttgaacaactgacctcaggtgatccacccacctcggcctcccaaagtgctgggattacaggcatgagccaccacgcctggcctatattcttaatttagtactattctgagtaaaaataattagctattagttttataaatttaccatgactattttataaacatcagtgctttccataaagtgaaacaggttatgttgtggtgcatttctttaccttgtgctggccaatccctcattatgctgttcccctgttgtaatacttacattaaatgttaccagtttgtatttaagtgatttatgtctcctgattggactctgacaaagagaaaaatgctaggaagagtaccaggagatagccccacaaagatgggatttgggcataggtttggttattcaagt

SEQ ID NO: 1899 - DNA, 110870 bp, Homo sapiens
tattgctaagccatccttcagacagagagggagcggctgcaagaggtaatgaggtatgtttgtgaaccttgtattcttttacggttacagatgtgtgtctacaagtgtgtgtgaatttgagttgatctcttttagtcaaaatgcccttgttggccgggtgcagtggctcacacttgtaatcccagcactttgggaggccgaggcgggtggatcacgagatcaggagatcgagaccatggtgaaaccccatctctactaaaaaaatacaaaaaattagccgggcatggtggcgggcgcctgtagtcccagctactcggagaggctaaggcaggagaatggcgtgaacctgggaggtagagcttgcagtgagccgagatcacgccactgcactccagcctgggtcgtagagcgatactccgtctcaaaaaaaaaaaaaaagcccttgttaatttgttaaacacaaagataaacaacaccaataataaatcaaaaattatgcacatgcatacacatggaacaaaattctcatttatctttttttcttagtgtgtgtatatttttctgaactaaggctggatctataagcctgattgtagtgaaacctgtgtgtttgtgtgtgtttctgtgtgaggtgtgatgaattatttaatacttaggttgaggtagcaggcagaaattctttcagattctggaaatgaagtgagagaaatgaataaaaggagttagaatttgggagtgagattagagcattttccctctgaaaggatttggagttgtgattgagaaaatgtaactgaagaaccaattataatcagaaaattgagaaatatatcactatgcttatgggtttggtgcctctgttgattaaatacagaataattttaggggatagtctgaggatgtgtgtaaaatattgggatgcatttatgagttggtgtgcattggtgggtaggagaggtttcctgtggaatgtgggaggaggtcataaagagaaaggtagggtatctgtcctggcagtcatgtgtggagtagaatgggagtgctcgtgggaagaggagaaggtgataaattgttgttggcccttaaacttaaaaacttaaaataaaatacttaaaataaacttaaaataaaacttaaaataaaacttaaaaaaagttggatccttactagttgccagtctagctagacacacgcaggcatttcttttctgactggttacagaggtgggaagggagagttactcttggggaaagagagagaaattgagactaatccccatgggtctccctgaaaaaggataccactaggttcttcatgcaggatctgatcagtggctttgctgggcgaggaagacctcccaatgtccaaactgtctacagtctgtgtcctggtgtgggacagtaagtgtatgtctgtaggtgtgcaaagagggggtgagatggagggggtctttggtttgttgtgctggtaggtccctgtgctaccagggaccaaatgaagtgggacactaaatttaagacagcttgttgctatttcagtcacactctcacaagatgccaatgattattttttattatcaggcattccctcacaaatacattttaatgagctaataaaattactataaaaattgttctataagcatggaatggaactagaaaagaaattttccatttaaaatttgttcaggtggcagctgtggaatgtgatgagaaatataagcctttgcacaccctgttgctgggctcaaggaggagttagctgtctcctagagatgatccttttgcagttcagatggggaaactgagacccagaggggttaagtggatttttccaaggtcatacagctggctagggtcagagctgactcttaaatctctcaccttgggtgtgaccagacttggaagaaaaaagccattcattagctaccttatcccttcccattcaccaagcagctgggaaaggatggcccaacctactaatatcgcccagcatttttgatgaatagctatggctcactggggtcctctttgcaagttgttcttagtctatctatccacaatgaatcctcttttccactagatctcatgtcttgtgttagcaaaggattttaaaagaatggcttagacctccatatacacatcaaacgctggctataatgccggaaagaggacaaatatccagtttttccaaattaatttagatagccattttaataatttgggcccccatgtggtttgtctactttgcctaaagaactataatggtaccaggacaatgagctttgacaattattcatatactaaataattcaagaagaaaaaaattctattgcttttgcgtaatgtatatatagtaataattctttttttaaattttactttaagttctggaatacatgtgcagaatgtgcaggttcgttacatgggtatacatgcgccatggtggtttgctgcacctgtcaacccatcatctaggttttaagccccacatgcattaggtatttgtcataattctctccctcccctagcccgccatcccctgacaggccctaatgtgtgatgttcccctccccatgtccatgtgttctcattgttcaacttccacttatgagtgaaaacatgtagtgtttggttttctgttcctgtgttagtttgctgagaatgatggcttccagtttcatccatgtccctgcaaaggacatgaactcatccttttttatgactgcatagtatttcatggtgtatatgtgccacattttgtttattcagtctatcattgatgggcatttgggttggttccaagtctttgctattgtaaatagtgctgcagtaaacatacgtgtgcgtgtgtctttatagtagaatgatttataatccttcgggtacataccctgtaatgggattgctgggtcaaatggtatttctagttctagatccttaaggaattgccacgctgtcttccacaatgcttgaactaatttacactcccaacagtgtaaaagcgttcatatgtatatagtaataattcttatatttcagtaagattattttctgaccaacctaattaaaattgccacccttaccccaacattcctcatttaccccccactttttctccatatacttacacagtataacccagtgtatatttatttattttgtttattgtctcttttttctattcatgggaacataagtctcatgacggcagggatttttatctgttttgttcattgttgtgtagtcagtttttgaaagaatgcttggcacattgtaggaacttaataaataattcatgaatgaataaataaactgcaagcagatttctttcttccagagatgtagtttagataatgatgaatgatcttggcaaatgaggcacatcagtagcttcttctaggtctcccagataatttaaaacgtgctatgggccataaacttaatgtgtttttatttgataaaactataatctcacagaaagcccaagctggtgtacactgtggggcattatagcatagaatacagagtgatggttaaaagccatggctgtggagtccaaagggcaggtgttcaaattgtggctttgctccttatcagctgtatgatgacatcaggcagtttatttgacgtttctgaagcttagttttttcatctgaaagtgaggatagtagccatgattaacttgcagtcgttataaaaatggcatgtgacaaattatggaaacctcttaggatatctgctcaatcactgttaaccattattatcattagcattaaaattgcatagttatatatttgtcctataaaaaaatagtcaaagattaaggacagattgccaagtagcagttttttaaaaaacatttttaaaagcccttaaccctatttaaattatttccttttttatttgcgtcttgccatttttcctgatcttagtttttcttcaattgcatttctaattgagataggaagcttcaccatcaagagttctataatgcaggaagtaaggtcaatcagataatgctggagttttttttaaggtttaaggaaatctttctcttgtatagctagaaaatagatattattgttccatagagcaagtaaccatatttgaaaatatggagcaaaaggactattaataaacagcaaacatgtttttaaaaatatgctaatgatattttattaaaaagtcatatttacctatgcatattggttatctattgcagggtaacaaattaccttacaattttgtagtttaaaacaacaaacatttattatctcccaatttatgtaggtcagaaatatgggggtgagttagccgagtggtgctgatttagggtctctcatgaatccagccaatatgtcagccaggactgtagtcatgtgaaggcttgaataggggtagaggcttgctttcaagggacctcactcagatggctcttagcagaagacctcagttctttgctagaaatttccatagtcctgcttgaatgttatgatggcatggtaactggtttcttcaggaaatgatccaagagaaagagcaaggaggaagctgtaatgcctagtcttggaagttagatgccatcccttctccacatcctatctgttgaaagtgagtcactaagtccagctcatcctcagagggtgaggtggtggggactcgccctacctcttgaagagaggagtatcaaataatttgttaaattaaaaacacctgccgtgtgatgattttaaataacattgaattatattttacttcacgtatttactgattgctgtctctatggatatttacacttttttgctattacgtgtaatactgtgatgaaaaacctttatttgtatatacattgattcccaagtgtgtaagtgtatttaagggatgaatttctataaatgcaattgctgggtaatgggcatgagtaattttaatagtttttaccaagtcttcattgagcatagggtgtttatagtttgaccagcagtcggtgggtgtttcttcatagtgtctaacatagtgtgttaataaacacttggaaaaaaattaaatatttttataaaaagcaatctcacatcttacaactattagcatctaccaaagaggaggcatggtcacttggatagacattctaactcctcttcttatcagtgaacataagattactctttgctttattagttaatttaattataccaggcatgagagattattaatctttatggaatttaacaagcaagtttaattttataggatttcttatgaagctctttggaatgtgagatagtggtgacagtcatggtaagaaagactagaattggagtaatttattctagaaaacacaaggcaatccttgctgtagagaaaggttgctttcacagctccatttccttttgcatagtaagagggcattacgttgactaacagcagtttcttatcagtgtatgagaagtaagtcctcttattcaaccaatccttggataaatgactaaggatggctgcttcctactgaagagaatgtgggaggaaacattgattgggtggagaatgagaccgcaaggaaatatcaaacaattcctaaattagggagtcatgaattaagacctcacaggagaagaagggtgatgttctttttgagtaaagagagtatgatttacaaggcagcctgggaaagcaagcattggtgggttggtggagaaagtaggccttgtataggcaagactgtagctatggctcctcttcctggctttctgcacctatgtcccaggcaatgcatgagtcatccaacacacggggccataaagcacttaatgaaggtcataccagagcaagccaaccaggacagcaatcagcattgttcatcagctgctccaccagaacaccaagtcgggtgtggtgacacactcagggaaagtgggactgacatattttgtaggaacattctgtttcttacccaggacccattacctgtcttctctttggtaaataatgagacctgtgctttatgacttagaatatttttatttgatttccacaataagaaggtggcaatagataataataacaaaagaaattgtagtttcattttacagataagaaaattgagactcaagagtattacataaattgtttcagctaccacagcaaaaaatggtatggttgggaatcaagctcagggattctcatgctctatttagcaccaccttctcttctgagaagaacttggggatagaataaaaaaataagacactaatgaaatgtttagcacatgtgtcttttgtgaaagggagaaatagagtagtgtgagatttctgtgactcacttgaaaatgacttttaaaaactaatatagaagccaacatcaccctgataccaaagacaaagacacaacaaaagaataaaactacagaccaatatcccttattaacatagattcaaaaattcttgacaaaatactaacaaactgaatccaacagcatgtggaaaagataataacaccatgattagtgagttttattacagatatgcaaggatgattcaacatgcacaattccataaatgtgattcatcacacaaacagaattaaaaacaaaacccatatgatcatatcaatagatgcacaaaaagtatttgataaaatccagcattccttcataaaaaaaaacccttaaaaaccttggcgtagggagaccatacctcaaaataatgaaagccatatatgaaaaacccatagccaaaatcatactgaacagggaaaagttcagtacgattgaaagcattccccctaaatggagaaaagacaaggatgcccattgtcaccactcatattcaatatagtactgggagtcctagctgcagcagtcaggcaatagaagaaaataacaggcatccaaactggaaaaaaggaagtcaaattacctctgttcactgatggtataatcttatacctaggaaactctaaacccttcaaaagactcctagatttaataaatgacttcagtaaagtttcaggacacaaaattaatgtacaaaaattagtagcatttccatacaccagtaacaatcaggctgagaaccaaatcaagaactcaatcccatttacaataaaataaaataaaatacctagtaatacatttgaccaaggaggtcaaggatctctacagacaactataaaacactgatgaaagaaattgtagatgacacaaattggaaaacatcccatgttcaaggattggaggaatcagtatcatcaaaatgaccatactgcccaaagcaatctacagattcagtgcaattgttatcaaattaccaatattattcttcacaggtttagaaaaaacaatcctaaaattcatatggaaccctgaaagagtgtaagtagcccaagtaatccaaagcaaaaagaataaagctggaggtatcacattacctgacttcaaattactctaaaagactatagtaatgcaaacagcacagtactggtatagaaatagacatataaatcggtagaaaagaatagagaactcagaaacatagccaaatacctacaatcaactgattcttgacaaaaatatgcactggtgaaaggactccctattcaataaatggtactgggaaaactgggatgtcatatgcagaagaatgaaatctctcaccatgtacaaaaattaactcaagatggatttaaggcttaaatgtaagacctgaaactataaaattactagaagaaaaatctaggaaacactctctggacattggcctaggcaaagaatttatgaccaagtcctcaaaagaaaccacaacagaaacaaaatcagacaaaaggggacttaattaaactaaaaagcttctgcacagtaaaaaaataaaatagagtaaacagacaaccaacagaatgggttaaaatatttgcaaacagtgtatctgacaaagggctaagatccagaatctataaggaactcaacaggaaaaaaaacacataaccccattaaaaagtgggcaaaggacatgaacaggtatttttccaaaaaaaaggcatacaagtggccaaaaaacatgaaaaaatgctcaacatcactaatcatcagagaaatgcaaattaaaaccacaaatgagatgatatcttacactggtcagaatggctattattgaaaagtcaaaaaacaacacatattggggaggatgcagaaaaaaggaaatgctgatacagttttagtgaggatgtaaattagtacaatctctatagaaaatggtatggagatttctcaaggaactaaaattagaactacccttcaatccagcaattccactactgagtatctacacataaaaaaataaattgttttatcaagaagacacctgcaattgtatttttattgcagcagtgttcacaatagtaaagtcatgaaatcaatccaagtgttcatcaacagatgattggattaaaaatgtagtgtacctatatgccatggaatactactcatccataaaaaacaatgaaatcatattttttagcaacatggatagacctggaggctattttttctgcgtgaaatgacccagaaacagaaagtaaaaaactgcatgttctcacttatacacgagagataaacagtgagtatatatggacatacagagtcatagacactagagactccaaaaggagaaagggttaggggggaggtgaaatactacctattgggtacaatgtacactatttgggtgattggtacactaaaagcccagtcttcaccactatgcatatacatccatgtaacataattgcatttgtactcctaaatctataaaaattaaaatcagtacaaaatatttttaaaaagtgaaaaaaatgctggtaggaatatcatagatcttctagttcaatttatttcctttgtaaatgagaaaactgagaatgagaaagcttaagtaaattttccaaggtagtctagctggttattttcagaatgaagattgcaaaaaagagaattaactagatttaaagtctcctggaagatgctatatcatctatgtaccattcttgctaaaaaatcaaacttaaatctgataaaaactctaaagctaataattaatttacaggaactataagggtagagaaacatgttagcatgcatagagatgtaatcaacaaaattcagattgcaggaaaaatctacagaacaaattctgtttattaaaaaatacataacagatataaaccaattacaagagataaatcttacttgcatcctcaggagagcagaacaaattataaaagtttatcagacaatgaaagaaattttaaaattcactagatatttgatgacagtaaattattataaacatatattaggtatgataatattttgccttttgcaaaatttcttatcttttaaagaaacatactatttttagattaaaagacatgagacctgagatttgtttcaaagtaattcaggggtagggagaaaagtggaccagaataaggacagaatgaattggccatgagctgataattttttaatttagataatggatgcttgggaggcttgttatagtattcattgcatacatttgagcttttccattaaaaatcttactagttatatagtaaatcaaattcaaatctaaaattgttttctcttacattttagagatggcaagaaagaagctgaaaaaatttactactttggagattgtgctcagtgttcttctgcttgtgttgtttatcatcagtattgttctaattgtgcttttagccaaagagtcactgaaatcaacaggtaagaagtaactctggggctctctccatatgttgtttttattagagcaaaccttcaacaatgtcaggaaagtaatgctttcatgctcatgtgtgtatgtgtttgttgcgggggctgttatatgtgtgtgttctatgtgttttggacagctcagtagatattcattgtaggtttaagttctgatactttgatttatcaattaatgcattgcagaattccataattgactttttaaaaatatttgccaaatttccttaaataagtctaattctgctaagaatgataattaacaatacccttatgtgaaaggcaagcgagtatatgagagacttcaagcagtttgtggaaaaatagaaatatagaaataaaaagaaagctagaaagataaaaataaaaaaaactttatttctcagtgtaaactccatcaagttcaagacacttttgtaaaagatgataccagccatttagtccatccataagaactgagggtcctgggaatttaacctttgtaatgcagtcttttttacattattaactgaaaaaaatgaatgccctttatagatttttttttaagattaggaaactaaaagaagtcaaaaggagccaaataggaaccataaggtggatttcccatcaaaactcttgcaaaattgcccttgtttgatgatgaaattagcaggagctttgtggtggtggagaaggactctccgtgaagctttcccgggcatttttctgctaaagctttggcaaactttctcaaagcactctcatgatgagcagatgttactgctctttggccctccagaaagtcaacaaggaaaatgccttgagtatcccaaaaaaccgttatgtgacctttgctcttgactggtctgcttttgctgtgactgggccactttcccctcttgggagccattgctttgtgctttgtcttaaggctcatactggtaaagccatgttccatcacctgctacaactcttggaagaaatatttcagaatcttgatccccacttgtttaaaatttctgtttaaggttctgctcttgtttgcagctgatgtgggtgcaacaattttggtacccgtagagcagaaagtgtgctcaactttcatttttcagtcagaactatataagctgaaccaattgagacatctgtggttttgactattgtttctggtgttatttgtcagtcctcttcattagggcatgaaaaaattaatttttatcttcacaaatggatgtggatggtctgctgctgtgcgcttcatcttcaatattgtattggcccttcttaaaataagttattcctttgtaaactgctgatttctttggggcattgtccccataaactttttgtgagtatcagtgatttcaccatttttccacccaagcttcaccgtgagtttgatgtttgttcttgtttcaattttagcagaatttatgttgctctgataggtgctcttttcaaattgatgtcttatctttcctagtgcctcaagctaagtcctgttcagacatgttgtaacaatctactttgagtttattttagtaccaaaaatatttgaaatttatacatagttttttcataatacatatttttcatggactttctgaagaccctcatctaatcaaactttttttgtttattgaatttttatatcctcaaaaggagctggattatgctgaattatccatggtttcttatctgattcatctaggatcaacttcctaggagaaccaggcaatcaagtgttaacctgtggcttctctgcccctcctaccccatcccttgttacaacaatatctactttttgtagaaaaaagtcccaaagattgctcaactcttaaaattatgtgattctaaagatgtaactaaaaccattatgcagacattggcacaatttgaatttgaaacccccaatgaaaagaaaaccaatcaaaagacactgttttgtcttaatgtcattattaatttattgcagaataccttcaagaaagctcacctccttattttaggatacaataaaaataccttttctaatttactgatttttaaatctgaattcaaagttcactagcccttaggtaagtcctagctgtcagtttttagagtggtggcctccctttacatcttttgtcatataggactttgtatttacagaagaatggcattgctcagaagcattctttgacttggggattggctgttgactgagcaagcaaagctgaggttactataattaggatgacacttgtactgcacatgttctgtgtgcccttgctgctggggttggaagtaaagaatcagatcagaggtcttcagactttactgtaaaggaccagatagtaaatattttagattttgtgggccatacagactctgccataatgacttaattttgccctagtagcacaaagcagctaaaaacaaacgagtttgtaatgtgtataatatgtaatgtgcatgtgtgtaatgttccagtaatactttgtttgtaaaacaggctttgacttaatttggcctgaaggccatagttactgacccctagactaaaggaagggtggtccccaccttcatgagcttctagtctaaaggcggagtccttgctcttatacatactatcttgtaggggagggagttgggagtagaaggagatgatatagagatacacaaaggtaaatacagtcagcaggaacaaagtgacattttataaagtgaatgcataaattttgaggtcatcagagtgaagcctactcagtagtggagttaattggaggtgttgagaactattgaatgtctgtgaaattaaatttgtctaatggtctttttatgtttgcttttggtatagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggtttgagttatgaattttgtttccattttagaatttatgcaacttgatagtttatttttttttgttgttttgttttggttttctttattagtgactctcaagagaggtgtttatgttgcagccattagtggctcaggcaaattaacctgtgtccatgcttgtatgacagtgcagcttcaggaaaggaagacctggaaaattcccttgggttgccagattcagcaaataaaagtgcggttgcccagccaaattcaaatttcagaaaaacaatgaataagcttttagtataagtgtgtcccgtgaaagattttgggcttacttactaaaaacgtatttgtcttttatatggcaacactacatgattactagttctttctgactctgttcatgccctgtatgtctctcctcctttcagaatttccaaagctcatctagaatctgcagtaaaaattcacaaaacattatttaaaataagggcaaagtttcaagagctctgttttggaaggaagaaggtaatgaataccagattaaagacagtgcagacatctgggcatttaccttagcccagtgtttctagattatcggctgaagtccacctgattatgatgattataaagtacttgcccacaccctatgtttgatgtgccaaatttacagaaagttgatgcacatgcatttactttccctgtcatattgtgcaagttactcaatagctcaattgagctgtactcaatagctcactcaagctgtactcaatagctcactcattacttggaagctcacctagattatcacattctcagtatgtcacactactgcaacactccatcttgtcactgggtattggtgcacttcagatacagccatagtaatgtttctttggtgctttattgtaagatcttttgataaatactgtggtatcaagattgaagttcaataaatgaactttggcttttctacatgtcatatctaactgaattactccacggccttggcgtttattaattggcattctccttttttgctcagccagagagaaatactggcactttcaatgattcattttcttgtagaagatacatcttagaacttttgttgtatgttttctgaatcctgagagcggtatgctgatccagattgttgttgagagctgaggctatggataatgatgtgtttgtatggtgttcacattaaagggaatgtagctgaaagaggatggtgggaagaagttatgaacacaacagataggctaggcagaatgttctggtgtcgaaaccattgctatataattttatcattcttatcatctgtcctccaagattatatgtaaaagaactaaaagaataactttctctgcagatgattcttggttgtaaataccattgtttgattctcccagttatgagagggaatccttttccagtacaggaggaagtactgtatcaagccaccctgacaccctgagtactcttgggagactcttctttggagagaatggactctaggagtccccttcatggatcttagaaaaaaagatcactcgattatctaactctagttcggatctttagttctgggcttgaagctggttggagggcatcttcactgaattccttcctatcatatcagctgaactcgttacctcctcaccaaatctgcttttccttctcagctaccagatttctgctagtagttctattaagcttctagttcttgagacagaaacagcagaacttctgcttggctcatcccttctatccctttggccagtattccatgtattttaaaatattttccttaacaataatttccagaagaggcatttcatttccattcttgcagccatccctagatcatcatttcctcatgcttgggttgctccaggtgccccttggcatcccttctgaattccatttctcctatccattccgttacatgtgggattagaatttctcttttttacatccaacttttgttattatttctacccaacttcagtacatatagtggtttattactgtacgttgagccaagttcaaacactgtcttctatcatctaagaccctacctctgtgcctctataggttcacttaggctatacttctatgcagattttaaagacaactgtctacacttattccaaacctttgaattctaaaatcctttccactttcttgatgaagtcttttatccccaattccagaacgcagagttgaaagatcccattgatggcagggagcaggaatatttcatcaaattccagatatccagcttaggaaagaaatgatagttaatacttttaaatcctttgatttttcagggctataaagcactgtgtaaacatgggagggcaggttacgtgcttaaagataaacccgcatgccctaagtaaatgttgcagagtaattaagctgagagaaattcacagttgatttccaaggataacaataacataagtggtaatctcaataatttgagaggttaccatatttcttaaacagaagctttgtcatcttttacagcgaacacacttggtaattgtctatgtattactcatttatttggcttatgatatccttttccaaattccagtttattatcaatatgttggggatcatgttttatgatatagcagcaagggtattgcattttgccaagatcattgtgagtcttcacctttaaattactctgtgtttacacaacatcagttaatagccattatatggtgctaggaagagcagtgagcccagataaaaacttaaagtcttaaaagacttaagtttatgtttggcaccttgaaatgataatgtagccattggtcaagtgaaaggatgtaaggggagccaggttattgagttactcagtcctggctttgcttctggaaagctctttgacttgatcagtaagtcacattttcttataaactgtgaaatccttctaagtaaaatgagacagtatgtgttcagctaaacatactcattaaacgttcgattaaatgactattgaacactatactaacctcaaaatattttagaatagtgatctctaaggttctggcaaatgtttctctgaatattcaccacagtctgatttgggggactagaaagactggattatgggaatggcagaggtggcaactttgttttaaaaagtctttgctgttagacttcactttgaggttaaatgaagtggccagcctaacaagctaaatttcaaaacctgactcaagatgcacatattataaaatagcctacatttaagatatttcacagagtcgagactaattttattcattcgttagttcaaacttgctgcacataaaaacagctagagaacattttgatgaatagagggtgatttgaaattcctttatcatcaagtgctttcaacttctaaaattcctgctctatttgaagatgggatactttgtctcattctactcattttcttcatgtggagactttctggttccaccttttttgttcacaacatcaggttcttttgtgctgctataacataatgcccaagactgagtaatttatcaaacacagaaatttacttatcatagttatggatggagactagaaagaacaagaccaaggtgctggcatcttgtgaggaccttcttgctgcatcctcacatggcagcacgtagacagcaagagacagcccactgtctcctttataagggcacctaattccctttgtctgggaggaggcttcatggcctaatcacctcttaaaggccccactgttaatactaacatactggcaacacgtgaattttggagggggcacattccagccaaagcaccagtctaactgaaattgctctaagtcttctattttcttagacttctgttttcttagggcaagcttctccatttgtctactgaattacaaactatccaaacttagtggtttgcagcaacaattgttttattatatgtagtgattttgtaagtcagagattctgccagggtttggctgaatggttctgttccacatagcatttactgggattacatgatatggtggtatttagttggtggctgatcttgtctggaggtttcaagatgactttactcacatacctggtaccttggtgaaaatggtggtaagactgactgcaccctcttcccctccatgtagtcacggagtctctcttggtactctctccagcagggtagctgaacttcttacatggtggctcagtgctgcaagagacagaggcaaaagcttccagttctcttaaataccacacctaaaccagcatagtatcacttttgatgcattttgttgatcagatcagtctcagggcggcccagcttcaacaggaacagcgacagactccacctcttgacacaaagtgtgttaagagaacttgatggccattttaaacaactgcagaggaatgcttattttttttttcagagtagcataaaggctgctgttaatggtgaaggctgtggtgacctggacaatacagatcagagcaggatggggtggcacaggttagaggagtcagcactgggaatagggtgggtggcagagttgagtgactgaggtctaatgcgaattgtgaggagctcctcctgttccctccagtggcaggaaatggttgatgccactgactcactcaagctgactctgcctcagtctgggatcatgtccttttaaccagcttgcatttgtccttgcaactttgccctctttctttcctgaatgctgtagttgctgaagttttgattttctttttttttaaatcttagatctgctgtttcctaatgccctaatggtttatgcatttcaaggcgcctgtaatcttatcagtaaattattttcaccccatattgtggaaagacatagggaattactttcgagaaagtttctagttgataattgatttcacctttagaataggcttttgagaatagggtggcaatttctcttttttatacaaaaatatgtgagaaagtatttttaaaactaaaaggcccacatgcttactacagaaaatgtgttaggagagaaagtctgtgacagattcctttaggttttttctggttcttctctctacccattacactggtcagcccacaagcacctggggcttctctgttttcctgtaacagtaggaatcatggattatcatttagtggttttcattttactactttctgtttgcttctctttttctctatttcctaggctctgtcccagaaattctgatttaattcttaaggagtggatcccaggcctgcttatttttgtaatttgccaggtgatccaaatgtgcagctaagattaataaccattggtctagagcagcagttttccaacattgttctgtattagcatcacgtagagagctaataaaatccttagcactccagcttcagtgaaggaggataaggcctgagcttttatacttttcctgaattttccaggtgattctgacagggaccatagtttgagaatatagtaaaatgtgtttgacacaatgtgcaaagttgtacatttttcagcagttctgtaggtcgttatgttggaagggactttggcaaaatatggaatgttttcagtctctgtttttatattgttaggcatgattattatagtcttcttggtaatccagtatatgaaagcttgaaaaataatgacacgtttgggacttgataaaagatagggagttgagaaaataggcagttctatattattttctattatttattttcacaatggttttgattttttctatatagcgttaacttctttgaaataattattcataaatatttaagatatacaaaaatatataaccattatccagcttaagaaataaaatattatcagcagagatgaagtcccccacgcatatcccttctgtattattaccttttcctccatcctctttagaagtaaccacacttttgaaattgatatttaccatgcattcctttcaacctttactacctctatatatacttgtaaataatagatatatacagcctataaacaaaatgcatttttgtttatgcgcttaacattgtgagatttaactatgttgatagatatctctagttcatttattttgctataaaactggtacacaattgtataaaattatgtcaattttatggcaaaaataaatcaaaatcattctacagtaaaaaaagtttttcttcaatatattgaagttacatcagtcccattctgaatatttttgtaagtttttttttacttgcatctgtgtgattttagatatatatcttaagtttactagacattatcaaattgatctccaaagtggctgtgccgatttaccatctcactgtcattttctgtatcttctttggaattgacagtcttttaaagttttgccatttgaggattataaaatagtgttctgttgtggtttcagtgctaatttttctgaatactaatattggtgaacatctctcatttagttcttttctgtgaatttttctgtcttgcccgattttatattgagatgtttatcttcttgatgtgtacagtcttcccgtttgttcattcatgtgattctggattcttattcttatcatatatgttgcaaatatttactgttaagaggctttgctcatctattttatactgtcttgatgaacaaaagttttacattttaatagagtcaagcctatcaacaattgtgacttatgttttgataactatgtattcccatattacattgtatctcaaaaacaattccaggaagactaaaagcctaaaggcaaaaaacaaaaagttatagatttaagaagagaaaaaaagaatctaatataataataattgagttattcattctattttttctataaattttcttgaatttctaccgagacaatattttgtctggaagtaatggatgatttggcttcattgttttcagtcttgtacatttttctttcttgtcctcttgaattgttagaacctccaatatatttttaaattataagcaatcatagtgatggatcacttaggtttttttttctgattttaaaaggaatccttttaatatgttaccatttagtaagatacttgttgtacagttttggtggatatccatgatcaaactaaggaagttgcttttcattccaagtttgctaaaaattttattatgatagctgatgaattcaaatgattatatggtatactttttaaaatgagttttttttaatgaatcacacaagtagattttctattattaaaggatctccttatttctggaggaaacaccacttggttattattcgtttaatatgtactgatttctgttattaatcctttgtgtgctttttcttttaggcttttgcatttatgttcatggataagactcggctgtagttatcctttatgtttcatgtttgcttttgacataaagtactttctttgtttcttcccttctctctcttttaagtgttaagaagcattgggaattggaggaggagaggattggggtagagcagagcttgattgactcttaagcagtgtcttcagtatctggcttgtctctatctctgaattctattcactactcctcttcgtgttggcgaaagagcctgtatagctattatataaaaagtaacatatctttccatcctttatgtacattatccatcaattactctgggtgttcttaaaatattctgttatgtactatctcccttaattttaccttgtgattctttaaacttttcttgtatatattttgagtctttattattaggtatatatccagttttagctgtaatatcttgaaactttaatcatcatgtactgactctatgtctctctaataatgaatttttacttaaagtctatttgcctgatattagtatggcttttattttattttattgttttgagatggagtgccactctgtcacccaggctggagtgcagtggcacaatctcggctcgctgcaacctctgcctcctgggttcaagtgagtctcctgcttcagcctcctgagtagctgggactacagccatgaaccaccacagccagctaatttttgtatttttagtagagacggggtttcaccatgttggccaggctggtctcaaactcctgacctcgagtgatctgcctgcctcccaaagtgctgggattacaggcgagagccactgcacccagctggcattctttttacatatttgttttcccctttactttcagggcttttgtgagctttagtttaggatgtgtaaactataagaaacatttagttggacttacttctttaaatgtaatctgactatctttgtcttttaaatatttaaaccatgtgatagttgacatgacacattctttctaaggtctcattttgtgccttctcttcatcctgtttatgtgctagtccccacccctactccttcataaacatgtcttttttcttaattttttggatcgaggatttccacactccccacaactctaacaattttccttcagtactgttttggtagttacacattctatattattttggcagtttctcttaaatttttaattctcatatccaacttaaaggggcattttgtgtcctgggcctaattctttttgtgtgccctaattctattcatgccatcattttctgtagtttctttctaaatctattttcctaggttttacatagtttgctttgtcttattatgtgggtcttgcaccatgtctcttcccacttcttgcaatggctcagctctactgtagaagctggcatttttgagttggccaacaaagactgtttgcattccttgctcttttggccactctgatctttgtcctttccagtttaatggaaaaattattaaactctgggctgtatacaaaaaccatcatgcttaacacccttttcaacacttttttttctttttatgctgaggtttcctctgagtgggttttacaagaacaaagacaaaaccgtggattgaggttgagttcacagtgacacctgatcttacggcagtataaaccacatatggacatcgttgtttatccctcatattggctattagtgtaaaaaatagcatttaattaaatttcattatttgtataactaagcaaaacatttttctgaccatttgcaaggctgtattctcctgaaaatgtgcttagagatactcaacccagagtatagaaaaaaaagaaatggatagtaagagaaccaagttttgttcttgccttctcaatagctgagtaacctttggcaggtcactttacctcggagaagctttaccaccatgggccaaaggtaattcatctgtaaaatgatctggtaggatgtattagttatctattgctgtgtaataaattattccaaaatttaatggcctaatatgacaaatattttctcacagcttctgtagtcagacatctgaccttggcttagctaggtgcctctggctcagtgtctcttggaaggctgcagtcaaagtgtcttccaggactatgggatgatcgttttcaagctcactcatgcaattgttggtaggattcagctcttcaggtgttgttggattgagagcctcagttcattgctggctgctagctggagacctccctcagttccttaccatgtgagcccctccacagtgtgacaacttgcctctcccagaatgaggactccaacagagaaggtgaaagagagcaagcaagacagaaacttcaatctttctgtgatctaatcttgaaagcagcgtctcattgttttctcttgtttctattacttgcaaatcacttgattcagcatgcactcaagaggagagagttctttgtccttttttgtatttaacttggttgcttctcccaaattagttggtgtgagaaagaaactatcttcattttggcttctacttgattcagtcattaattatgttagaaggcacacacctttcttaagtaagaatctatttgggtgtcaagaaagactactttctgcctctggaggagttgagagactgtaaacatgtcatatatctcacatatgtataatccatataaatgtaaggcatatatttaaaagtcaaaacaacattagtttgatttgaaagcttcagaatacagatgattgcaaagtcttattttcatttttaaaagtcaaagccgatataaatgaagctccatttgtaattttggattactggtgatatagctatattattgtttagactatttaaatatatttatgagtttttttttttgtgataaaagttatagaatgcattttgcttcccatactgttacataagaaggacactggtcagaaaaattggttgtgggtagaaactctgccattgcttggtatatggcacaatttatctaaatgtcagtttccttatttgtaaaatgaaattattcataccagagtctcaaattagatgtttcgtgctttataaatgatcatgttctacaactaaatggagcttctttgactaacctcttgtttcaggccacatgtgaccaacgtggctgttgctggaatccccagggagctgtaagtgttccctggtgctactattccaagaatcatagctaccatgtagagggcaaccttgtcaacacaaatgcaggtaagccagagtctgccatgatgcaggaggtccagaccctctggaggttgactctgtatcccccaggggcagcctgcagagttctgctctgtggggccatataaccacatgtgacagaaggtgggcattgctcttaatcgaggactagaatctatgtgggcaccaaggaaaaattattctctgccttgggagttgagagaccatgtcctctttccaacttccccatttatggaccttcatgactgcaataatcattgatcatttttgttttcaagtttatcccttttaaagtgggggatttgaaattggtaacctctcagactacttccaactgtaattttatgttatttttatgaaatggaagtaattccaattttataaacatgttatgaaagttactagtcaatataagtgttcatggagtgaatagcccctcttcttcctcctactctaaaatgcaaagcataggccaggcacagtggctcatgcctgtaatcacagcactttgggaggccgaggtggatagatcacctgagctcaggagtttgagactagcttggccaacatggcgaaaccccatctctactaaaaatataaaaattagccaggtgtagtggcatgtgcctgtagtcccagctactcaggaggctgagccaggagaatcgcctgaacccaggaggcagaggttgcagtgagctgagattgtgccacttcgctccagcctgggtgacagagcgagactccgtctcaaaaaaaaaaaaaaaaatgcagagtataatgatgacaatgatgaccattctaggggatagcagaaggtgacactttagggaggctctcggtataaaggaggaggcatgttcccctttcagatgctcttggcctgatggactgttgcaatgaggtctcaactctcacctggtttaccatttaattagggagatggcatcaatggatataatcacctgtaatgcaatatgaaaataactgagaaggaattatgtatatgtatgtcaggtctgagaatgtaaagggtatctaattaataccgaatgactgatgggcctgtggaatgagtgttaggcttattgggggaggttttcaatcagattttgtagaagagagacatagatttttataaaatgtaatgatgatatctagctccagaatctgccatagatagtatgtgcgtatgatggggtatatatctgtcttttcccttcttttgagaaataaagatttttcatcaatccctttgacatgtatcctaatatatatatatatatattttttttttttttttgagaaggagcctcactctgtcatgcaggctggagctgtggtgcgatctcagctcactgcaacctccacctctggggttgaagcaattctcctgcctacaaagtagctgggattacaggcatgcaccaccatacccggctaatttttgtatttttagtagagatggggtttcaccacgttggtcaggctggtctcgaattcctgaccttgtgatccacctgccttggcctcccaaagtgctgggattacaggtgtgaaccactgcacccagccccgtgtatcataatttttatgtagctattatttgagaatttgcagagtcaactatgaaaaccttttttttctcctatgttaggattcacagcccggttgaaaaatctgccttcttcaccagtgtttggaagcaatgttgacaatgttcttctcacagcagaatatcagacatctaatcgtttccactttaaggttgtaatttgtttatttttttttaagtttttttgagagacttttattccctatcggatgagtgcagttactacaaaatagaaaattttgctactggatgtatttttctatattgctattattaattagcacctgtatgttaaagacatatacagaatagcttcctttactgtaataacttcctgaatatgtattacagtttactagtgagtttggctttcattcatttactctagataacatgtggaatatggtaggaagataaaataaggaagtatcacagctttcaatccatctctgcagatgtgctctgtatgtctctacctaaagactaacttatgcccaaaggtgaaccatttgagtttggtaacataatgagtacatctacctaagatatgaggtcagtttgatcagtgcctgattccagtatcctaagtagggatattgggaagctctgacaagtttttattttggctttccttctatttctatctctgcacagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtaagttttggaaacctatctaaggatcagagtaggaaggttacagggaggtctgtaagcatgaagaagggggtgtttcaacaatattcctgaaggttgtgggcccattattggtgaccagaacctttaccttctaaagtatacatttttttctggctttctttctctttcctctgtttgcacaatcatttttttctctttatttttccctttatttccctccgtctataatatataaccagctgtccaccagtaaatatttactgaacatctcctatcgtaagtatagtgttctggtcatgtagtaggctgtctggtctgggagactaatgcaagaaatttgcacatggtccctttcttcaaggagtccttatctcttgttttccatagaaaaatgtcacaggagggcaaatgggactgaatgaatgggggctattgagtcactgagatataaaggacgcttttctaagcacttacgttctctccaccctgcttgctcacccatccttgtgttctccacctgtgtctaggtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggagtaagctttcaaatgggcccctttccactgaatatcatagtctcattcttaaaggtcacctctagtattacagtgtagtgtttaagagttagagtctagagtgagactacctggctttgaattctagtcttgctattcaccagttacgtggttctgggtgttacctacctctctgtcttcagtttcttatctataaaatggaagtaatatctcaatagggttgtggtgaggatgaaatgaacagatacatgtaatgtatctagaagaatggctgccagaaagaaggtactcaataaatgccaactccttcatattttcctaaccagatatggagaagatattattaatatctgtactctcaacaacagttgattgtgatctccatatttttaggttcacctttaatcactgactcaccaggtttatcatcacaataggataaagtctcagctaaaacaatcattttttgtataaagaatgattgtggtagtgaaagaatagacagagttttgttgttattgttttattttatttccactttgttttgactgctaaaatttgaagtaacattgttttctggatttggcaatactctgttgttcagggcctttctttttcttttcttcttctctctttgtttgagatggggtctcactgtcacccaggctgaagtacagtggcacaaccatgactcactttagcctcaacctctctgggctcaggtaaccctcgtacctcagtgtctggagtagctgagactaaaggtgcgtgtcaccatgcctggccaaatttttgtattttttttgtagagactgtgtttcgccatgttgttcaggctgatctcaaactcctggactcaagcaatcctctggccttggtctcccgtaagtgctgggattacaaatgtgagccactgtgcccagctgggctttcttgactaagcagaattaatggatggaagaaaggagattacagcaataatttattagtcatatatatatatatatacacacacacacacatacatgtttgtgtatatatatctatttagccatagagtctagaaaatataataatttcttgttagaaaaaaccaaggcccagcgaagccaaattaatagctcaaggcaaaagggtttgtaagaacaagaatggcctgaacccgggaggtggaccttgcaatgagccgagatcgcgccactgcactccagcctgggtgacagagcgagactctgtctcaaaaaaaaagaggttgtaagaacagaggaagaatctaatccctactctgtgtaatttttaagcccaggctctgtactgtacatatgcctatcagaaaagcagaaaagctgttaagtcagagcagcttacctaggaatagttggtgacagttgtttcattaaggagcctcagatccttgcttctcaaagtgtgtatgtggcaggggaaccaccctctgagagaggtgggctttcagtcccttcttccatctattgaattaaaatctgcatttagggctgggagcagtggctcacgtctgtaatcccaacagtttgggaggccaaggcgtgtggatcatttgaggtcaggagttcaagatcaacctggtgaaaccctgtctctactaaaaatacaaaaaattagctgggcatggtggtggcgggtgcctgtagtcccagctacttgggaggctgaggcaggagaatggcatgaacccaggaggcagagcttgcagtgaaccgagattgagccgctgcactccagcctgggtgacagagtgagactccatctcaaaaaaataaaataaaataaaaaccgaaacaaaaattagccaggcggtagtggcacacgcctgtaatcctagctactcaggaggctgaggcaggagaattgcttgagcctgggaggtggaggttaccgtgagccaagatcacactactgcactccagtctgggcgacagagtgagaccctgtctggaaaaaaaaaaaaaaaaatctgcatttaactaaaatgcccatgtagtttgcagatacaccaaattttgagaaacacttttccagagcaatagttatcaaatgtgactacatgttgaagttacctggggaagttaaaaaataacagccatgtctgcttctacctctagggattctgttttaattggtctggggtgcagtctaggttgagaactcctgttctggagtctcaaagacaagcctagactagagctccatctagttacctgattcatattaaagcatattgatggagcttttgctgatgaggttaagtcaggttaagacaggcctctttgagagggcagtttttctgaattacattttaaaaattcctatcctcttaccttctaaaaaatatcacagccttcacattccttctagatgaatgataatagctggctcattctgtaagaaaacatgagttcacttggttaacatcaactagatatagaccccatcttttaaaaatgtgtctttatgaccctgaatgtcctgtcaattagttgcatgattaagactgatttcctaaaccaaccccacagtgtgatgctgagacttcttagttgtaaattttggtttttaattctctttctgcagaacggaactaatttgtatggtgcgcagacattcttcttgtgccttgaagatgctagtggattgtcctttggggtgtttctgatgaacagcaatgccatgggtaaaggaatattcatggaaaaaacaagcacaagagtgattttcagtccctttcttacagcactatgataaaaggaatggatccctttaagagtgactgagccatagtgtagggagggccttatagattctctaattgtgctatccctacttcattacctattgatccatggtagccatgagtaggggattttctccaacttatgattttcctgaatctggtggcctctgttggaatattttctattatcaagttaaggagctcacccttccctataatttactctgagatagtttccaccaatgtgttcttctccgtcttcagccctgtagtcagtagatcccagtggcaatgaattgccataggggaagagaagatgtatcagaatctcccaggattgatggtgggcatagggtattgatccataccttttcttaattgagagtcatcgattcaatcagtgctcctcaaagtgtggtccctgaatgggtcacagactgtttcaggtctatagtaagatgagtatagaaatggcgagtaagcaatgctgtagcctccacacgcacacatgaacctttttctagtaattaattttcatattattttatgaaaatatcagcttgcagtgaaatggaaattaaacaaaataaagatctgattctccaccacagatatccgagaagcactctaaatgatctaacatgattctaggacatctaagagatgaatctaagacgattctaatagaatcttagatggtcctaaggtacttaaaataccaaataacctaagaatagactgagataatataatagaaagactgtacagttttagataggtgaaaggaaccagaaaataagatgagtcagacttagtgggaaaggccacaagatcctagatactctgtatgagttgttcctatgaccaaagagtacattgcaatatttcttgaggcattttattcctagatacgaatcaaggtaatgacacaacttttaagaatggtgattggcacatagaagggttttgaatttatgatacaatttctgactttttttttttagtttggcttttgtttgaggtgagattcactgaggttagttacctccatgtctagttgaattatattctcacaataatgacggggtatgtggtgggacatgttctgtggttatgaaagtcagagaggagaaacttttcctctaacctcttagggttaattcttgggaggctgcaaattaaactggcaaaaaggtagattagcaatagaaaagacagaatttatttacacatacaatgcacatacacacagcaattctcagtgatgagtaactcaaagcagagattagaacttggggcttctataccatcttaattaataggtgaaagggaatggggaaagacacttaggagagaacaaatgacattttggaaagataaatgggcccttaggagagtaggtgggaggatgtgatagtcttgtaacactgtttatctgggaatggtgcctgttgtctcagagaagactagaggtactccttggagcagatttatgacaattgctttttattgagttcttttgggaggctctgattttagcacatcagggatttcagtaacttaaatgcctttggtccaaaataatttttttatgtcacagtggcttattctggaccccttcataagcctggctgctttttccccagaacctggggcctggcacaagacactaagacactccagtcagtattattaaaatctgtcacagaaaaaatgccttggctgccatgtgctgtgagggtggacttggatggtcagggttttcacttggtattcaaaatgtgaggcactagggtcaccttgttaatgttcacatggttagtgatcctgtgttattttaaaacttgtagttactattcaagaatcaattctgatttttattttcttcatttttaacctttcaagaggttgtccttcagcctgcgccagccatcacttaccgcaccattgggggcattctcgacttctatgtgttcttgggaaacactccagagcaagttgttcaagaatatctagaggtaaacttaggatgtcaagattatgactcaggaaatcctaaacagcaaatattttaaaaaagtaaaattcatgtgcaagtgtgacccacaaaatctgctgttacaaatttgagatattaaagaacagatttcatatatgcaatggaaacttgctgtatagcatttttatgttataagaaggtgagagaatataaaggtgccccaaacatggccctaccctcaaacatttatgaaggggctggaaaaatagactaacattctaacattaatgaatcagtgcattgggaaatggactatgtttggtgctctgaaagcaatgcttcgaaaaatttttattaaaaacagagtatttgctaattttcacttcacatatttctttcagctcattgggcggccagcccttccctcctactgggcgcttggatttcacctcagtcgttacgaatatggaaccttagacaacatgagggaagtcgtggagagaaatcgcgcagcacagctcccttatgtaagcaaggttttcaacagttctccaaaagtaaagaaattcccttgaagaaaaagaaaaactgtttatattttctctccctgagtttaattgatttatttatttggtaatgaaaggagttttagatattcagaatactagacatttttttttttgttggaccagtaattttttcaaggaaccattgttctttatagtatgaaatagattgggagaccataattatgtgttgggaggcaatctgtttttgtctctatttttcttattatgtattttattagtaaactttttttgtgcttactgtattgactacattttacaggtgtttttatttgagttttcaaggcatttgtctctttagcttgaattgtagcattttaatgcttctcagtatggattttcttgccttacacatgttcttggtttgctttgactcaaaagtgtcatggcagggacttaccataaaagttgtatcatattttcagaaattcctctaagattctggcataagatttcatgtctaaattcttaggttcttaggtttagtgtcaggtcaagaatgatgcagatccccaggctccctacctatgttttaacagatattttaaagaggaattgaggaagtggagtagttctagaccccatgaatttagttcaaactaattatattgctagaacaaccatgagccatctgggttagcatcattttttttcacagatagtaaattgaggctgtcaggggaaatactatgaccaagaccacataggtaattgatgacagaacaaatactgcatgtgactacatggatgtgaaaaataatacaagtttcaggtccatgtgtttttacattgatattttgattactattaaattgggaataagcaaaatttgcctttctctttagagtggtcattttgccattgaagctgagcttcagtagacattttgtaatttgacggaaagatagtccataaatatgatgtgtaaaagaaagtgcttaatggaattgagattcaaaaagcctaggaacactgaggagatgggggaagcagaaagtcagggcagataaagacgtttgggtggatgaattcactctcaatttggctgcgagtcccactactcattctccagcatgacgtgtctttatgcatgtgggggtgggttgggggagggataacagaaaaagtggtaaaagcaggactgagccaaaggacaattaacacagccaccataataatgagtgctacaacgtggtgaactctcgtggcaggcagtgtgctacatgccttctttagttatctcagcaactccattttactattagaattccattggctgggcacagtggctcacacttgtaatcccagcacttgggaagccaaggcaggcagatcacgaggtcaggagttcgagaccagcctggccaacacagtgaaaccccgtctctactaaaaatacaacaacaacaaaaaaattagctgggcatggtggcaggtgcctgtaatcccagctattcgggaagctgagacatgagaatcacttgaaccctggaggtggaggttgcagtgagctgagatcgtgccactgtattccagcctgggcaacagagctagactcagtcttgagggaaaaaaaaggactccatttaagattagaaatcccatttaatattagaaaactaggggaactagttttcaagcccagatctctaacatcatagaggtcatctctttttttatgccattttccttacttatagatagacatttcctttttaagtgatccaggaaatgaaagaattggactgttactgctgcctagtggtgtgagatgtgagagggagtgtttagacagggaattgaacactattacctgagttcagtatacatgtcaaaatctgtcacatttaagtgaatgaaaggatatagtatggacatgtaataaaacatttttgtactttgaatggctaagtttgaatgtacctatgatattggatactattgggagtgaaatttaacaagagatgcaaagggaaaagctcagtagtcttctagaataatcctcttctctcccccactctattccattggagacaaacctaggttgtagagaagggtacattttattctgggcttcactgtttatacaggtaaaattgggatagcataaacaacaaagatgtggggtagaagcgaagtaacaaaataaaatgtggggtagtaaaatgagggagatgtgggagagagacagtctcttcccttctttatcttgtgaatagggtgaaatttaggtcatttcttaggtggatatgtctgattgtcttaggggtttgtcataattggtgttgcttgcttgattggtttttaatgccagagtgccaggcaaggattggatgatgcagttaacctgatggcagggagggggccaagccctagggaaccaaccagtcgtgtgtttttgaaatcaacattggaaaagaagtactcagatgccaggaactgattaagaactctatttagagcccagaacagagttgtttatcctgaataataacagtgaaaatttgatttcattttactatggaaattcctaggtgctaattgtggactttgtatattctttcaggatgttcagcatgctgatattgattatatggatgagagaagggacttcacttatgattcagtggattttaaaggcttccctgaatttgtcaacgagttacacaataatggacagaagcttgtcatcattgtggtatgtactgccctctttccaccaaattaggtatttgctcctccgtatcatacacccatctctcctgctttctcccccagttcccagtctcctttcagtgcctccggtttccagctagtttgttcattgtattcttcctatttttaggatccagccatctccaacaactcttcctcaagtaaaccctatggcccatatgacaggggttcagatatgaagatatgggtgaatagttcagatggagtgactccactcattggggaggtaacttaatgggaaggctggaggctggtggaggggctgcataggggtgtttgaatgtgtctgtgtgtgtgtgtgtgtgtgtgcatgtaattgttttattgtacattttcagtatatttatatatgctggggataaattctcctctgccctttcatgcccaagtgcaagccggccatcgtagctttttgattcccttcacagccaagtaagtccctttaaacaacagctcacacactgagtgtccactttctcacctcccacacactctgcagctgactgtggtctccttccttcccccctcacttccctgataccgctctggcaaaaagcacccgttactttctcactggtaagtccagcggaactgtttcatacctcttcttactcaattttcctgcattatttgacaagtgtacccacttctttctcaaatgtttgtttgtccttgttttttcaggaaggtgttatctgcttgttcacttctaaggcctctgatgaccttttcagagtatagtgtctgggggaaattggataggaaagaaagagagaaaagtaaatgatgttagaatccacagcttatagtggactagctgaaatttacacaatgctcttcccccatttactattcccagaattaagaacaaagaagtgtagagagttaaagatgactaagttagacaatgcctttatccacgaatttattcattaaggacttaaacatttttttaaatgcatatttcttcgagtgaccctggcatttattttaagtattgtgagcaccgcaccttcttaactaaaaaggatatgttcctgggtacctcggttgctgtgatcatattaggaatttctttgcaaagtactttcctttagtctatatttgtttaatttactcttaccagtgtttttctttttctcctgaaggtctggcctggacaaactgtgtttcctgattataccaatcccaactgtgctgtttggtggacaaaggaatttgagctttttcacaatcaagtagagtttgatggaatctggattgtgagttgtttacacttggattattaggtgacaaatattcaaattgtgtatatctgtatctgtatctttgagtcacagagcatagggagaggaggaggagaagaaaggaagtataacaatcactctcaatattcactctcttactatttaaataatcttgctaaaacacatagcttagaataaaaatcaaaatgttagagctgaaaggaaactcagaattttttttcccaagtctagctctttttttttttttttttttttacgaaggaatgagctgaagtcagaataggtcatgtactccttacattgttgcaaagtatacaaattgttcaattgctagttgaagactcttccttttggacatgttgaacaaattgatcagagccaaagtactcaggtgcatgaacaaactatgcctgtggtaaagaaaaatgtctcatatgatgtcagatgaaagaaagtaacctaactgagggttagcaaaatttagggagctccagagttgaaactttttctttttctaagagaactgtagaaaattcaaacaatacagagagttaaaaagataaaagcaaaaatcctcttaaattatagcaactaaagacatttattatcgatacgttggaatgcatctttctagacctttatgtgctctctctctccttttctctccacatatatgtttatatgtatttatatgtatatgtatttacagttatatttcgatatatggaaaaatgtataagttgaaacatgtcatcatataaattgaaacttttttcacctgatatgtttgggaattgttcattttcagcgattatagacatattatttgaagagaggttaagaaccttcttcatgaagccttcagtgggtagacaagacaagaacacctactctattccatttatacaaatacccctttaaaatatctggaataatttatctgattaattaaaaaaagacaccatcacgacatcataagataacatgttactttttcttaatagtttttgctctttgtcttgtaggatatgaatgaagtctccaactttgttgatggttcggtctcaggatgttccacaaacaacctaaataatcccccattcactcccagtaagtcttggtggtcagcagattaaagtagccatatgtatttcatattataaattcataaggacagatctgaaaaatctggcaagggaatttgttcataattgtgcatagaaaaagaaatatgtgggtaatatataaggaaaactaggaaggaaaataaaaacacactatgctttcctaaaacatgcacaaattcaaaaggggcaatctagtacttctacttatactcaaagctatttctagggaagatctagagaggataaagtgtagaggccagaggctagtggtaagtttatgtcattctcaggtatgcacccacaggccagggtttaccagagagacaccaggtaaccagccttggtcatcaggtaagggttatgtctgatgtgtccacagtgtgaagaactgagttacaggatgaaaagacagaactcatgacctgggaggtcaaagtcagtgaacgtgatgatactcagctttgattgaactttggacaacactatctctcagggtgtggccttggcatcatagcatcggccatagtttgaagaatgctagaggttcaaggacagattatatcttgattgagaaaggaaaaaactgctaagatgataataacttatgaaggcttcaatatggtgggaagacaggaaattggggcaggaaggttagaatcaaatgctgaggggcttggatgagaggctaaacagttcatattttactcttttggtgttagaagctacttatcttttagtaatagagaagcatggtagtcagatgattttggaaatatgaacctgacattaatatatagtgtgaactagaaatagatacataggaggtaaataagacatgacgaagctactgcaatagttaagatccacagataatgtggatctcaaacagagtggtgcaatgggagcagagaggaatagatgaatacaggagagactggaaatcattctctacaatatatgatcaggggagagaaggagtcagaaattaatttacactttcattcagtatttccattcttggaccacttaacttagctcagtttggagaattcagattgaacctcaggcctgaatgaatcttcttacttccaagtgtctgcctctaatcacgtgagagctccagtgggaggatgtgtgtgggtcagcagaattcatttatatatcagagaaactactccaagtggatagcattctaatagtaagggagcagtgtgactgtttacaggatgcccacaaaagtgcctgcccagggggctgtcatttcggattgtgatagtcaaggagcagaaaatgtgcaacttaggctctcactgattgatcctgcttttgtttcaggaatcctggatgggtacctgttctgcaagactctctgtatggatgcagtgcagcactggggcaagcagtatgacattcacaatctgtatggctactccatggcggtcgccacagcagagtaaggccactatggctatgacctgctaattattgaatataaagaatatatatatgtttttaattcttggagattatggggctaatgcataaaatttcttaagacaaaacaaagcaaaacaaaacatttaatgatacagaatgctcccaacagggactctaattgtaccgaaagagagttggaagagaatgggttattcacttttaatgtcttttgtattgttgctgtatccccttggctgagacaagctaagatcccacattgactccttaaatctctctcccttgcagagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgagctgctacctcaagctctcttatgaacctgaattcccaggcaacctcattctagaaagttttcaaaccacaaagctcccctctcctgcctgccatggctggggatttaatatcttgagagcatgtgcttcatccacatcagcagggctttgataccatgacattctttcctgtactgccttatgaagacagaacgtgcaactttgatatgtgctggaatatatctttctattaaagtgtaacatactttatacagaaaagtgtatgtatccttaagaacacagctgatgaatttcaccacctgaacacatctgtgtatctagtaccaagatgaagaactataacattgccagcaccctacagtctttggcattttttagttaaatccaacatatttatgaattgaactcctagagtgttcaaggtcttgagcagagtaggcatggtgagagggaaggaaagcataaatatagtaaagatgtaccttctctttgccccaagggtttacagtttagtaagaggagacagatgtgtaaacaaataattgtgacaaactagggtaaaaagaccaacagggacgtatgagttaaatgttatgggagatcccgagaaagggatttatctgacaaaattatgagggacaaaaggaatcaaggcagggagtcaaggacacttcatggaaaagatgacatttgagattaaccttgaaaagtgagtattttttcatctgactaatcaggggggaagttcattttaacactgagaaataaaaatgagcacaaacagtataagggggattatttgatgtatctataaggattggtgtgtgggactggaatgagaaatgatgctaaaaagatgggttggaaccaggttttaaagatctaaaaggttgaacagcaaggaagtcccggagattttttaataggtgagtgacatggtcagacttaggctttagaaaaataatgctgatagtggtgaggtcaaaataataatatcagcagtattactaggtactatgcatccaaaagctctttatgtaaagtgtattacttttattacctcattcatttacgaaatacctgtgtagtaatttagtactcactgacaaaatgaggaaattgaggcacagaagggttaggtaacttactcaaagtcatccagcattcaagagtggacacaggctatgaccaaattttgaccaccctcctagccttctcggtaggaggtttaagcaaggttcagttgggaggtccctggtggaaagcaaaggagggtggttagaaggaagtgaggtatacctgttgtctgtgtgtccttccaggtgggtcctgacatatgtggctttgctttggacacccctgaggagctctgtaggcggtggatgcagttgggtgcattttatccgttttctagaaatcacaatggccaaggctacaaggtaaggctcctaggacatagagtcagaataaatttggcatacattaggactagatctgtctgcatccttgccaagagatctgctgaaccaacctcttacctggtcttcacttactctaatttgcactatcatgtgcaattaaccagaatctgtgctgtatcatcgaaatgcccaacggcctcagcctgttatttactgttgcattcaaggaaatggtgtgtctgtaaaggtctttcatcaaacttctgtacgctttatctacattgtttgcttttaaataagaagcaaacaaggaaatacttcaaaattatttaaattgcagcctcccaagagaggaatcttaaagaatgaggaaggcaggttgaatcgaaaactcaaggagagacacttggtactactcagaagcgaggtttgcaaccttggcctctgtcattcaggagggaaattcttggttgtaatgaatgaggtctggaattctgcaggtgcttctgctatcctgcagccaaaccacaactgcaaactcctatttcctcccaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagtaagttcacctaacctccttaaattttattaatgcatctggaatgacattgactatatcatcaaatatcagagtgaaaactgaaacaattcaggcagttattcatatctatctgtatctatatctgtaatctagctatctatattcattaatctatctatctatctatctaactggaatacctagttggtatttgtaagcatcgcctgttcccttttggtgagagaattagactaaaagtcatgggactacaggtcttttctttgttctgccattcactaactctgtatcttagacaaatcattttttccttagtttcttcagtcttaattcaaaggatttgaaatcttgactgtgatggtctcatctgtaatgcactataatgccagaactatgttcaagctgtaggaatgagcctataatacaaatacaaatgaggatattataaaggatttgtagaatttcagaattcttatttctcaggcaatgaacatctctaatttaattctaaaacaaggcacttaagagcattttcttgtcaaaatacagtcaactcccttatgtgggtgacatatgaggccctcaggcacgtatcaggctattatatattcattattttgggaagtttttgtctgctcatgaaatttcttgttaaaaggcagatattctgaaagagaaaaaagtaaaatgttaaattatctgatattttgtatgatcagatccagtttcttgatagtcagctgaagttatgaaatgtattgattatttaagtttttaattttaaatttttgttggtacatagtagttgcatatatttatggggtatatgagatgttttgatataagtgtgcgatgtgaaataagaacattatgggaatgaggtatccatcccctcgagcatttatcctttgagttataaagaatccaagcacactctttaagttacttttaaatgtacgattaagttattattgactatagtcaccctattttgctatcaaaaggtaggttttattcattctttctaactatttttttttgtatctgttaaccatcttgacctccctcccagcccctcactacccttcccagcctctggtaaccgtccttctactctctgtgtccataagttcttggcttttagatcccacaaataggtgaaaacatgtgatgtttgtctttatatgcctgacttatttcatgtaacgtaatgatctccagttccatccgtgttgatgcgaatgtccggatctcaacttactttttttaaaaaggagggctatggaaaatagaattacagcctgggacctgcctagcatacatactggaatagaaacatctgtttatcctgagggaagaataggagacatgagctggggaaggggaatctgtctaggggtgcagaggggcttgagtaggtgtcacagaataatttggggggtttgcctgggcagacggcctgcatgctttcaacaggttgtgtgtgagtagagctgctacaaatctcattggcagtggctcaaatctcagtgaactgtctctctggttttcaggttctacgaggacaacagcacttgggatgtgcaccaacagttcttatgggggcccggcctcctcatcactccagttctggatgaagtaagtgttcccacagagatacactagagatctctgcatctgtatctgctgccctgcaaactcctctctgcttcttattccaaactcacttctgacatctgtgactgagtcagccttgaagagagtgtgctaggttttgagaagctagacatctggtaactacacatttttctttctagaatttcttttttctcttgatcaagttcccaaccagtttagaagcatctactggaaactctagagttacaagttatgttaggttgttcttgcattgctatacagaaattcctgacactgagtgatttacaaagaaaagagatttcattggctcacagttctgaaagctttacaagaagcatgatgctggtatctgtgcagcttctagggaggcctcaggaagcttacagtcatggaggaaggtgaagaggagcagcgatgtcatatagcaaaagcaggaacaagacggggtggggggagttgccacacacttttttttttttttttttttgagatggagtctcactctgtcacccaggctggagtgcagtggcacaatcccagctcactgcaacctccaactcctgggttcacatgattctcctgcctcagcctcctgagtagctggggttacaggcacctgccaccaagctcggctaattttgtattttttgtagagacggggtttcatgttagccaggctggtctcaaactgctgacctcagatgatccacctgcctcagcctccaaagtgctgagattacaggtgtgagtcaccgcgcttggccgccacacacttttaaacaaccaaatcttacaagaattcactcactatcaccaggacagaaccaagggaatggtgtaaaccattcatgagaaatctgccctcatcatccagtcagctccctccaggccccacctccaacactggggattacatttcaacatgagatttgggcagacaaacatccaaactatatcaagagtggtcctatttgttgttggattctcatagcagatcctgacttgctccatgacgtagaaacaggatggagcagtgacccaacactcactctaaagtcaggctgatcgggatgtgattgttgtctctgccactttgagcctgtgtgatcaggggtgactattgtgctggcttctcatctgcagaggggtaatactactactactaaaaataatggtacccaccatttgggaatgttgggaaaattaaatgaggtaatcatgtaaagctggaatgtttgtcaccacacatgttttattattattttatgattattattattcctaatgtggctacgtttgggatttctctctgggttgccaagttacagtttctattatttgtattagaggagaagcagaagaaaggcataatagcagggcattcctgccctctctgtgtatgattaagaaattccctagagaataaaaagaaatccattttatttccctcaggggacactacatttttttaatttcagggtgcagagaaagtgatggcatatgtgcctgatgctgtctggtatgactacgagactgtaagtagctttgacttttcttctactccttaagactgtagctgcagctgcatagacaagctacctttctggagagagaaacatccatctacatgctgaggagtagtttttagtgttttctgtaatttcatagcagaacctgggtaaagttaacctaaaccgttaacatcagtcatgatgaaatgtgaaaaaataccttcatatactttatttagcaataagataggctgacatagtatctcataaattaatattggaggaactgatggacaatgtgagcttggtcaggaatcagactatctgtttaaaactatcagtttatataatatatcaaatagcctcagcatggcataaattttttcacaaacccccaactggtagcagaacatgttattcttgatttttttccttctgttgtttgattgcctggctagaccataattcagctaattggaaaagggagagagctgtgtatcaccaggcatgtagataatcagtgaagggcaatatgctgtcatgccaatgtgtttgatttatctgcatgcatcaggggagccaagtgagatggaggaagcaaaaagtcgagatggaacttcctggagacaaaattggacttcaccttcgaggaggctacatcttccccacacagcagccaaatacaaccactctggccaggtatagcatggctggagtgtcctttcagaattcatgtccttgcttaaaccctttgaatttcttttcgaaacacactaacagccaggtggtcagcctctttggtttggccacgactgttgcagttttagcaccaaaagtctcttcccttgggaggcttttcaattctgggcaaaccaggtcagttgatccctctgtctgccttggccacactgcatccatgtttctttacccttgactcacttgttctcatttctagagaaccttgactctcctccctcctagaatttcaacttcctatttcttttctcccactaagatttctttcttgtgattcaaaaattaccttatgcaaacctcaaatctccaagtcactgaattttcctttatatgtaattgattccaaaaaaatagattccatctgtactaaagaggtgcacatttatatcttcatggctttgagagtattagcctacttgtctttaatagaccaggagctctttggaagccagaaacctgtcttttcttttgaacctctcttactgctttaattttccaagttgtagactttttatgatactaatggaaaatatccctgaatccaatgccagttggcttcctttttctaactgttcaccttcaagctgttctgcacactgataccaaattaatttttccaaaatgaaaatctcaactggttgctcccaggcttgaagtccaaagtctttcattaatagggtattcaaaaccaatcacaacctggtttcacgttactttaacaactctatctcctgccacaccttcatgtacatacagaccagtcatgccaaaagctttctctttcccagacatacgtatgtattttacaacatttgggcttttgcacttatcctttccaacattctttgcctggtgtattcttaatgatccaaatgaaactttacatttcagcagcaagaaatctttccttaatcttccagcagaggaagcactgccactttcaagtttctggtcattttatatatatattatatatatacgtataatatataatatatatattatatatatacgtataatatataatatatatattatatatatacatatatataatatatatatattatatatatataatataatatatatatattatatatataatataatatatatatattatattatatacatataatatataatatatatacatataatatataacatacaatatataacatataatatatacatataatatataatatataatatatatacatataatatataacatataatatatatacatataatatataatatataacatattatatatacatataatatataacatattatatatacatataatatataacatatattatatatacatataatatataacatatattatatatacatataatatataacatatattatatatacatataatatataacatatattatatatacatataatatataacatatattatatatacatataatatataacatatattatatatacatataatatataacatatattatatatacatataatatataacatataatatataatataacatataatatataatatataatatatattatatacatatatataatatataatatatattatatatacatattatatatataatatatattatatatacatattatatataatatataatatatattatatatacatattatatataatatataatatatattatatatacatattatatataatatataatatatattatatatacatattatatataatatataatatatattatgtataatattatatataatatattacatatattatatatacatataatatctgaatataatatatatattatatatacatatatctaaatataatatatatacatataatatctaaatataatatctaaatataatatctatattatatatacatataatatctaaatataatatctacattatatatacatataatatctaaatataatatctatattatatatacatataatatctaaatataatatatatattatatatacatataatatctaaatataatatatatattatatatacatataatatctaaatataatatatataaaatataaacataatatctaaatataatatctatattatatatacatataatatctaaatataatatatatattatatatacatataatatctaaatataatatatatattatatatacatataatatctaaatataatatctatattatatatacatataatatctaaatataatatatatattatatatacatataatatctaaatataatatatatattatatatacatataatatctaaatataatatatatattatatatacatataatatctaaatataatatatatattatatatacatataatatctaaatataatatctatattatatatacatataatatctaaatataatatctatattatatatacatataatatctaaatataatatctatattatatatacatataatatctaaatataatatatatattatatatacatataatatctaaatataatatatatattatatatacatataatatctaaatataatatgaattatatagatatatctaaatatatatattatatatacatatgatatctaaatatataatatatacatataatatctaatatataatacatatattatatatacatatactatctaatatataatacatatattatatatacatatactatctaatatataatacatatattatatatcatgtaatatgtaatatataatatatacattatatacacatacgacatataatatatacattatatacacatacgacatataatatatacattatatacacatacgacgtataatatatacattatatacacatacgacgtataatatatacattatatacacatacgacgtataatatatacattatatacacatacgacgtataatatatacattatatacacatacgacgtttaatatatacattatatacacatacgacgtataatatatacattatatacacatacgacgtataatatatacattatatacacatacgacgtataatatatacattatatacacatacgacgtataatacattatatacacatacgacgtataatatatacattatatacacatacgacgtataatatgtacattatatacacatacgacgtataatatatacattatatacacatacgacatataatatataatatatacattatatacacatacgacatataatatatacattatatacacatacgacatataatatatacattatatacacatacgacatataatatatactatatataatatacacatacgatatataatatataatatatatataatatacacatacgatatatgatatataatgaatattatatacacatacgatatatgatatataatgaatattatatacacatacgatatatataatgaatattatatacacatacgatatatgatatataatgtatattatatacacttacgatatatgatatataatgtatattatacacttacgatatatgatatataatgtatattatatacacgtgtaatatatgatatataatgtatattatatacacgtgtaatatatgatatataatgtatattatatacacgtgtaatatatgatatataatgtatattatatacacgtgtaatatatgatgtataatgaatattatatacacgtgtaatatatgatgtataatgaatattatatacacgtgtaatatatgatatataatgtatattatatacacgtgtaatatatgatatataatgtatattatatacacgtgtaatatatgatatataatgtatattacatacacgtgtaatatatgatatataatgtatattacatacacgtgtaatatatgatatataatgtatattatatacacgtgtaatatatgatatataatgtatattatatacacgtgtaatatatgatatataatgtatattatatacacgtgtaatatatgatatataatatgtatattgtatacacgtgtaatatatgatatataatatgtatattatatatacgtgtaatatatgatatataatatgtatattatatatacgtgcaatatatgatatataatatgtatattatatatcatatatgtgatatataatatatatattatataacatatatgatatataatatatattatataacatatatgtatataatatatattatatatcatataatatatgatatataatatatattatatatacctataatatatgatatataatatatattatatgtacctataatatatgatatataatatatattatatgtccctataatacatgatatataatatatattatatatccctataatacatgatatattatatatattatatatacctataatacatgatatattatatatacctataatacatgatatattatatatattatatatacatacaatatatgatattatatattacatatacatataatatatgatataatatatattatatatacatacaatatatgaatatataatatatattatatatacatacaatatatgaatatataatatatattatatacatacaatatatgaatatataatatatattatatacatacaatatatgaatatataatatatattatatacatacaatatatgaatatataatatataatatatacatacaatgtatgaatatataatatatatcatatatacatacaatgtatgaatatataatatacatatcgtatatacatacaatgtatgaatatatgatatatattatatatacatacaatatgtaatatatatattatatatacatacaatatgtaatatatatattatgtatacatacaatatgtaatatatatattatgtatacatacaatatgtaatatatattatgtatacatacaatatgtaatatatattatgtatacatacaatatgtaatatatattatgtatacatacaatatgtaatatatattatatatacatacaatatgtaatataatatataatatagaaatttatatgtgtaattatatatttatttttatatttatatatttattatatatttatatattatatatatatttatattatatttttgttttgttttgttttttgctccttagatgattttgtctttcttctttaatactgttagtatttcaagaacagttgtatactctgtgcttgaaaattttattatctgaaatgtttaggggagtctaagtctattgttagttaactttgttgactttctttcatgttgacttattaccttgtgtgcttggtgatcttattttttttaagctgtgataatcttataactgtgggtctcattcctccagagatgatttgccttctcctctgtgtgcaagccaagaattgcttccaactggcattatgttagcttccttcaaggatctcagcttcatgtgggaatcagaggttcacattctctaccttggatcactaggcttagtagcccaattttaaccttgctatgggaatttgccacacggagattctaggttttgcttactaagcccccttttggttttagctcagtgttttgttatcctgttattgttttcatctcttggatatatttcttactttcttgcaaatccaacaatattttaacaggaatatgtgttgtaatttaactaggatcagggaatattttactgggtaagtctccagaagaatatccggtccaccatatttctggaactgtggttctggactcctagaatatcctaacttttgtgttgttttcattgttcgccttcattttttaatgaatgtgcctattttttcctataatatttaaggtcgttcagatcaggggttgtgatttatttatttttgtatctcattgacttcttagaaacgactgctactcagtacatgaatatttaatgaaagcagatgtttttgctgataataaaaactaactttcttgcatagtgaaaggctgaactgtgaaagaatacaatggagaatatgagaccagtgacagaggagaaacaagaagagcaggaaactgggaggttgcttagagcagtgatagaatgaggagagactccaaataaaaatttctctcttctccccctcttcctctctgtccatctactttaccatgtatttgagtaatgttttgtgtttcttattctaaattatagagtagattagaatgatttgtttttctttcaaaacaaactaataaccaataatcagataagttactactaaatagatggaccttattatatgttgttgctttctgagtataaatggtccttaggcaggcgaaaatgtgtcttcctcacagcactggacacttctactgagggcatcattgctaaagtgatataactgaaccagttattgcccaagatttatttctcttctcatactctgtattctaagtagtagttgcagaagcagcttttatttgagttattgcagtgcctctggtgcttaagttcttgcctctaacatagatgttattgttaatgtttggggtatttctatctcttgtgacactgttgatattaaagataggggcgcctgtcaattttgtgtttgtgcctgaagaaaagcagaaccatctgctgctagtaacttttccaatttgaaatttgatggaaatattctcagctcggctggcaaaattctctgactcctgtctttgtgtcttgaatcttgttccccacagtcgaaagaaccctcttggtcttatcattgccctagatgagaacaaagaagcaaaaggagaacttttctgggataatggggaaacgaagggtgagcacttatacgataatgttgctgtttcccaacctgcacctgtgacttatggtccttcactcctgctggtcattcagctgtgggagaaatctcagtaggcacagtagcaagagtcacttaagtattttgtttctggttgcaccattcagaggtagtggtagatgacctacaaaggaaagaaaaatacatttctatctctggcaattctcctattggacagtgatatctataataggctttttatttatttatttatttatttatttatttatttatttatttatttatttattgaggtggagttttgctcttgttgcccaggctggagtgcagtggcgcgatctcggctcactgcaacctctgcctcccaggctcaagtgattcttctgtctcagcctcccgcgtaggactacaggtgcctaccaccatgcctggctaattttttgtatgtttagtagagatgaggtttcaccgtgttagccaggatgatctcgatctcctaaattcgtaatctgcccggctcggccccccaaagtgctgggattacaggcatgagccaccatgcttggccaataggctctctttttattgtcaatgggtgcttagaagagatggtttcaagactgttcccgtaacccaatgttaatgtcttcctcctgaaattcttatgagcaaatgttgatgatatagaaatcatgcccctgccagtgaggcagtgagaatatactttttagcatatttgtggatccagtatactaacaattcctgtgcttcaagtttaggaaatagattcccttgaggcatatgccttggaagcccttggaagggaaactttgcaatgttccagtaggaaagagaaggaaaaacaatggcttggccttggagactcttgtccatctaatccaatgtgtagatttaaatatttattttttaattgcaaaatatttaattggcaaataaagatgaaatatattcaaagtggacaatgtgaggatttaatatatatataggcatagtataatgattaccacagctattttaaggaacagatccatcaccacccatactgtagactggatccccagaacctattcatctaataactaaaaatttgtacccttgaccatcatctccccagtttccacacctgcaggctctaagaacaacagttatactgtctgcttctaggagctcaacttttttaggtttcacatgtaagtgagaccatgcagtacttgactttctgtctctggcttatttcacttagtataacgtcctctagattcatccatgctgttgcaaatggcagaattttcttctttttatgtctgaataatattctattgtatatatataccacaatttctttattcattcatccattgatggacacttaggttattttcatatctttgctactgtgcagaagtaaaattaaaaacttaaatgtaagggttgaaattgtaaagctcctagaagaacacaggaaacaacctccttgacattagtcttggcaatgactttttggatatgataccaaaagcaaaggcaaaatagcaaataataaacaagcatgactacatcaaactaaaaggcttctgcacaggaaaataaataatcaacaaagtgaaaaggcaaactacagaatggataaaaatgtttgcaaaccatgtatctcagaagagattaatataaaaaaataaggaactcatgcaactcagtagcaaaagatcaaatgacccaattaaaaagtgggtgaaggacctgaacagatgtttttccaaggaagacatacaagtggctaactggcatgtgaaaagatgctcaacatcagtaagtgacacaggtatgcaaataaaaaattacagtgagctaccacctcacacctgttagcatggaaataataaaaaagataagagataagtgctggcgaggatgtggagaaaatggaatttttgtagactgttggtgagaatgtaaattgttacaaccgttatggaaaatagtatgcatgttcctcaaaaaattaacagaacttccatacaatcccatgaaatcccacttctgggtgtatatccagaggacatgaaaccagtatctttaagagatacagtcactcccacgttcattacagcattatgtgcaacaaccaagatatagaaacaatctaattatacattgatgaatgaatgaataaagaaatgtgatacacatatacaattgaaaattattcatccataaggaaaaggaaaactgctatgtgtgacctcaaggcatagctgaaaggagtggtagggtgaaatctgttcttctgaggtgggcaggccagaatctgacttgtctttctctcactttcagatactgtggccaataaagtgtatcttttatgtgagttttctgtcactcaagtgagtagcatatttttatgaatcttaggtgtgggctttggactgaccattagcacatctgtgcttgtgtatattgtatatgtgtgattatatttgtaactttatatgcattattggctataggtgagtacatttctatttatgatttcatcgatgttttcaaaaggaggcattaatatagcagctagtgtttctgaacacagtttttaaatgcctgtgtgtttttatgatcgttttaaattagaggattatccaaataatgttgtacttcttcagcacacactagtagagaaagcagagaggcatttatggcagtggggggtatccggtctggaatggaatatttgagtgacttgagaatctgtgtatactcatatacctttatgcatacttggacttaattgttttgcagaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggtaaaaacccattttgttgagatggtacattgagaattctccatagcatcgtgatgttccttcttgccaagtttgcatgggtccctgaaggaccagggcacctttgaggcctgttttggggaagtgagagggctggggaaaaaaatgaggtggccagagctagaatgagttgggtatttttcttcttattcccttctctgcctatcagtgttcccgtctttctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagtttggataggaaacttgtggtcaggttttggaggtcttagttaccaacttgatttaattctcaagcagtctcatattgatccttgaatgaaggctgtgctactgtgtgtgagcattgttgggagtgggagtgggggctggggactagtagaacagggaagtacaagatggtttagattgggaggagactaggagaaggatgataatctttagaatgtgatttttgtactccagacaagtgagaactttaacttgggaagtgttgtttaaagaagtgtcaagataagaaaactatatagaaaaatattaaatatttgaactaatggtattcaaggaaggtttcagaattggagtctttgggcttagagaaatgaacatgctgggatgttagaaatagaaagaaatataatgtttttttcaacttttcaaatttgccgttgctaaaattgaaacccaaagaaatgaaacagaatacctgacttaccctgatgtgattattatgccctgtatgcctgaatcaacatatttcatataacccataaatatgcatacctactatatacccattaaaattaaaaattaaaaaaagaaatcatttgtccaacattctacagaaatgtgggcatgataaccaggtcatatgattcttattgctgtgctctttctaccactccacgccaatgggtgatactggtttgggcattggagagcaagaggatcaactcactttaggatgacatcatgtgtcatctcacagcgagctaagaggagtcagggtagaaaagaataaggggtgatcacaacaggttttatttgacctaactgttttcattatgctaagtacaagattgtgctagaggggagacatttgacctgttgctgctaaatagattctcccaatgtgcagttctcttcttataagctaaagtcatatgttgcttggatgtttgaaagtctggtctaatttctattttttttttatcgaaaaaaaaacctcaggtcttgcaaagcctgtctcctaaagatgaatttccttatgatttccacattcctacaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggtaaccatgctgatggggtttgtgtgcatgagaatctccacacctaatctgtagtttcttaagcatagcagtggtacttacataactacttaaaatccatagaaagaacttcctaagggacaggatctagatgtgacaagtaggtggggacatgtgcgaaacttcttaagatgaatattttgcttggagacaaggaattgaaatttatgttattgccaagtgataagtgatgggctagttttatcgtcatataaaatgactttactaaccctgtttaggttagagaactttaagaccacatgctgtgctgatctatgactttggccttacttttcaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaaggtaaacacagtacatgtatcaggtagtgattagacccttttcagttccattaccttttattggtctggatcacagaaccctaaaataagttaatcatgctacaacagactatatcattatccagagagcattgagaaatcattgagggaacaatgagacctgccctaattttcatttggaaaagattactgtggctactgttaggaaaatggttgggagagcaagagtaggtacggagagacaacttgggaggctaccagttaggcaggtcagtggagggattaggtttggactagacagtggaatgcaggtggagaacagtggacccgtctgaggttgagaaagttgggttacaggatctagtgctcaattgcaagcaggtgacaatggagatggaacatcaagaatgatgaccgtgttggtatcttgcatcttaatatggatggtgctgacattaactcaaataggaatactgaaaaagtttgtgcttgatcaatgtaagatgatatgttcagtttgggatgctgaatttgagatttctgtaaaatggccatcaatatgcagtaatttcatttctttccagaatttaattgcatttaaggactagggatggactagctgtgatgtctatttttctattaaactaagcttctcaaggacaggaatgtgccctttcctgtttgtgcttctgaaatctacagagcctggccgatagtgctgtaatgttattgacagagtaagtgaaagtggtcaggacattgtcacattgcctgaaaggttctttacaatctgacatcaacccgaattctgagttcttgttcatcctctaatgcagggaagaatctcttgtatgtttgtaccctccttgtaacactagcatgttttaggcacctaatgggtttgaagtgaatgaacttccctggagttctagccttaaccattgcctactctacctcttgaccgtagagtaactctttccaaaatatgtgcctctttctggcccactttaattctctctgccttcgtggttgttattcttcaccagaatgacttgatctcctttctttgtttggttaatgactaccaagcttttaatattctagactgtatttctcccgtgagaccgtctcagtctcccagaaacaatgttaggcatttccttccctagaatctcacagcacttctacatagctctcccttagcacacatcacccacgtgttgtgagctgctctctttgacttcttattcgcatgtgaatttcgtaaaaccataacactgccttattgagctcacgtccctagtgtcttgtgcagtgtcaggcaggggatgtagtaggtactcatgaatcagtttagataccactttcagcaaggacattctgattattttaatcaaatagatttcattttggggagacaggtttttttttgaactcataatgattttaagttatttatatatactcatatacccacagaaaataacaagtaacatattcataaataccacactgattccagaatgattttccaagtcagcagcaatgtcccattgagtttattaaggtaatagaggccttaataatgagaaatcacagaaaaatgttaaatgtgacattgttatctgatatattaattaaatctcagatatcataaagaagatagaaacatagcatctgaactttgtgtccaaaaatcaaaaaggttctgctaagggtataggtttcaagagtagtattgttgcctaaaattgatttcctctggcctagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataaatactgaaggagttgaatgtgcctgaggattcatccaacaaatgtttatggggtgccttctctagattaggtgctgctccttatacacagctgaggtttctcttctcatgacaacaaataataagtaaatatcactttgagtgctatgtagaaaatggactgaggggtgcaaggatggaaggcagtgctggtgtggagtggtcccagctgtgatgatgaggggtgcttggatttgtattgtggaggaccactgaaaggaggcagtgacagagggaaacggaagaatgatgaataactcctgggcttttagcgaggatatctgtgatattttaatcaaattgagtttcagttttgtttgggatatgaacagcttcttggtaggaatcaagtgttctgttgtccttgaaaagtcacctgctggaaacagagataaaagctcattttctgtttcaaatctgcgtttttgtgtttcagttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccaggggtaaggacagagcatttgggatctgtgtctctgcttctctccacccacactgctcaggctttgggcttcatcttcccaaactccacttggtcatcacattctgcttttaggcaagtgggccaattctcaggctcctttgtttcatgtgtttagtttatgtgtctagtttcatggagaaaactagagccatgttagcaagcacatttttgttgagtttctttctcaggcataatgtcttttaaactcctactgcttcttcccatgactccccagtacaagaagaattcctatggtgtccacccctactacatggggctggaggaggacggcagtgcccatggagtgctcctgctgaacagcaatgccatgggtaaggccatcagcacctcccttattttggggggataccaatcatgcctgagtcaatttacaatgtgtttagcctaactgttccttgaaggcaaaatcttcattttacgggcactgctgtttattttttctttgtgtttagcctttctgtttatttcaatctaatatcatgtaataagaagatttaacccaactctcattttggtaaaaatcacataagaagggatagtaacaccacatgggtcccaaatatcctggagggcagctcgtgagagccagttatataatttgaattagggtaaaactatgggtcagagaagttagtctgggggtattgagggtgtatggtatgttggaaaattacctatcgggtactctgctcactgtccgggtgagggatccataccctaaacctcagcatcatgcaatattcccatgtaaggaacctgaacaggtatctctttatctaacataaaacttgaaatgtaaaaaataataattttataagagtagaatgataaaatatagtaaagtaccctaaagagaatcaaacccaggaatgggacctgtagacttccattgatcttcttcagttctgtgagtatgatagaaaatgcctgctgttactactctatgatagggagggtgcaggaagatggagaatgtgtggatttcaggggtgattcgtgacatggaaggtgtccgtgaggcttggcatttttctttattttcagatgtgacgttccagcccctgcctgccttgacataccgcaccacagggggagttctggacttttatgtgttcttggggccgactccagagcttgtcacccagcagtacactgaggtagggggaaatccaattgtttatcaagtacttacacagcacattctgggtgccagagtccacattgattagtataactctcagttgacaactggaaatattggtctttcttggagagagattatagaatgagaaaaaataaatacattctaattatcattaaatttatagcctctgtaagcattgcagaatagcagaagttatagtggtactagtggtggtgctggtagtgatagtagtgtgatgttggtgttatttgtggttatatggtgatgatggcagtaggggctgacggtggtgatagtgatgtgggaatggtgataatgatggtggtggtagtagtggtgttggtgatggtgatgatagtggtgggggtggtggtaatgggtgtgttggtgatgatgacggtgatagtggtggtgatggtgacaagggtggggctgacgatggtgtttgtggtagtgatggtgatgatgatggtggtgttggttatggtggtggtggtagtggtggtgacagtgaggtggtgtgaggagtgtgatgttggtgatagtggttgtggtgatagtggtgatggtggggatggtggttggggtggtggtgggggtggtagtggggggtggtggtgacggtagtgaagggtaatgataatggtaatggtggtgggggcacgatcgtggtactgggggtgatggtgaaaatagtgatgatggtggtggtgatgatggtgatgatgaccatggtggtcgtggcagcaacaacagacacttacatactaccaagtgcgcatcactgatttatcacttgctgcatgttagagcatttcacacatattaactcattcatgcatcacagaaacactatcaggcagatgctattattatccgttatttacagatgaagaaactgaagcactaagagattacttaatttttgcccaaggtcacacagctagcaggattggagcctgtatactaagccaggcatatgtctctgattctgggtttcttaaccagttatctacagtgtctctaggaatagcgtaacatcagattttccataatttttaagaaggagctcaagtctagcagaaagctttctctaagtatcctagtggctctatatcctgtcagttttggtctggatttcaattagttagttgtctagcttggggcacagaaaaatattcttattacttgatgtaaaacttcaatgtggtgcctctgttctgaagactaatattttctgtctattttctagttgattggccggcctgtgatggtaccttactggtctttggggttccagctgtgtcgctatggctaccagaatgactctgagatcgccagcttgtatgatgagatggtggctgcccagatcccttatgtacgttctcagtcatggctctggagtttcaaaactaacccaggtgcctctgtgtctgggttcatttgtctaatgtttgttggattccataaagacataaagttctttttcagacaatatcacagttagcctcaccccagcacagtaatataggtaagggcacttgtttccgtcttccagagatgacagctcaagacccagcatgactcgccagagtgggagataggctggctccagggctctttctgctctcccgtgcttccttccatttctttcacttggcttcaaaacatgtagtcaaaaaagtccttggtttcataagaataaagtatatcccacagttcttttacttaattcttgaaaagactaaccacaaatcaatcagacaattgtatatgtgaatacaacctcagttcctgcatcagctctgagctaataacagatggattaaacagatcctgggatgggtttccagaggacatacatatggaaagaaaccttatccttcagtggaggatgggaggggacccagtcatcagagaattgatcccatgaaccatcacatatttaattttatcccacttttctattgtttacagttgttccattagtggaatgtagtgtttccattagtggatagtgaaatgcaatattacagtctcaggaagaatgttgtgtatgattaccctcaagattcggtattccaaagcaactatacatctttgctttgttttgtagtagatttactattagtcctggataattaacagtatttttcctaaacatgaaccactgataccaggggcagcctcttggggtaggtcatcaccatcactcctgatagtggcagtttacaaagcactttccaaaccagtgttttctcttatcctcagaatagccatgctagagacgcattctcatcctagcttgtgctgacttcgattttttttctatcttatcactgaacattttaaaaattaagtgtatttcccagcacctgtacctaacaaatggcagagctgggatttgaatgcatcaacaagaagctgtctggaattccaccatgggtggtggagggttgttctcctataaagcttgggcgtgtacagcagcagcctctcagctccccatgtcctcccgcaggatgtgcagtactcagacatcgactacatggagcggcagctggacttcaccctcagccccaagtttgctgggtttccagctctgatcaatcgcatgaaggctgatgggatgcgggtcatcctcattctggttagtcctgatgtgaatgtgtgcggtctgtttgggagcaggtatgggctttggtggagtcagagttatactttatttccatgttgcaagtagataaattgaagtgcagtaagaaaggtgtatttcccaggactcacagaaactctactgtgcaggtagaagccagcgagttcacccttgaggagttctccttcattctgtttctcctcattctctggctttggttttcccaactgacttatgctttgatttcaggatccagccatttctggcaatgagacacagccttatcctgccttcactcggggcgtggaggatgacgtcttcatcaaatacccaaatgatggagacattgtctggggaaaggtataatcctaagcgatgatccactagtccccagcctgagggtgggtcactgttggtgggtcactgttagtgggtcacacgcctgtgtatgttatttttggccttttctatttgggctctgaggtcagaagctctccttttctcaatcaatatttgttgatacaattaacgacttttaaggtaatgtaacgtgttatggagttcacttttcttttatgtcaatcctatgtgatagtcaaagtattattgctcctaggagcacggtttgtataacaatttattaggaaatactatgtaagggaaattgtctagtgcatcgctactgaacgtatttctctccataggtctggcctgattttcctgatgttgttgtgaatgggtctctagactgggacagccaagtggaggtaaaagggtgtttgtaaatttgggtggagtcagggtttgtaggcaggggcagctgttcctgggattgtggacatgcctgtaccgtggacatgggcttggcaagggagaaacacttaggtgatgtgtcttgggtgtcattctgtatgcctattactttataggtagtcatactttactggccactgggatgtagatatgtattattatccttggaatttaagaccagagagcttaaattatttgttcacagttttaggtgacagagtggtgatttcaattccaaggctgtcagattccaaaggcccaagaaattcccactgggcgatacctcctagcagtgccatcttttctctgaactggcatacttactgttgttgcctcggttatcccttttaaacagtcttcaaccctcgaagactgactaggtcattttctttgtatatctttctttttttccccatgaacaggtgtctccatcttcatacttacgagtcctgccccgagccccaccattccttgggtttctcaactttgcttttacctgtcagtttccagccttattgtaaaacttgctctctcctggggacggtttgttgcttgtaatggatccaagtagtccatgcttctggacctgaatttttttcccgattgactaagcatttcttgcttgaatgaatacatggctccttacaggagagtggagaaagtgaaggcagaagccacaaggcaagagttgaatatggacaggcaaagccagcaccttggagaacggcagaacatttttatgaagttggaaagggtcatccgagcagtacttagggaagttcctacctcacggctggccaggttccctacgtgtaccccgtatgggatagaattctgactcagctgtggctgataatctctttattctaattctccatcccccacccatcccgtcgtttctaaccctgcctgatctggagctctcagtttctggtgaaaggttctctttgtcgggtttcctggttcctacctccatttcctaacaaaaggcatccctggcatgcccacgtctctcaagattctctgtgatgtgacccactgtcttctcacatccttgactgccagacccatataggctgatctgtttctgttttcttatgttcccttttctgccctttttctagacatctgggttcctacctgccctttatctgtggtgtataagaactggagctcccctagaccaagtcctgtttttgttgccttccccaccctcctcaccagcattctttagctctttcactcttacaatggtgtgattatcatagaggaggctatttactgagacaaacaaaggactgtaatgttctataacaaacaacatgagtatattaaaattgaaggacatttacttgctgcttctaagtggtgtgaacccactgttaaacactgagtatgtattttatcccaggttctaagctcagcattgtgggcaatataaatatcactcagaaggatataaaacaaacttcttactctcaaaaatctacaatgtagttaaaaagttgtatcttgaatctttctttcaggttaaggtaaaaacactgcttttattatgtgagggtagaggaaaataaagggaagttgatgcatcctctttaagtcctctcaatttatgttacacacagctgtagttgtcatgtgattctgaaatcgtagaaaacactgaggcgtacttgtctaatatccagaaatgtaatcttattccttcctcccctctctcagtgggaatgacataggagggagtccctgggtgtttcttcctaacctattaccatgcatctcatgtctgcagtctctccctggctttgtctttgaggagtgcataggaaatggcaggactgacgttgagggttgggcatcgagtgcatgaggtcactagttcgggtcattgattgtcatcatccacgtgtataggaagagaacagtttttggatgttttccaaatgctgggaaggtgtgcaaattgcactaatttctcctctcattctacatttctctaagaagttaataacattatttaggccctgttcaggctgtctgtcaccatgcagttgaagtatttgtgtgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtggctcttgtctatctttgtgtgcctaagtatatgtaccactgaccttcaatcaagaggatagtcattgtccaaagaagactttggacatagcagacacttcttcctctcaggagaggaactgccctggtagccctcacaccttctaccagacctgacgctcctactgtaaaacctgtgaggcgggaccaggcgtggtggttcacgcctgtaatcccagcactttgggaggctgaggtgggcagatcacctgaggttgggagtttgagaccagcctgaccaacatggagaaactccgtctctactaaaaatacaaaattagttgggtgtggtggcacatgcctataatcccagctatttgggtagctgagggaggagaatcgcttgaacataggaggcagagtttgcagtgagccaggatcgcaccattgcactccagcctgggaaacaagcataactccatctcaaagaatgaaaaacaaaaccaaaaaaaaaacctgggaggcaatttactaggaatttctggaaatttgattgcctcacagccaccctgaaagagatctatttttttacccctctagccagtcgttctgtaggagtgaattaatctttctagccagttctcaccaggatttgatgaagctcccagggctggcatctacagagattactggatgttgaacaatttattcactacttccttggctcagaattggcaggacgtaattatcttaaaaagtgaggtatgtctgtgtttggcatttctaggatatgaatgaaccatcaagcttcgtgaatggggcagtttctccaggctgcagggacgcctctctgaaccaccctccctacatgccacgtaagaagccttggcctccttgactggcagagccatgactggaaggattacactggaggagcccgaggccaggggcagccccacagctgagggcacatcctcatggctgctgtggtttactggggaccagagacaaaagctctgcacgtgctttacccagccgggcatgggcaagtgactagactcattgagcaaatttcttgaaatttgtccagaaagcacttagcagagctcatggcacaaagggttctcacagctgagtttcttagtttttaggcttgtgtgaattccatcacaggaatttcttgtgtcatcagtgagtggaaattactggcttccccttatcatggagctgatggactttggagttacacttgggttcatatcttggctccagaaattgttctctctaggagttttgtgacttttcacagattatgtgatatttccaaatctcagtttgctaaattgtaaaagacggataatgagatcttcttcatagaattatggaaataattggaagtcaaaagcctaaatcagagcccgtcatgtagtgtttgacagctgtacgttcttcctgacacctctgcttccttcagtgaacttgatgttggaaacacagcaggcgccaatgcagctcagagctgggggcgctgtgctcatgtctctggggagatggagagcgacacaggcaggactgaagttagtcttaagatccagggcccagtcccttgaagagaagtcagggagaaacagaatcagggctgggtttcacctcgccagttcttcctcctcagatttggagtccagggacaggggcctgagcagcaagaccctttgtatggagagtcagcagatcctcccagacggctccctggtgcagcactacaacgtgcacaacctgtatgggtggtcccagaccagacccacatacgagtgagtctccgtctcccttctccagctgtcacaacctatagcgattgccagtgactgacatagctaccctagttttcctttcattccatttctaaggattaagaagattctcataactctgtaatgattcttatttattaaacaaatgctcattgacatggagccaggccctgtgattaaaagtaggaggacagatttaaataaggcatggtcccaccagtgaaaaacttaatgatcctagtgggaaagactcacatggagacaccataatggtcacacagggcagccagtggaacaatagctttagttacaggaggtgaagggaacacagaggactgggcatctctcccgttcatttcaaagtgaatcatctttggagatgtttgtatttttggccattcttggtggagggtaactggtattgtactgaattagcacagtcctgctttgcaagctcaatgaatagtatgaattcttctaagaggatcttataaccttcactgtgttccttctcaaatatagaaaactaagtattgaggaaaccattagcaagacatagtaattccttagtattttgggagtactccagtgaggctgctacagtgaagttctttgtaaagcactgtgagaacacgtgactcattatctccatcatctgggatcagtggaactcctattacagctcagagtcccatgttccctccagtcacgcagcaaacattgactaggctcaagggctctgggagcagaagctctatggcctttactccctggctgttgcctcagttcacctcctgttcccttccaagcagagccgtgcaggaggtgacgggacagcgaggggtcgtcatcacccgctccacatttccctcttctggccgctgggcaggacattggctgggagacaacacggccgcatgggatcagctgaagaagtctatcattggtgcgtgggtccttccccagggcctttgccgacagggcagggagttgggatccttagggaagaggtgaggaggcagatcatgagagcctggtgtgacacagctgtgcttctcgttgcaggcatgatggagttcagcctctttggcatatcctatgtgagtgtccttgggatcctcctaagcaccaagaaggtggggacatctttcagaaatcatcagcaggctccttttatttcctcttgtttcagacgggagcagatatctgtgggttctttcaagacgctgagtacgagatgtgtgttcgctggatgcagctgggggccttttaccccttctcaagaaaccacaataccattgggaccagggtaggacagtggcttctacctccactgttttatgtcacttgaaagacagtctccatttctgtgctaaaagtaatgcagtctctatttcctgggatatctttaaaaaaaggtgtttttttttgttttgttttgttttgtttttttttttgaaacagggatttactctgttggccaggctgaatcgtgcagtgtcccaatcatggctgactgcagcctccacctctggggctaaagcgattgtcccacgtcagccttctgaatagctgggataaaggcacatcccagcgtggctacctaatttttgattttttgtagaaatgggatcttgccatatttcacaggatggtctcgaactcctgggctcaagcgatccactcgacagcctccaaaagtgctgggattacaggcgtgagccactgcacccttaaaaattgtgaagacctggtgtctcaatgaaccatattcctcattgtgctttagattattatttttttcctgtatttcaggcagaattttaccaaatgttccaaaaagaatgtcttacagtgaaattttatcagctgtcttaggagagctttggtgactctttccggtctattaagaatattctctgggcctcatgtatagttttcttttgtttagctgtgagtgatcttcaattggagtatgcttttagtgaccttcttaaatcccctagaaattccagggcgagctcccaacactgttctctttctcctttagagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtgagtgtccagcagggatcccgatgactaatggatgacttattgcattctatgtggtagcagttgatatacacaacgcttccaaattaaagacatgatggccttttgacatgagctcttcagacacaaagtatacctgattactgtctttagcacagtgttatacataccgtaggtcataaaaaaagggtatttattgaatgacgaaaattgaaatgatgcagtacagcatagaatagtttcattctaatttggttgtgcaaaggcctatcttatgtagcagttttgttatatggacccaggtcacaaaagaaggatttcagcaagagaattgagggacgagggccatcctcacatttaaaatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggctgtgcaaaggcctatctatcttttgtagcagtttggttatatgtagccagatcacaggagaaggatttcaggaagagatttgagggaaaagggccatccttgcatttgaagtttgccatggttgagaaatggggcaagtattttacaagagagaatacatctacatcccagcatttctgaagtttgaggcacatcccatggggaaagcagaggctgggtgctcctgatgaagctaggcctaggaaaaaggcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgtgtgagtatggaggcctccgatgaggggaggatcccagctgtgaggcttggggaaaaggacgaggagaagaggcctgagctggtgggggtcctaagacatggtttcttattctacctgtgtctcttcctctctttctgagctgaagtccatcacttaggtgttcttggcctcagctccttcatctttaaaatgagcctaacaattctggttcataggatgatcaagaagaaaacacctcatggtatattcaatgacacaatcgtttcttcgttaactaaaataaggaatagaagatcagatgggggcagtattgtaaagaattcataacagtcctctagcactattacaacttttcagaaggattgcttggcaatgtgtgtgtacttgtattgctgctggctaacccttcccttcctctgcaggagctcctcccagcagtaaaagccatttctttacttctattgttgattaggcttctgattaaaataccagttaattgcaccttcccaaaatctttttttttttttttttgagacagagtctcactctgtcatccaggctggagtgcagtggtgctatgtcagctcagtgcaacctctgcctcccaggttcaagtgattctcctgcctcaacctgccgagtagctaggactacaggcacgtgccaccaggcccggccaatttaaatttttttttttatttttagtagaaacagcattccaccatgttagtcaggatggtcttgatctcctgacctcatgatccgcctgactcggcctcccaaagtgctgagatgacagacgtgagccaccgtgtccagcccgcaaatcttatggtacccacagaatttttttctgccccagacacaacctcagttgtttgtctctttaagagggaatggcgtaagcctatttctataagcaaatagtgaatttttttttttcccgaagtcctgggtaccaaagtgctttatgaaagccacttgttttggggtagacagatctctcctgtttgaaaaaggaaaagggatggaaggtttcctcaataggtgacctcctgggacatgaggcaagtgggcccaaggccatcacaattatttaacctctttcctaagtattttggtttctctgtcctggaaaatggtgccactgccacaccttgtttatgtttcattttagaatgccagaaatgtcactgcatatttccctagagcccgctggtatgattactacacggtaagtttttctgaatgtttatacaacacgggaaaatggtagagagtacaaaggctttagatctgatagaccttaggtcaaatgctggctctgtaacccacctgctgtgtggtcttagagaagccactttaacccttgtaacctcggttttctcacctccaagtggagtaagaccacttccctcatagaactgttgtgaaatgacacataaagcatctcactcaggtttttcgtgggtgttctctttgtgttaatttttaatattttcttatatcactgctatttacaatgttttgtaaaggcagatgcttttgagattgtgttgcaaactatagtttttgtttttaatgtttatatctttacctgctgtaagtttgtaagcatagaggcctttttgtctctgtctttttattaaatatctccttccatagcatagatgctcaaagaagggcactgcacataattacctaaggtaagcaagtgattaggcaatgtgcaaaacacacacagaggtatgggacccaacccttgtgagtctaagcagtgcaagtgcatttagaaatgaggaagcaatgaagagctccttgccgcatagtttctgtgctattatgttccccaaagacttatctgggaagccagggtcttcccgggcagctctggggtggtgggctcttgctgggaccctgacaagtcagaccctgattcttggggaagaatcaaagaaggcatttccttggtctctaatggggcctcttctgactttctgaggagaacatcgttgagggctggaaatacagcaaaggggtacaagcagggatacaggaagcagagcatgtgctggcccctttcatccaaggggattgcagtgagattaggtgaaaactggagaaggatgtgcattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaacagaagatgtctttggttgaagaggaaaagacaaaagaaatcatggagcaagctatttagaaaaagatgaaattttgatgtttaattaaaatgaagatgaatttcatagttaatattaatgaagaagtgtcaccttaattaatcttcccaagtttgggtaactattactcattctagagcacaagctggcaaaaactatggcccacagccaaatctggttgttagctgatttgcaaataaagttttattggaacacagccatgcatatttgttcgcttgttgtcaacaataactgcttcttacctgtaaagtagcagctctgaaatgagaggattttgcctaccaggggacatttggcaatgcctggagatatttttggttgtcacaacagagtgggggtgaggaggtgatgcggctgacatccgaggattctgctaaatatcaaaaggcacaggatagccccatcgccagagaattgtctggccccaaatctcaatagtgctgagactgaaaagccctgctctagttgagaacatgtaggatggaagcatggtcccttaggttctgatacaggtgagagagtagcacctcttcctgtcacacatcaggcaaatgtagtttgtacagtggaagcaaaggcaagagaccctaacaagatattatagcagccttgcaagatttcttgcagcactgggtgaatgcagaatgggtaatggcaggtatgttgcaaagggtgatgagcaggcataagttcagaagggaggatgagatgtctggcaggatgcattgttcagggaggggcctgtcctctccttagtcatctcttaccttcttctgcctccagggtgtggatattaatgcaagaggagagtggaagaccttgccagcccctcttgaccacattaatcttcatgtccgtgggggctacatcctgccctggcaagagcctgcactgaacacccacttaaggtaagtgacaggactcaggttttcctttacatgtcagttagctcaacaatttgtaatgaagtccaccaaaatgtaagcatcactctcaaacccacatgcaattctactcaacacttgttttttctttgtttgcttgtttgtattttaacctttttcagactctatactcttcgactaattattaacagctcttttatgtctaagtgggtgagttgataggtctaagagtgtcatctttcaatctcacaattgaaatggaagtcaaaataggagccaccacgattcataatagttttagtatactattgggtctgattgaatatttcctaataaaactattgctgaaaaattgtttattcctctacaagatgttaaaattctagatcaaagtctatgtataaattaaccatagctaacatccagtgagtgcttgccctgtgcctagaactatatgaatatgggcatttccatgtggaaattatctattttttcttagcaaaaggaaaacataaattctgtgaggttagtactgttaccaccatttcatagatgagcaaaaaggctaagtgatttgctcagagtcacacagctactaagtacatgaatgcggactaaaattcacatctctctggtatcaatactaacattcttagactccctattcatttgattctaaagatttaaataaaaatgaagaacttaggacatttgaaaatagaactccctgtatatgtttcagatattaggtcacgaaaacagattttcagcatcaggattttcctttcaaaaggaaaagaaagaacccagttagtctggttgtcattattttaagagccttaaagcagaatcctcttgattcattcactaattcatttgttcatgatatgaagtcatagagccagacagagacagaattagaactaagacacaagtctcttgaattctagtatgcagtctttatcccccaaagcacttccctttgctgctttatgtttgtatgtaaagtcttggtttgtggctgtggctttacttttagctaatgcctctctgcctgctcactgcagccgccagaaattcatgggcttcaaaattgccttggatgatgaaggaactgctgggggctggctcttctgggatgatgggcaaagcattggtgagtagaggttgcctgagattcatgctgatggcactgactacattcctggattatcttacaggcctgctttcaccttttccctattataacaattttgcattttaaaatataatcatttgttaattcaagggtataatccatattggacatgatctttattcctcatgtaaatgaagctcagttctgaatcacctcccattatgcaacctttgtaatccactatagaaggtagcaatatgggagccatggggaaagtttatttgtagccagcggagataaactttcataggatttatggtcaaggacacattcccgaattacatggtttactgtcccagtaagaggggtaatacctctatccgttgtattatttatgggatattttctattaggagtttataggaattggtaaactctcaggaggattgctcaagaaattattagctatttctagacaagtgctatccaatagaactttctgcagtgatgacaatgttctatatcttctgctgttcaatattgtatctagtaggcatatgaggctatcgagcatttgaaatgtgtgacaagtgcatctgaagaattatatttttaattttattcaatcttaacaagcttaaatttaaacgtgttacattttactagtgactgctatcttagacagcacagttctaagggatagccagtggcaactgactgagtggtgagtcatttagaaaagggccagcacagtcgagctcagtgcctcacgcctgtaatcccagcactttgagaggccgaggcagccggatcacctgaggttgggagttcgagatcagcctgaccaacatgcagaaaccccctctctactaaaaatacaaaaaaattagctgggcatggtggcacatgcctgtaatcccagctacttgggaggctgaggtaggagaattgcttgtacccgggaggcggaggttgcagtgagccgagatcatgccattgcactccagcctgggcaacaagagcgaaactctgtctcaaaaaaaaaaaagaaagaaagaaagaaaagaaaagtgaaagaaaaagaaaggggccagcacacaggaaagagtgtgacagccacgagggcagggtgtaggatgggaatacttgaaaccaagctattgactagttcaccttcaccggctgtgctgaacttcatattcttcctaggcctgtggcacacatttaggataaaggacaaagaaggcttttctttgatcatctttgttctctggagatcacatttttaaatttgcctaatacctcaagataaacccaccaagacaccagtgttggtgtttgcatatgtatatgcatataaatgtgtgtgtggagatgtgtacatacagcaaaagaaacctggaaattctgagctggttaggaagatgctgggatggtagaccacaaggaagagaagtgacttaaaaatggtgtcaggaaactgtgttatatgaagtgactctgtcagacagatgtgtctatacacattcatttcaagcattttgtgtaaactgagtgtgggtgcagggtttgattagtctccataaagagcacttacattttaaaatagaacactcaaaagacagaaataaaaacaaagataagccttactctctcaaacaagacaagtaggcaattagaacagcatttatatattctatagcatagagttctacagcacaggtccaggccatgtttatcttgttttttgtttgcagatacctatgggaaaggactctattacttggccagcttttctgccagccaggtgagtgtgattgatatgaagtgagaatagggttccactggcttaggagggtgctgaatatcgtaagggcataaaataccacctagaatttcttcattgctcatcttgctaattcacattcttctacttctctagacttccggtggaaatttactatgctcccaggaggctttctgcaattaaacctatccacatctcatcagtaatgatcattattctagtttaccatgttacaggtggacgggcagtttctgttatctagcccttgttcctgagttgccttggaatggtctgcacattttgggattcctccacctgtagaatataagtatcttaacagctgagactttttgtctcctgtagagttcagggcagtgcgaaagaccctgtagctgcttgtcaatgcaaagtggatgggagttggcaataggccatagagtgatgaaatcatgatttccatgatccaaagttacaagatggtgactctgaagttgtcttactttatgacctacatttgtgcctaaaaagaggttagaaaaatttgaactaattctgctattatatttttcttttatctccaattcaacagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtttgtgaccagcaaaaagtgcgaatggtattctccacccttaatatgcctagtgcagtgcctgactgcttcccttccaaatgatgccctctcctgccaggccctccgggaatccctgagttttccatgtgttaggaatggaccacgtggagatgaatgaaaaatcatggtttatcatcatttggaatccatggcctggattcttactttccatgtttgtcttcttgtctgcaaacctatgtaaaactttgtcttgactccctcacctctgcctcagagatcaacttcccaaacaggttggaactatcatattttatcaaatatgataccatcagtgaaaattgcttcattatttcatgtgccacaaagaaagaaaaaaggatgacaaaactatgatagaatgcttccttatcactcaattttttttttttttttgagacggagtctcactctgttgcccaggctggagtgcagtggcatgtgatctcagctcactgcaagctctgcctcccaggttcatgccattcttctgcctcccaagtagctgtgactgcaggcgtctgccactatgcccggctaattttttgtatttttagtagagacaggttttcactgtgttagccaggatggtctcgatctcctgaccctgtgatccgcctgccttggcctcccaaagtgctgagattacaggcgtgagccactgtgcccagcctcagatttttataataaacttatagaaagtttttgaaacttctttagccataaagttttacctatatatttcaatattgtaagtgataatatggaggaaaatgttgagtggagatacattgatgattctgcctcaacgtaatttaaaagaggtagaccctaaatgtgaagaagcactagaaatagcttaaccaacttgtatcgtatttaaattgtactatttaaattcatattaaactgttttattatttagtttattgtatttattattatttagaagaaaaatatgtgttacaaattggttaagatatttcctctgtactgcaaaaggtgttggtgattcagcattttataaaaattcttccactagtgtctatgaagtttttttcctgagccactaacacactttatatacattttcatcctagtgctttcttgatcttactaaatattccttcctgtaataatccttaaatgttttcagcccatccattcataacacagtaatagcaatgaagcttacacaggcacagacaataacaattatgccatgagtgctgcttggctcacagtaattctatggttgtcgattacaagacacgctcttgtcagatgaatgttaaatatgtgaaaaatctgtaccttgggattaatgctgtgtagtggtcctgacacttatcatcccgatggtaaatgaaactttcttccttgtgtgcttacttattattttttttcctgaacttttttctttcataatccttcctgatgattaagcctgaaacaaaagttttctttcagttttgcattctttacagttatttcctcatacttgtggttttcttgtcaacaacttccccaactataccataaaggactttgcccaatcctgttgctgaccagctcagggacagacatgcaagctgatgagggcacatgcagtgaaagcttcttgacagcatctgcctaggaagaagcaggaatagtggactcttgctgggcaaacactggggtgctatagtggaataggagaaggaggaaacagaaggatggtgccaaggaaaatcaacacctcagtagaatggaaaagagggcattctctccagtttgtgcagttgtttctcttcagcggttgcatattgaacattttttttttttttgactgagtctcactctgttgcctaggctgaagtacactggtgcaatcttagctcactgcagtctccgcctcccaagttcaagtgattctcctggcttagcctccctagtagctgggattacaggcacctgccaccacgcctggctaatttttgtatttttattagagctggggtttcaccatgttggccaggctggtctcaaactcctgacctcaaatgatccacccacctgggcctcccggagtgttgggattaccggcgtgagccaccgcacccggcccatattgaattatttaaaggcccatctctaccactgaataatctttgtactctaaaaaattagaaaacacccttctcatctgaaactttgaaggcagtcttttaactagacaatacaatgtagaagtattagggggttatttggactggatacttgcacctgatttatttgcatgcaggaaatttcaacaccggatgcccaattcttttcctttggttcctaacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 1900 - DNA, 34382 bp, Homo sapiens
caaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtgagccggcccagggtcctggcagcccaccccggagcccagcgcctagtccctccggtcactcctggtgctccatcccagacaggggaccaatgggaagccttcagttgagggctctgaagagatctgtgtttgtgcaggcgtcaaaatcttaccccacaatttttgctggtcccccttcccatcctacccaatacctgtccactctacttggcccttggctgtggtggtcaacctgaagtattcaagtgtaaagccattcccagtctccccatcttatggatgatgaaaccgaggcccaggaggcacaatggaagagctcctggtctctggagcgccttatgttggtggggatgtcttacgtcttcactttttagcaacacatcattcacgggcaaaacctcttcccttgtttttcaaggggcttggcactcacatgggggcctcacagttgcagctgagttctgatgggtgcgggcctgggaacggaggtggcctggggatgctacttgtcctccttttatcatttccttctctaaagcagagctcctgtgtatatatcttggagactcaacagaagctgagtccagaagcagaatgctttttttttcccctttctcttatttgatcttaatggcttaataataatattaaagacgcttagagatggaagggatattggcattgtctcatccagttgctgagtttgcaggtgagataaccgaggcgcagagaagttaaatgaattgtgcagagccatctaaagagtgggcagcagacctgggatgttaagtcctagatgcatgtgaggagatgcttggctaaacgcctgtaactctgagaatgagtcatccattcccttcaattacagaatccttgggctggagggaggctcaagaagtcaatttgttcaccctgcattcagagaagtccaccagaggcccttcttatctttagagaacaggcttcactccagtcctcaatcttcccaacttcaaggccagccattttcttggccccttttatagccattccaaattgttgagaatgctgtggccctctgtcttaagactcaggctcccacagcttgagaatggagtttggtggccccccaaagtcaagtgtgctcatctcctgcagagggtttggaaagcaggggtacccttattcctattccttggctgtttgagcatccacagcatgtgaaatgctgtgctttgtttggtgaggagtgcagaaaagttaacagtctagttactaattttctaggtactaattttctctaacatccaccttgtaacgccagccttctggaagtagcaccatgctaataggtcatgtctaaacacaacaccacattgagtttgtccttgtggagtgcacagcctagggctcagcagctttaagaggccaagtgatttctgaaggagtttgggaggtgatgggcctgttggctcttgtatgttttatattgatagaactgcaagaggccttagagattaaactaatccattgcttcttaactttctatctttagaaaaatgtacgtacatcccaaatttgcatataatgttgggggtccaagggccttctttggactttagggtgggaacccctgatctaagccatgcttcttgttttattaagcacccattgctgccaaaggcacttcagagctgcctgggttgcctgcagagtttcctttgtgagccctggcctccacttggcccattcatgcctcaggggaagttcaggccatttgcagatggcccttgccctctcagccttccctggctctctacacatatggtatttataacctttcatacattatctgtagcttctccttcctggtgtacaatcattgacaagacaacatccatgccttagcatctctggggccttgcccagggtctcggctataggaggttcccagtagacattttgcagaatgggagggaagatggggagaggtgaggatccccaagcagcagacaggtttgagcgccttttgtctgagacactctcccggctttgcctaagtcatcactggctgttaactgggtctaagaaagtggcagagtcaaattgccacagatgattcctcatctgagggagacagtaagaccgggagaggcagatcgctcttctttcttatcctccatgtgcagtagttccctctccccactcatgtcagcaactgaatttagctcatgcgtcaaaagctgtctccccttgagggagtgtcagccagcgctgtaggaggggtcataccacagggaaccctccagaaccaaatcatgtacttttcttctttctcataaaatccagtaaacagttgtttttaattggaaaatatagaaaagaataaatttaaagaagaaaaaaagtcacccataatcccatgacttaggagaagctattttaatttacatataaaatatatttatatataaagcatataatttatatataaatatatttccagtatttgtagctattttatagcacagttgagatcatgctatacatataattttgtatgctggcttgtttatttttgtttttgtttttgagatggagtctcactgtgtcacccaggctggagtacaatggcacaatctcggctcagtgcaacctccgcctcctgtgttcaagcagttctcctgcctcagcctcccaagtagctggggttacgggcacccgccaacacgcctggccaatttttgtattttaagtagagatggggttttgccatgttaggcagactggtcttgaactcctgacctcaggggatccacccacctcagcctcccaaagtgctggggattacagacgtgaaccactgcgtctggccagtttttcttacttatagcatgaacatttcctatgttataagcgttatttgtcagcattatttttaacaactgcatactatttcactatttgtatatacaattattcattcaactaatgaatagcattgtttttaacagctgcatactattccattgtgtgtatatacgattcttcacttaatctacttctcttggatgttttaggctatttctaattttttgttattgtagaataattctgaatatctctgtgtataatattttttcctatattgtgtgtgtgtgttttttttgtttgtttttgtttttgtttttttgagattcccagaagtggaattgctaggccaaaggttgggcagggttttgtttaaaatattttttaactttaaaatttttgtactaagagtcatattttgcagttgttttccgagagggtgagttgacactgcatcccttccccattgcgagtaaggctgctctggggtggataagtgcgtccatgcctaggtctcagaaggcctcctcctctcccttctcccatccctgcttcttgccttgattcttgtctccatgccaggcctgaacctgtgaggggccttttcctcagaaacaaagatttgcctctttattcccccagttcttggcgttttgcccctgagggtccatccactttcagtaatatgtgcttgccacagcgtctatttcttgtctgaggaagaacacacagaaaaggacattcttttaataactagttaatgtgctgtgatctctgcctgaaataacttccccggcctaaggcccggcaacacagagtaataaaatgaacagtaaattggcttggcggctgccctctccaacacaggctgcctctttggagtacagtagctctgtgtccctctggccctggcagcctttcctcctgcctctgctattcttctccctttgctatttctctgcccggcatgcagccttgaatccctccttccttggaccatctggcccctggtcactccttctcgctgcctacttctgtggccccttattctgcaggtagtggaggtgagtagctggctgctccaggggctgaggaaggcctgagtacttccatgggccatgagggaggcctccctggaccttggcagagctgagagagaggctctagtggattggctgtggggcctggggctgcagagctaagctgccccgggctccttggggaggctgggctggtctggagggttgcacggaccttctatcgtgtgacttggactcttgaggcatgagcacttggtagggctgctgggatgggagtccatcgtgagggctactgagctggccctttcagcttctcccacttcaggagactctgcaacctcccaccccaaaggtgccttcgcatttgctgtggccgcaccagctctcatcaccaccctgacatccccaccccaggcattacagcgccactgcgccgggaaagatggttctccagaaagccaaagggatagagtgagagggccaccaccccagtagacccactcactgcaaagtccatcctggcaggcatagcccctgcaccaccttcagccctgtccacccaccaaggccaggggatgtcctttgtctgatagggttctgatctgctgggtctctaaaggggcctgggtgaaaatccacctgcttcttacaaggcctaagtgttacacaaggaagcagaaggccttaggccagaggaactgtgtccgcgtgcctcggcctggcttaggggctgccttgaaagtcaggtgcctggcagtcatcaggcaaaacatttactgggaggagaaagacctttggggaaaggtctccctcccattcccattgacagtgggacgaaggccatggaacacagtccaagtcagcagaatccagctccaccacttcctgcccagggacctggttaggaaggtctgacagaggtcaggccacctcccctttctgacccgcagtttccttatccataagatgcgaatagtaataaccgcctcacagcattactgaccggattcggggtggggagggggaggcagaaccagtttagcaccagctgtgctccaggcaccgcgcatggggctttatcatttcctctcctctctcgagctgactctaacaggagacttagaggcaggctctcaggaaggtgcgggaaggcccttctccagcacgaaggggagggctggagaaggggcacgtcgctgagctctggggacggtgccgggtagtgccctgggcgggctggcctgtcgcaaggaggctggactgtctggccaccagattctccttcgtgctggaatcccttcatcacatggctgagggtgctttcgacagggccaattatagctgctccagggaacacggagctgactcatgcctcaacttggccgtggagagtctcccatccactttctcgcttgtgtctgtgggatgcgttacagactccctcaaaccccatgaggccgacagggcaagtattatcatcctggactcagtctgtcctgtctcccctcattcttgtgcatccccgtctctgctgttcccaccctggcctgaattaacttttcttttttcacactgctgtgggaatgttttctcctggcaacagaggcaatctgtatcgcttcccataaagaatcagtgcatgagattcctcaatagatttttcctttctggacacagtggtggctttgttacaggggcacctgctgctgtaagccatacccaaatgtccctgagaatttaccccacccgactgtgctgcctggacttgctggtggcctcattagactcagtgtttccccagacccatgtgtggtcagcaagttttgggtcatgtgggtttagcaggacaaactctaggcccttgcctgaccacctcgggctgcagccctgtaacttccccggaagccaccctgctaggctgggaagccttcactcatctgctgagaacaccacgtccctctcaggggtagaatttgagacgcctgtgtgagaaggatccttcattgctgctgtttggccctgttcattctgggcatttttgaggctgcctcagaatggttcttttcagccctctctatttcagctgtccctggagcctttgatgatccctacttcccgcaatccactgttgctgctcccttgcagagccctgcttagggcttctcatccacacactcactaggtcaggtgcctgggcaggcaaagatagatggggtttcccaatcagggtggaatctttctcgtgaagggtaatcttggccgactgtttgtaaatccaaaagtgtccttttagagcccatggagccagggacctgctctgatcatatgatagcagcagctttgggatgccacaccccagtcactgaggccaagcagggaaccccacagctgatatttacagagatgagtacactcctgcgtttgtgggcctcaaagcctcacctctcctccaaggcctggccctgcctgcctcctgccaaaccatatttctttgtggccttcttgtcccattcatcgttctaaaagggagctcaacccttttggcctgtccctaaagatggctgcatttcctggtcaaggcaggaaaggtgagtgtagtggttaggagcgtgaactcaaatccaagggccaggttcaaatcctaaccctgttactgtttactgagtgcatcacctggggcacctttatctcctcctccttcaaatggaatgataatctaggtaatttaaggtactggttaaatgcttaacttctgcaatgaatttaatccccagaactccctgtgagataggttttcttattaggtccatttgatgaggaagagcatagtgctgatatcatagtatgtgggaaggtgaaacgagataatccatggaaaatttagaacaacgtccggcacatcgcaggtactcagtcagtctgaacgattacccgccatgttatggagtgaggtactgaggttccctgagttaagtaccccctgaagagcatagccctcaatgttagagaaagcaggttggctggccccaggccactgagattcacagcttctcccaggaggccctgaaggagaaggtattctgagaaggcaggaagtgctagccaagggtgcagctgttaggattcactctcatcacaacctcggtgccagctttcaaagtgatcctctgaccaggggaaatcctgccctctcactctgattattgaactgggatctggagagatgaggggcttcccaagacaacctgaaacccatctgtgccctgtgtggcgggtggcctttggacaggagggctccaactctcagcagatcagcagcttcctccagggctggctgccgaggctcctccttggggacggagcccacagcaacctgactttaactaccatggaactgcagagtaaattcacagctcagaacgctgctcaaaggcacaaatgggatgttgatgagtgggaggaagccctggcaagcctccctggccaccacccctctgtgcagaccaggcctgctgctgcagtccacctgtgcacattacaacatccttcatggttacaaagcatgcacacgttgtggggaggggtgtgtgtgtgggtgttgggtacagaaggaaggcattgacagatagaaggtaactttttgacacctgtttaggtagtgcaggtaaaacaccaaacacatttaaaaacatagcacaattataatctttatctgggaatcccaccatatactattacattcgtaatgaaattgcctaatacccaagggcacaagggaggactcatttgctgaacatacctattttgccaggtactatacaaggcattttgaatgtagtctcttctttgaaagttggaattaaatggataatgacaagaaagatagaatgaaaggtgtgcaggttgcttctatgctaaaaaataagatcaggtggctgggtatggtggctcatgcctgtaatcccagcactttgggataggccgaggcaggtggatcacctgaggtcgggagttcgagaccagcctggccaacatggtgaaaccccgtatctactaaaaatacaaaaaattagccgggcgtggtggcggctgcctgtaatcccagctactcgggaggctgaggcagaagcatcacttgaacctgggaggcggaggttgcagtgagctgagatcatgccattgcactctagcctgggcaacaagagtgaaactccgtctcaaataataaataaataaataaataaataaaatcaggtcaggcacaatgcctcacacctgtaatcccagcactttgagaggccaaggcaggcggatcacctgacgtcagcagctcaagaccagattggccaatatggggaagccccgtctttacaaaaatacaaaaaaattagccaggcatggtggcaggcacctgtaattccagctacttcagaggctgaggcaggagtctcacttgaacctgggaggtggaggttgtggtgagctaagaacacgccactacactccagcctgggcgacggaatgacactccatgtcagcaagataaataaataagatcataaatgtgtagatctgcatgaacacttaataacatagtacttgtgtgcatgggacatttctggaagaatacaggatacaaaatacagatactagagggtaggataggatggagattcatttttctttctttctttctttctttctttctttctttctttctttttttttttttgagacagagtttcgttcttgttgcccaggctgtagtgcaatggtgtgatcttggctcactgcgacctctgcctcccgggttcaaatgattctcctgcctcagcctccctagtagctgggattacaggcacctgccaccatgcccagctaatttttgtatttttagtagagacaggtttcaccatgttggccaggctggtcttgaactcctgaccttgtgatctgcccaccttggcctcccaaagtgctgggattataggcgtgagccaccgcgcctggccagagattcatttttcatagtgtaccttttatattgtttgtattttgtatcatatatgagctatttttatattaaagaactaaccggttaaataaagacctatgaaaacccagcagagtctacggaaggtttagttctaaccatgcctttgtgtgggtacttcagcaggttaccttcagttatggagtctgtaatactctgtgtaagaatcatttcaatccatgctttgtttttgagcccaaaccttgctccttctacccccgcccaccagcccccaaccaattgagaaagggaaaaagataaggaccaaaaaacagaatattttaagttcagctgaaattccacctcctctacaaagttctttggacttgttatccagcaggcatttctcccggccatgagatcttgctgcggtggccctgccctcccctctgactcgcatgttgtctgccttatagtagacatgccgtgttgatctttgcgcagaacgcctgcattaggactgtgcttcttcctgctaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggtgagtgtggagggaacacaacactttcaggtgctctcttttcttcttggggtatggggagtgaaagaacagtaggcagggtcttgggatgcttggtgcctagagtctcctgtcaatctttccatacctagattgtcccttgcttgctgagagtgtaactgagtcagttgtgagatgcagcagctgcaaatgctgggttgattcctccttatcagggagcagggaaggatacaacaatgactcaggtcacattcccctaccctgcacctacccctagtaaaagtggaggaggatgctccatatagttcccagtatttgcctaaatattcagtggctgggatttgcatccaactggaaggaggcagacgaaggttcttttctattcacggatattgtttctacctggtgggaagaaccctggaattaagagggaagccttgggtttgagcactaactcttctactaaattgaatgaccttgcacaggtcacctctcttcccccgggacaagttcagccttgcagataccaagatcatcatgatgatgtgaatggagaaagctctaggaatgcttggcaaactaatctgggccttcacattaattattctgtttaaccagaatgcaggctgatcccctgctcacacttattacactgataaatccagtttcacatgtgcatggtaaatactttgaaaataattttaaaactactttttctaattggaggtttttagagtagaggtaatgaatatgggctttgccttcagatagacctgggttcaaatcctgcctaatactgtggctcttgaacaagttacaaaacttacttgtttctaatttttcccatctgtaaataggataataggagttaaaggagaaataagtgggatagtgaacagaaaacacttcgtgcctggcacatagtaaccaacaggttagttagtgatagtgttactatgtcttatttcatttgattacttaattgtttagtgaatggaataggcatctgctgtggccatttttcattgtagaagttgaggctcattgcccaaaggattctcgatgtctcttatcccaaatatatatatatatatatatatatattttttttttttttttttttttgatgagatggagtttcactcttgttgcccaagctggagtgcaatggcgcgatctcagctcatcgcaaactctgcctcccaggttcaagcaattctcctgcctcagcctcccgagtagctgggattacaggcatgtgccaccacgcccgactaattttgtgtttttttttttttttttttttttttagtagagacagggtttctccatgtttgtcaggctggtctcgaactcccaacctcaggtgattgacctgcctcagcctcccaaagtgctgggattacaggcgtgagccaccgtgcctggccccaaataatattttttataaacctatgaacttgtctctgacctttcttgtagtggcatggagtcaataacagtctaagacagggacagggagaccacgacatgaatgaaatgtggaactgtgagtggccaaggtgtgcgcccagagtagggagcagaggaagggtcacgctgagaaatcttgggaacttggcctggcagagagagaggcccaggcatggggcttggtttatgttgggaatgaagctgaggtccctttaggaagaatgaggaggtcgtggtggtaaggtgcagtggggcaggtgtcctggagtccaggggtgtctcttatacctggaactgagtaaggaggtcctggatgcccaaaatgctaaaatgcataaatggagggggtgggatgagcatgattcaggagaatgagtcgctggagctgaagagaagcagggatatctgagcaagggggtaggcaaggaatttgattttggacacattgagtttgcagtgttagtgagtcagctgaggagcatcgtcctatctgaaggcagagaggaggagctggaccccaggggagaggagggaaaagccagggggagacaagaggaaactgggctcatcacaagagaagagtacaggtttagtggttaatgccattttgggataattgtgcttataatgatatagtgtattgtattatatgtaatagcatatagcctattatgataacagaatttaagtgattgccatcatatgctgggtgcattcctgagagctgagcgcccttatgtcattaatcaaacccagcaagtctcattaactccattgttaaatgtattgaaaccaggtggtgtgggtgaggttgggtgggggtggtttactttgagtaaagacacctctttgaatattattatcttcatctagaaagtgataaaatgtaaataatccattcctgcaaatgttgtgtgttgtgtgaagaagatctgagagagaaaggaaaaaatatataaatctttacagtggttaccttttttttttttttgagacgaggtcttgctctgtcgcccaggctgaagtgcagtggcatgatctcagctcactttagcctccatctcctgggttcaggcaattttcccgcctcagcctcctgaatagctggggttacaggcatgcgccaccacgcctggctaatttttgtatttttagtagagacagggtttcaccatgttggccaggctggtcacaaactcctggcctcaagtgatccgcccaccttggcctcccaaagtgctgggtttacaggtgtgagcctgtaaccggcctacagtggttccatttaggaagtggaattgagcagggcagaaggatagagaagaggaacaccttcctatttcattttatgccttgctggaccatgttttggttttttgttttgttttgttttttgtttgtttgttttttaccatgtgcatatattttacaaaaaaaaaaattataaagaaaatatataggaaggtgttgtgaaacaaataacatgcacataaaaggtgatactattaaggggtcaggaatctctctctaaatctgtgatttcaatgaataaaatgaaggtgactgaggcaagatcctgcatttccagagtgacttggtgtctggcctggagagcagacattgacaaggaaagaaatgtggccacaggaggggctgtgtctcctgcctccttcccaggtatcttactaagggatagaattcgtgttttatttcaacagacaccaggcccctagcggccttgggctctattctgtgggggaatataaggctgatccagtccagtgggcacaggcttggaaagagccagtgataacccaggcaagaggaagagcaggcctgacgaggcctttgtgggaaagttggcatttgaccctgacattaaatgatgagtgaagtggcaccaacagtgtaaaaaaaagaggacattcccagcagaaaatactgaagagagaaagaggagaaaatatgcatcaccagagaagaatgatgaaagaatgtggcttactgcaggcacctatgaaatcgtgaggttctgagattttctccaggagcacgcagccgctgaagtagtggatgtttaggttggctgggagtctgccaggcatgtccattgaaacgacaacagggaatgatgttgcatccctcttgcatgtgccaccagcttcactgcagtccacacaaggtgctgcaccttagatttgtccgcacaaggtgctgcaccttagatttccaggttcctgtctctatgctgctgagtggtcctatttcacaccccttgtctgctccccttccctcgcttctcttaaataacacttgactgctttcctaatagagatatttggcctttaaatgcccaaataaatgttcctgggtggttcccattcttcgaggccagctccagtgcctcctcctccaggaagccctccctctgcctccaggaagccatctctctgccttgaatcttccaaacactacatctgacttctctcagggtgctggtcccattgcactgtgtattctgcttgtccatgtacaggcctcctggcctcctgtcctgcaccaggctgtgctccttggagacagggatcgaggtttggatatcttagtgtccccaacagcaggagttggcaagcatgaaccatggctgcctcacaatcatccagggagcttcctcaaggcatagagcctgagtgagacccacttctggggctggggctgggattctggcctggctcctgggagtctccattttaagccagccaggcttgtgatcctctggccatagcacccagcctgttatcttgcacagagtagggcctcagttactgttgaatgataccccatttacaaatgaggacataaacagagaagcacagccacttggcccacaaggatcaaatcagaaggaggctccccagaccctgactctgcagtgatggtttgggacagacccttgaagtccctcctgccccgctagtccctaggggctcatttgaagaggagccagggggtcttctcattggctatctaaagaagctaaggttcctagagagggccaagctaagtggagtaactcaaggcaaggaggtagctgaccaaggacaaactaaggacttggggccataagaattaaacccaggctttgatcacacatgaagacccaatgtcgctatggagtagccctgcttgctggtcacacagcattttaccaaacacacccgggtgcagggcgctcttaacactggatgtggggagaggcaagaggactggggttcagccccgggtcagctgtcagccacaccctgaactgggcaagtccatggtgaactaaacccttcaggatgcacctgcagctcacctgagagagacaagacaggtggttggagtcatgcggctaggtcatgaaaggtgggcgagtactcacccaggttacctctgcccatgcaggttcgtgtgtgcccagctacctaaccctgtgctggagagcatcagcgtcatcgacacaccagggatcctctctggggagaagcagaggatcagccggggtaagcaacctgcctgaggggtgttggctgtgggctccatggttctggcacgttcagtctcttacataccagaagagaagcacccagggccatgctgtcccttggtgagccggcacttctcctgtgctgtgtgggatcattttacctggggcagtcctaggccggggttggcaggggtcgggagaggggaattcaggtccaccgtagctcaggagatagctggcctcagtcttctcatctgtaaaatgaagacatcaatatcagtcttacctcgttgggtttattcatgctacaaggggcaccttccatggccctgatcctggcttgcttcttaagttcctggggagcttgcagctctgcagggcagccaaatgcatacagagaaattcagctcaatggtatcagtgccctgggtcataagaggagggaaccaggtagtgaaagcacttcaaaaactgttcactacagataaatacaggataattgctcattaaaggaggttgcctggtatggtggttagaagacagaactctggagtcaggctggcagggttctaagcctgcctctgccacttcatagcacagtgaccctcagcaggtttctttatttcagttactttgtctgaaaaatggtgtggggcggtgggggcgggtggggtgggaatagtattatccatcttacagagttgtttgaagattaaaagaaatgcttaagataaaaagccttttctggttggcacatagcaagtacctagtaaccatgagggattatagatgatcatcatcatcatcgttgttttctttttttttttttttttgagacagagtctcagtctgttgccaggctggagtgcagtggcacgatctcagctcaccgcaacctctgcctcccgggttcaagcgattctcctgcctcagcctcccaagtagctgggattacaggcgtgcaccaccacacccagctaattttttgtatttttagtagagacggagttttaccatgttggccagaatggtctcgatctcctgacctcgtaatccacctaccttggcctcccaaagtgttggggattacaggcgggaaccaccgcacccagcctgttttcttttttctaactctaaaatgctaggcagatgctatcaaaagctaaaaacaactgctctgggcccccacccccagcctgtcctggcacagtttgctgagtgtcctgtatagcccactaccctctctgtgccatgtgttgtatctctggcaagaaaatcagatgacgccatgcccaccccaatattggagctagttgccagggctggagccacatcagcactcagaagtcagcctatgggtaaggaagggctttgaactgctggggttctctgggaagcagctagaactcttgcctgaatggacctaggtaggtgactgtctgcatgtgccttcaccctctgtgctctgtggctctggctgggacacagatctgccctgcccatgtctgtgccacaatagtggggcccagaaacctttgctctttctgcaagagcatggcctgcccaggccagcactgctcaccccagacccctcagaggagaggtcacagcctcatggtgtgacaggccagtgctcctgcagttgtgtattgacgaggcccaagtggtgcaggcccttggcccaggtgcaggccactagtgccagacctgggcttctgtccagtgctcctgtgagctgccttggtgtcctctctgcagaaagcagctctcttctgatgagggcaggtgtgtggtgcagggccaggctcggctctttgaggctacactatgcctgtgtgtgagctgccatggctgggagtggaaagggaagacagtgagagaggccctccaggtcagcagcctgctcaagggccaggttaacccgagtcagccctccagggaagacacagcctggagtcctcatcctgtagcaggtgggagggagtggggaggctgaacatcctgagaggaaagccctgcccttcctccttaccacctcttgctttgcttaggaggtgagacctgggaagaagaggggaaatgaagcaactgagtcaggagggacttgggaaactgtgttagcagttcctgtaattggtggcctgtgaattctgggacatcacagtgtcacctgggaagggggtcttggaagacttgatctcctggctccctatctctgggctgtatggtggaggtgatagggagctggaacccctggcctgggaaaatagggatgtctgagcctccctccttccagccagcacgcacgctgtaagcacctggctccctgttaagggccctgtggagggacagcacgggtggtttttctgtcttgctttggtttgtttgccggagcaccccctttctcctaacccacctattcccaaccccaagtggttcatctggggtttaccctgcgtttaagcctgaaggggatttgctgtttcactcaggcagctcaggactcctccaggaaggctggggaaagccaccccttcccagtgtgaactccctgggggacgtcacatgtgcacctgcaaggccagtgtagcctgaccagcgggtccagagaggactccagcctctgcggtttccaaggacactgtactaggaattcagagttctgggctttagaacctgtgtgtgtctcaacaggtcacattttcagtgtccccatgtgtaacaaggggtaatgatatgtaccacacagccgtcttgtgaggtctatagaccatatgaaaacacgggccatagccctgggtctggatcaccatgagctaccttcctccctccctccctgtcagttggcaccacctatcatacaatcccagagtaatctgtgtgaatagtttcccttgtagttgtgcagtgcacagcctgtgcacctgtatgtggcaggctggttcccagggactcctgccttcctcagttcctatcctattctattcttttcctatttctgtttttgttgttgttgttgttgttgctgttgttgttgttttgagacggagtctcgctctgtcaccaagctggactgcaatggcgtaatctcggctcactgcaacctctgcctcctgagttcaagcgattctcctgcctcagcctcctgagtagctgggacgacaggcatgcgccaccacacccagctaatttttgtatttttagtagagacggggtttcactacctctctcctgcctttgtctttggaccccagtgactgccttaagcaaattaggcccttggtgttcttgcctgcacttcctaatgcctcccatcccacattgactaagcaccaggtccccctacctctgggagaaatgatggccccaggagtggctttgcaggccagtttgttttctgctttcctgagtccagactgtaaatgcagctgctggcaaaagcagcctgcgttaaaaacaagagctagaactgggctgctggcgcctggggcggtgctgacctcagcaccctgaggagaccaggacagttgggggaagggcgtcagacaccctcagttatctgtggtaccccaaacgagtaaagtttccagggtgcagagcccaacccctttctttctcacaattggccttagaacacatagctccagtttaaactgacgcacacctcccccaccctcccccacccatacctccttttacgcacacacccactcccacacccacacatgcatacacactcctcacacatatcctgcatatacacaactcccctcttccccacagcaaccccctcccacacacacacacacacacacacacacacacacaaatgtgtgcatagaacaaaacttgctttctcatggcttcttgcctagggctccaagagctctgggtttggccacagagcagactgggtgcttctcgccttactccagccagcccaggcaaggaccggacacccttcctccctgggatagtcctgccaactatgtcctacacgagggcatctagaacctgaaactcagcccaccttctgctcactgagcctcatacctggcgcagggctgtgtctcaccagataaaaaggggcatggttatcaagtcggcacagaggcccctactggccatattagactgcctgttctgcaaagtgagctgcttcccagggctccaagacctcaggcttcacaggaaggagcactcgggccccaggctggactagggcggcaaagggtcgtccttgctcagggtgtggaccctctactgggcctggggcggggtgtgtcttgtgggaagaaggctggggtgcccgggaagctgattctgggaggtcctgggccagcacttgtctctggatgcagatgcattggggtgggcaggggaggaagacagggaggtggttcctggaagtggcaggatgtgccccagcctggctcattactgggaagaagtgaggatgcagcaggagtgggagggctccagaaggctgagtgtcctgagcttaggaaccacatttcctggctgcttcccagctagaaatccccataggcgccaccttaggaaagcagggcggggctttgtgctcacatcacagactgcacagcttgaagctcctccccacaggcccctttctgcacaggtgagctcagtaaggccagagcaggttgaaaatttgcccggatcacacatctagggaactcgggtcttcctattcctggtccacggcttctcagcacattatcatcacctgccccggaagagcacagggggtaggaatgagggcaaacctctcatctccaggtttcctctaggggtctttagggctcagaccttggcaggtctgggctgatccttgcagcctcacattcctagcccatccagggcaccctcattggagcagagcctgcacttaaaggcctctgggtcttcccagactacgtgccggtacaggcacgcctgtgtgggcgctcctgtgcctgggcagagcagccgagtcctgacgcccttcaaaaggccttgccaaccatctgctcgggccgctctttgccgttacttctgggaagcatctaatgtggcatttcttccccgttgtcagccaaactcttcccacattttggaaattgatgccttgttattcctcttttgctcaaatgcctttaaatcttgacggagatttttttggggagggatggggttttgtatgtacccaccgcaagtaagtgcctggtttgagggctcagcctctgagcttcaggctcacatggctgtgagctgttatagaaagagaatgtgggctgcaagtcaaggagctgggttccaggcctgagtttgccaccacctggctgtgtgagcttgggcaagccccttaatctctttgtgtccagattccctgtcctgtaagatgtgtatgccctacttacctcctgggatacagagaattatgaagagcgaatgaggtcacgtggctggaaacccgaagaagtatgctgccctgtgagggcccaggcactgcatgccaggccatgatggaagccggcgggtgaggaaggggtggctttccttactgtgtttgtctgattgatttcctcttgcctggcattacttcaaagtgctttctttccagtcatctggagcctccggttggaggggaccatagatccctgcaggctgcccagtctccaggcccggagctggctgactagacctcttagagccagcagacttgtgctatgaagtccaggaagggcagcttctctgctctgtctcttggggcttgaatctcccccgactcactagtccatatttcatgaacacttgggctgccgcaggtgcccaagagctaccgttgtgggtctcagagccatcgctgggaccagagaggggaagggggcctgtcactggccatagcactcaccgcagctgctgaggcagtctgtgctgtcagatcttgttgccacagctctaccacagagtcctcattcagctctaccacagacccctcattcagtcatttgttatccctattttgcagctgagaaaattgaggttcagatttgccaaataaatgagaaagctaatcctataccataccctttttcttactgggtccagtccatacctttgagataccgccattcctagatctgcacctaagtccaggccaagtgaacaactaaatatccaccctacagatgacacagcctcggggttagccaggagcagggaagtcgagcttcagagcaacccatggagtcattgcttgatggtcatggtcttcacagccacacctggctggaagcttctggcattactgagtctgtaattggatagcagctttccagagcaaataggaggcctctgcttataaaatcacggaaagagttcccagaagcccttggcctgtcctcaggcagaggcagacttcacacaggcatccccgaggcctgtaagacagcagcctgcagcctctctctcttgctgtgcctgcaaagggtcccttgtagctaatctccatccatcctgttgtactccccaccctcacacctctggtctcagatgcagagaattgtgaaccgagaaaggaagctcggaggttgtccagctcaatcccctgatttgacaggcaaagagacagaggactagagaggggagattcttgcccaaggacacacagtaagttagtggctaagcggaaacgagaggtggactcacccaggccagtgctcctctggtgactcctacagagcacatcccatctcatagaaactagggcttaaaaggagtgctttacaaaaaacagcagggcaatgagaacagccaaggtcacagctcagcagtttcacctgcatcctctgatttgtttagatcctcacaataaccctacgactgagtcactgattcctcaaccataaaactgaggcccagagattactcatttactgtctcccagatgccaaacgtggaacaggtttccacgttttccacgtttcacttccgttcagcaaatactgatagtgcacctgctgtgtgccacacaccgtgctgggtgcaggggaagcccagaagggtgaggtgctgcccctgccctgtccagctcccagtgcaccgaggatgatttcagtgagctgaagagcagaacaggagcgtgcatgatgctacaagaccactgagggcagggacagggataggcaggggtctatcctgttctggcagcatggacatattgctgcccctcagcctttgcagacacagccttctcttacatcgctggtgtcatcagggattgcagcaagttgcagggacagagcctcttcccttctctgcagcttctctggtgtctttgttttccccagcctggtggaggcgtggctacagtgcaagagttgagtttggagttcaggtcttggctctgacccccagcattgcatggccttgggcctttctctcaccctctataaacctccattaccttgtcagcataggactcaacactggctgccctggctgccttagcctgttctgagccattgagccaatatattggggctgagatttgctggacaggtgagagggagctgcagcccagtcttggtcctcccagcagcccctcctgtggcctgcactggcacagctaaaatccagattggggaataaggagcagcagaaggccagaggcctggcagggagttgtggagggtccctactgccctcctgctgtgagctgtttgcagaggtgggggttggggattttcttagccctctggcccctccctacccacagctctgagggactgcctttgggaggtgacagcagccttgccatgcgctgtgctgaagggaagataaaaataggctggagccatccctgggaagggaaggatggacagagggatgtaggaaggaggggagtagtgcgggctgcaggcttcacctgaagtgggaatgcttaggcttcccgggctccagtgaggagctggctgtgcctgcgtgccagggagggagggagggaggcagggagcggccaggtgcagaacggctggatggctgacagctgggtcatctggcctcacgacttgccaactgtttgactctctcctctctgaacctcagtttcctcccctggaagtgagaacgatactcctcgcgctgcctgcctcagagcgtgtcgtgagggtgacatgagataatgacatgaacatcttaccgtctgcagcaagcactgaacttcgagttggaggctaggggtcgtgtctcatgggtggtattggctgagtcacttaactcctagagtttgcgtgaacatctccgagggagggttgatgatgcccctgcccactgggcagagcagcctctgaagcactttcctgggccttgtctctgagccgagacaggacacctgtgttcaaaagagaaggcaaaatctagttcacaccaggccctcgatgacgcacccatcaggaactatcctcaggatggcacctggagatactgggccagctctgccccttcctgagcctcagtttccctatctgtaaatcaggaagttggaccattgatggctaagctcctcgtagcctcataggtctacgccacaggagcagggggagaaggctcaggtgttagttgagctgtatattcattgagcagctgacagatcttggagaaaatcacatggcaatgggaatgcttggaagcacttcatttaccaaagacagaggagctgaaaatggagtagtactggcatccgggtaaccaaaggagggtttgaccttcctttgtttgttagaattctcttacagccaccagggaaacattacaggggtcctccaggaagctttagggcagcaagttttcccgaccgtctgatcccatccccctaccccctgtggcagtgcctccacacgtcctaaatatgtaccccactgggtgttcactagatgccacagggtgggggaaaggctttttaaacctagctccgttggctccattcatcctcatcccccaccccatcgatgcctgctacttagtctgaaatgacagcctttgaaagtgaaagccaactcggtgcagtggttcatagcactgactccagggctaccttcctggacttgagtcccagcccattgcttaccagctgggtgaccttagacaagttcctttatctgtttgtatctctggttactcctcagagaagtggggctgatattagtgtctaatgaccctacacagagtcatcgtgaggattaaaggaatgaatgattataaagtacttaggtcagtgctgaacaccttttgaatgctattgttatttttatgggccagtggtattcaaagtgtggcccttggaccaacagcatcagaatctcctgggagcttgttagaaatgctctgcgccagacctactgaatcagaaactttggggatagagtccaaccatctgggttttaagaagccctggggggattctgatggaggctaagtcaggacccctgttaaagacagtcagagcttcttaagtctgactcactcacaaggcagttgcctgatgatcttgcctggtctctagcctccctctgtgaggcagggcaggctttttcctaatgatttggtttcccattcgatggtggcaatgagctttgggtccccagtgtgtgtcaccttggaacccttgtgctatggggagccaggatggttggtcactttagtacccaagaaagggctcctaccttggtgccagaggtatgccacgggggagtggcaggaggagaggctgagaaccctgctcagactcagaatgggaaagcctaacacctccatcttcatgcgactgctgctgctcatgggctgtgtgcccttcgacaaatcacttgacttctctgagccccacttccttatctcttgtcttcctattttatgtaagaggagcctgagacacagaggtaagacctactggggctctgggtgtcagtgaatgtatagactattggtccaccctcctacttcagctcctactggatccacagctacttgggattgagcagaacaacttctctggggctcctgtaaccagtctgacctaaagcagcttagtgctagataaccaagatgcgggtggccagagttccagtcacatcctaaggaagaaaccccttgtggtttcaagagttgggaattttgtgctgcagctgattacaaaggaaagagcctgagtgagaacaagatgtttttataacaagaattgcagatttcttccagaccagtgacaggcatggtctgaaccatcatcagtatctactttttagtgtttcattgttttcagaccttagaaagaatttctgggtctttgtgtcagattaggtgtccagactttcttttccagcgggctgctaaatacagtaagcacggataggggagctggtatggaaataatgacgttaataagagttactaggccaggcgcagtggctggctgggggcggtggctcacacctataatcccagcactttgggaggccaaggcaggcgcatcacctgaggtcaggagttcaagactcagcctggctaacatggttaaacctgtctctactaaaaacacaaaaattagacgggcatggtggcgcatgcctgtaatcccagctactcgggaggctgaggcaggaaaatcacttgaccccaggaggcagaggttgcagtgagcagaggcagtgccactacactccagcctgggtgagagagcaagactccgtctcaaaaaaaaaagtaactagcatttactgagcacctactaagtgccggattctaagagtatttaatcttcatagttctattaactaggtattcatattattttagtatttaacagtatttttagacgaaaaaaattctatgagacattgagtaatttgctggagtccaaacagttaaaatgtggaggagccaggatttaaacttagatctgactcccaagactgtgttatttctaccacacccgactgcttctccaaacccctaccctataccccaaaggccccagcccctgattgtccctctgccggcagggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtgaggcagccccctgggaggtgggcagcttgggcaggggcccagagtttggggtcagctgcacgagctgagggttgctgcctccaacagccagtgcatcatgtgtgtgacaccaaggggcaggacagtgcgggagccatggttacaagctctcaggtcagatggccagattggaactgactccattgtttactgtctgtgggattcccagccttggcaaggcctttagtctctctgtgcctctgtttgcatctgtaaaatgaaggggttgttggaggataaagtgaaataaagagtctcaaagccctcatcacagtgtctggcaccttcagagatgctcagcaactgtcagctgctggtattgccttcagcagcagcaacatgaccacctcaccctgccttgaccatagctccccacaacctcaccttgcccacataacatagaaaaacagcccagccctgcaagcaacatggagccatgagggtagaggtagaaattatttcaaaagtaggagcaggaggaggcgggagggatgtaggggaaggaatgatgcaagagccatcctagaaggaagggaccgtccagggtcttgatgtgaaggcttctctctggccctgtttgtcaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggtagcgagggctggggtctctaagacaagggacagtgtcccgagagctggctgagcagcctgagtatggaggaggccactcttggagccccccagggagaaccccgcccagaatctgcaggcaaggaggtggccctggatctacactcctagctgggccatcactggcccaacaggggccatgtctgggcctggggagaaacacggagcccaccgccccagtggtgcaggtgtgttagatgatgctggggggctgacacctccagttaatgaccttctctagtcacagccaccacaggcttgacgtccccaccatctctggtgcagtgggatgggtcacctgaccaaggttctccaggctcttaaagtgctcgagtttacatctgaggtcccccttgtgagcaatctgggacacgagcttcggggaggcagaagtgcacacgggaactcgtcatctttgggtcctattgcaggtgcctatcttgggccagtggccatcacacatggtttcttacggttttccccaaagcactcatcagagggaggcatttttcatctgcctttttacagaagaaacagaggtctcagcattttctgagtgtagcattcacataggccacaagaagaagagccaggagctgggcccaaaggtccaagcaggaaaccacaacattgactggatcctctgagcctccatttcctcatctgtaaactgaagctacaaaatcacgccttatacaggtgttgtgagcatcagtgagataatctttgcaaagcccttagcacaaagccagacagactatgcccttagtacacagtagcaaatcattaggtgggcagagggaggtgggtgctgagcacaaagcacccacccactgtacaatgtttgcaacttcttatgattctagaattaggaaattagaggccaggcacagtggctcacgcctgtaatcccagcagtttgggaagccgaggcgggcagatcacctgaggccaggagttcgagaccagcctggccaacatggcaaaacttgtaataaaactacaaaaaaattaactgggcatggtggcaagcacctgtaatcccagctactcgggaggctgaggcatgagaatcacttgaacccaggagtcagaggttgcagtgagccaagattgtgccactgcactttagcctgggcaacagagaaagactccatctcaaaaaataaaaaaattagggaattagaaaaatcaaaaaatagcagccacagaagcacttaatagatgctgttgctcttgttttgatctttagcttgggaatcagtttctcagtttaaatctaggtttttcataacatcactatagtcctcaataggcatttttagtttcctatccggcagaagaaaaagaaaaaaatatacattccaagtatttggaatttgttcatgtgtccattcactcatataaccacctaccacgagccattcactaaccagcattgcttttgttttgcgggtttcccggtccttgacttggagcacttcagctcttcgcttctgcttttgttaagaatttaatgatttgtaagcaaacatttgggaagataacatttgaaagggaccctaagaccccagttttaatgtgaggaattctttcaaaacaaagattctcacctcatttgtttgccagttcaatattctgttctgcagttcaatatgctgaatccacaatgtaaacagctgtcctgtgtgggtgtccatcgtagggtaatgggagcacccaccatgccccctagttgatactgggacccctgcatgggagcccaccaaacatacctagatgtgagcaggctgggagggacaggaggaatgagaggtgggaggaccttgggacgtgatgctctgaggggtgggagatagggccctgtctgctcctcctccaggagtccttcagccctaaggccttcctggctcagcctcaccctaggaaggaggtgagaagtacccaggctaacacttgccctagaaagctgtgggtgttttttgcatttttctgcagcagactagctgtgcttcaccctgtgtactggcctcttcccagcttctggagagttaggtggccagagccagggtaggagcagaaagctgtcaccctatcaccctctacaggccatggagaagttggtgttctagactcgaaaactttcaaaattgcagagacctgcaaagtggaagatatttcttttatggtgtggtgtgggttgtcatgtgaaggcaagaggagctctttcaaaatcggcatgcccacctgcctgcctgtgcctgctgtgtcaaaccctcggggacagtcatgccttgctaatgacagggacacatcctcagtaatgcattgttaggtgattttgtcattgtgtgtgaacaccatagaatgtatatacacaaacctgcatggtagggcctaccacacacctggactatatggtatgatgacctattgcttctaggccacagacctagcatgtgactgtactgaaggctgtaggcaattgtaacaccatgtatttgtgtatctaaacatagaaatggtacagtaaaaatacagtatgaaagataaacagtggtatacttgtacagggcacttaccatgaatggagcttgcagaactggaagttgctttgggtgggccagtgagtgagtggtgagtgagtgtgaaggcctaggacatcactgtacactgctgtagacttctttagaaacactgtacacttaggctacactatatttatttttagaaacattttctttcttcaataataaattaacatttctactttacagacttttttttttttttttttttgatacagagtctcactctgttgctaggctagagtgcagtggcgcgatctcggctcactgcaacctccaactctgggttcaagcgattctcctcagcctcccgagtagctgggaccacaggcatgtgccaccatgcccagctaaattttttttgtaattttagtagagacggggttttcaccatgttggccaggatggtctcgatctcttgacctcgtgatccgcctgcctcagcctcccaaagtgctgggattacaggcatgagccaccgcgcctagcctacaaagtttttgactcttgttgtaacaattagcttaaaatgtacattgtatatctatacacaaatattttctttatatccttattctataagttttttctatttaaaaaaatttattttttacttttttatttttgtgtgtgctaaaaactaagatgcaaacacccatgctagtctaggcctacacagggtcagcatcatcagtttcgctgtcttcacctccacatcttgtcccactggaaggtcttgagagatagtaatacacatggaggtgtcatctcctgtaataacaatgccttcttctggaattcctcctgaagggcctgcctgaggttgttttactgttaacattttttttaaataagtagaaagaatacaccctaaaataacaataaaaagtacagtatagtaaatatttacataaaccagtaacatagccgttatcattatccggtattatgtactctatggaaatgtgtgtgctagatttttataccactggcagcacagtaggtttgtttacaccagcatcaccacaaacacataatgcgttgtgttgtgtacagtagctacaatgtcaccaggcaacaggaatttcccagctcccttattgtcttctgggaccctcgtcatacgtgtggtccctcattgactgaaacattgtaatgcagcacatgactgtattttgaaaactctcctcaggtgactccgatgagcatcctgattaagaaccataatttggggatgacctttggcttctgttatgatttggttttagtaccctgtgccctgtttggtttttgtttttgttttcactaagtggggatagaatgtgattttcctacctcagaagggcgctgggggagtgaacgaggtaatgtagtgaaggcacttgcggtgattttcaagtacagtataacccttattaaagtagaggcccacatgacccagtctcagaggtacagcattcaagagacatgattcaatagccaaaactgacttaaagagaaatgtaatgatttcctctctggaatgacattgaaggggattgaaataaatagatcatgccaatacttgttaaatttccctttcttccccagcccctacaacccttctaccccctactgaaaaatcccatcatcagcccagtgggcctttattcccctcctctctcataccttcgattaccacgtgatgtccatcagctgagcctctaggtcacaggtctttcattgtagaaagggatcagctgtgaacattctggtgctcataggaggcacgtgataaatggagggctctcctttcatcgtatcctatcttcatcctctctcctcctcttcccaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtggcccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 1901 - DNA, 44491 bp, Homo sapiens
cttcaggggccaaggcaaaattggtttattaaaacagctatttgcaatggcagattttaaagacaaagacacaaataagtcaatggatataaaaaactgtaaaaggctgtaaatacatgatcatcatttataaaatcaacaacatctcatgtatctggcactttatggaaacccattttacattttatcatttggaataaatgaagggttttttttcctaaataaaatactttcctaccccataagctacgctttcaaagtgctcctttcttctggtacagtacccatctgacaggtgctcaaatctcctttagtcctctgccaatggacacacttttatctcttcattcagcttccttcctgagtctgctatggagttggaaatcaaacagccatgtttgttagaattgtttgtaaattaagattaaatagaatacaggttgactatctcttaactaaaatgcttgggaccagaagtgtttcagatttcaggatatctgcattatagacttgtcagttgaacacctcaaacccaaaaattcaaaatccaaaatgcccctatttcctttgagtttcatgtctactctcagaaattttagattttggagtatttcagatttggggttttcagatttgggatgctcaacctgtagtaataaatggctctgaggtgctaacttatgaataaattgcatagactttggaaaaaggccattgttctggttttgcacctgtattcttggttgagagggatgacataaacaaggtgtttcatggtagttcaaaaaatcagatataccaaccacccactgattgactctataatttagcatgggtttgtttttgtcctttgaagtagatagacagagaatttctggacagatttgaaatggatctgatagtctatatatcaagcaaatagacacacctgtcacaagcaggaagccctttgagaactcaggtgttttaaatctactaggttgccccagatccaatcatacggagatattgtcagaagaagactaccccatgacctcagatgccagagccagcccaccccacctggactctgccaattctcttactgtctgtgtttctgaaagcccactatatccctgaccccatccccaaacagctgaaacttagcctatgtctctatcaatttgcagatgctgggactaaatgtctaaggatatatcattcccatttcagaccttaaaacctagatgattaccccaccatgtgagaacatgtggcatgtctaaagtcacttgagtttgcagccacagaggcagtgttgtatggaggctaaccacaccagctctggagtcagaatgcttaggccatgtcaggtaacatctccgcttgtgacaaggttgtggcctcagggaaggatggctagcttttacaaatctgatgtaatctttacttcctcccttccctttctgcatgctggccatgcacggggagggctgcagaagagaaaccttcccagctgagaaggtgacggctagtgaggctgtcctgaagatcagtaagtagggtgggcatgggttggtctcagccaaaggctgctcttgggccacatgcagagtcttcagtgagggcaggtgagactcagccttctcaggagtacagtgccatcatcatccactggacatgttgggaaagcaaatgatggtcagttcagacccacgtctcatctgggcctccccatcccacactcctggggagccatggagacagaacattaatggatggtttagccagagggagcatatcatccattaggaagtataaatcaacttgaaatataatcaaccttgacttctcacggtgcctatgaatgatgacagtcaaatacaggctgattctgtattcagttctcaatgaatttttttcccatgaattcaatttggcatgcttgtgccagctctgtgcaggtgtgcaaactggcagggtagcagaaatccattaaagcatattctacacgtttacatttatggggcccttggtctgacagctttatgtgggtttgatgaacaacccctctaactcatatagaggggacctctggggaaaccactccccaggccaatccctcagaatgataaagctgagaatagtgaagttaccaatggtgtcagagaaagcctcagcgtgaaatccaacaaggtggctgccattccctgcagaccttgggtggtcctgatcctcactgagccacagatggtcagagctggaggcaatctcagagaccatctagttccactcatttcacctgtggggcagctgaggcccagagatttaatgtaatttgcctaaggccccacagctaattacaagaagtgttgtggcttcaacccagttctcagaccccagtgcagttctcttcctgtgatagctctttgcccactggaccctgctcagttttgggctgtcctatttcaggtgccacatttgtgttgtcctattctcctagacctgagccagccactgtggaaggattgcctgggatcaggagcgatgccccagtactcaagtgtggggctaagcagtccagggataggccctgaaaattctggccattggccctccagtagaatcccacttcacatcaaatcttggagggattgaggggtgacacaggctgcaggtccctacagcttggaaagcaattccataaaatggacatttgagatcaagaaaaacattccagctttgactgaatcatttctaagtggccatagcagaggaagggttgcagaataaaagagcagaggattgaactccagagtccaatgtccttgcaatgaacattacctagcgctacacctggcacctaagcagctgctcaataaatcagtgcattttgaaggatcagggaagataatcagtttcatacataaatttgtattctcctaggcatatcacttcattcattcaacacatcctgctgtgtctgcaaagtgatattaaagaggaggaaatgggcttggccatttgacttgctttggacaacagaatgacttgcaggcgtgccagattggagccttggtttcagaggcctactgtgtttaagcttgcttgcttgtgtttctcccatttccctgggaagaacaaacctaggcagagtttcctcagttcaggtacccagcaaaaccctcagccaacccacagatacatgagcaagccagctgagatccactgactcccagccatgtgactcggaagctaaataagtgcttgtcatacatatgctgctgaagttttgtaaatttgtcacatggcattattgcaatcagagttattggatacacctttcatatgtgcctggcacaaagtgggtgctcagaaaatatttgatgggtgaatgaatgaatgaatgaatgagtgcaatgaatgtagtgctcaatttccaattcagcagaataaagtgtccccagagcccttctccttcacaagagcatggtcccgcaagggccacctctacgtaagatgacatgagccacctccttggggcaagtcttacctctggcttctggaggtatatccctttgccatcttgggttaagttttggaagacatctgtgaaaatgcagcagaaaggaatacagctaatgtgtctattggaaacattatgaattagttcctcccatatgtctcaccttaaccacatccattctgaaaacgtgagggaacccagtgtcagcctacatgtgaccacacgcagccacatctatgataagtgagccacttcaagcctttgtctctggaacaagtcaggaaaagatgagtttggatatctgcagccagggttcacaggcacttggctggaggtccccacagcttccctggtctgctgtttctgggatggcggctgtcctcccttgtgcttaaactagggacaggtgggaagtcatggggcagcagaggaagacctggccctccccagcttcccgccagcttaccctccatgttctctacacgcagcatcaagtggatgaaactgacaaagtccatctggaggcgggggccgccgtagcggatgagcatcagctgacagacgtcatcactgagcatgattcctgcattgagcacaagctcctgctgtgggtattgggggcttgcacccagctcccctcctgctcaaggccccttcaaatgtccctccagtttagggacctgaatcctgatagcatggaaatcttcttttatagggttcattttgaatggtttaattgtttaaccaatttattttatttaatccctactcttcacccctgtctgttaaggcaaccagcatgaggctgttttcatcaagtatgttaccagccttcaatgaaggaggcagtctgctaagtgctcaaaagtacctgcttgggagcccggcagtcctgaatttaaaccccaggcaattgagcttcaatttcttcctctgtgaagtgaggattataacaaggtggtgttgaagattaaataagaagttgaatgtgccacccctccatcaatgttggctaggatcacagggacaatcataaaaaatgttggagttgactgcagatctacgtctttgagagtaacactgcgtattagagttacttcagcatgccacacatcccctctcctctgcctgatgagtgtgcaccctgcccgtgtgtgcccacagctccagctcttcctgtgcctacctgcctccctcatggcagcgtgcagctgctcccagttcaggtatcctgacccacggtcttgcttgtggaaaaccttctgcaaagaaccaaataagaggttcaggaagccaggcatttccaagcaccatctgagagccctgtgtgccccttgtcagcaccgcagaggggctgttgaagatatctgaggctccacatgcagggcctgttgccaggataagaatatggcagagtccatgctgggatcctaccgcctcatgtttcctacagaacaaggcttctgagaaacaaaaaagtctttttctcatggggtatagacagtcttggtgtgggtaaatgtgcttagtgcaagcacattatccacactttaaagtgattccagctttctgactcaggagacaagtgggagagttgtgagttgtgagcaatgattggaagagcaagaaggagcaaatttatgaaagactttaaatgccaagtgtgccaaggagtttggactttctctgaagcccatggggagtcttaaaaagctttttgtgaggaaacagcatgatcagatatgtgttttggaacttcaggagactactgcaaccagctctctgagtttggaagagaccaatagaggaaatgctcaccgaagggagaatagagaaggtttggtgaggtggatataaagggctgaaggggacagaagtatcttctacagctttgcagaactgccattcctacaccatcttccaaagaggtgtggttaagacttgttcttacctgagagagcttcagctgcttccacaggtccctgaattcctggatgctcatagtacctgatgcattaagctgattaataggttaaggtaaaagcttccagggagagttctatccatgctttggaggcagtgatcagccctccacaaagtgatgtgcaatttgtggatggcctcattcaatgtctgatcatgtctgatttcgctagttcgcctcacctcactggccagtccagcccagggctccctcactcttgctaggaaaaaacagaatgagcccagagcacagcagcactgggagaagcgatgatgatggaggtgatgatggtgatgaccacagctagcattaagggaggcagaatttttttaatgctatgaaatgttatctttgattattgttagtggagtaccagtagtattaacagatggtgatataattttaatatacttgaagtcttttacacctaaacataaacaaattaaatatgacatatcccattgcctcttcctttcacgcctacttttttttcttcttaacatcctttattgagttctatatatatatatatatatatatatatatatactttaagttctagggtacatgtgcacaatgtgcaggtttgttacataggtatacatgccatgttggtttgctgcacccattaactcgtcatttacattaggtatttctcctaatgttatctttccccctgccccccaccccctgacaggtcccagggtgtgatgttccccacacttgtccaggtgttctcattgttcagttcccacctataagtgagaacatgcagtgtttggttttctctccttgcgatagtttgctcagaataatggtttcaagctgcatccatgtccctataaaggacatgaactcatctttttatatggctgcatagtattccacggtgtatatatgccacattttctgaatccagtctatcattgagggacatttggattggttccaagcctttgctattgtgaatagtgccgcagtaaacatacatgtgcatgtgtctttacagaagcatgatttataatcctttgggtatatacccagtaatgggatgactgagtcaaatgctatttctagttcttgaggaaccaccacactgtcttccacaatggttgaactagtttacagtcccaccaacagtgtaaaattgttcctatttatccacatcctctccagcatctattgtttccttactttttaatgatcgccattctaactggtgtgagatggtatctcattgtggttttgattagcatttctctgatgaccagtgatgatgagcattttttcatgtgactgttggctgcataaatgtcttcttttgagaagtgtctgttcatatcaaggcaggatattttgacatggccaatttgatgtgatttaaatttaaaaaatagtaaccttttttcattattattttaaaaaccagcttatggaaggagtcaggcacacagtggctaatgatgccttttacatttttttaagtttaatggttggctttgtagaccatgcccagatacccctaccatcagagacattgggtcaaagtaccaccacaccccatctctatttgagccctcaccatgaatccatcactgagttacacacttcacctgtagcaggtgaggtcggcattaactccccatgttccaggtgatgaaatgagcgcttggagagggtctgatcttgttcaagttcatacagctggtgacagagctgggacctgctccatgcccgtgcacctaatcctgcactgtctctgagtttctgcagactgtttttgtctttacaaccccccttaggctatctattcaatatgcctctcaatagtatggatgatcaaacattgattacaattatccacttagaaaggcagtgtgtttgttagaaaaattgcagggctgagaaaggacagctgagtttgtggcatgttgtttaacttccctgagcactggtttcctgatctgtgcatgggggcagccaccgcccagttattaaatggaaaacatagggccccaaggcttttgtaaaggctcttgtaaacctggagagctgttactaaccaccaccttctagctgcctcatcctcattcccaggaaatgagattattgtgatggatggctaatattggtcacctattagatgatagctctgaccccagcattttacctgtattatctcatttgcattcccacgttaatcctaccaagtaagtttcaacactctctccatgcttcagatgagcatctggatacataatgaggctcagtggcttgtccaggatcccacaattagcaaggattggggttgggattcaaatatactctgcctagctccagagtgaagctctcaaccaacagcaagcatccacccacaaacctgaaaggatacgtccagtaaggccaggatcccctggcaggcttccaggctaaagaagggctgtctgctccccagacctgtgaaggagcgaaagagtccacatgggggctggccccaggtctgcacaccccttttctgagcaggaagaggcagtgctgcatgggccagctgatgaccaccatgtatgtacgtgggctgggaagagtgagaatggaagacagtagagagacgggggggtgacggtcgttcctacccatggagaaagtcaaatgctataggggatgcctggtacggcttgggtttgcttacacagagggccaaatgaacatgccctttgtacctagggagggccaggatcatagagtcaaactcccaaatctcaaagagatccaagaggtcaacttgttcaagctcccaaccaaactgggggattctttcctcaggtttctttctcttttctttttttctttctttttttctttctttctttctttctttctttctttctttctttctttctttttctttctttttttctctttttctttcttttctttctctctctctctctttcctttctttctttcttttttttatttttttattttattattataccttaagttttagggtacatgtgcacaatgtgcaggttagttacgtatgtatacatgtgccatgctggtgtgctgcacccattaactcgtcatttagcattaggcatatctcctaatgctatccctcccccctccccccaccccacaacagtccccagagtgtgatgttccccttcctgtgtccatgtgttctcgttgttcaattcccacctatgagtgagaacatgtggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttctaagtctttgctattgtgaatagtgccgcaataaacatacatgtgcatgtgtctttatagcagcatgatttatagtcctttgggtatatagccagtaatgggatggctgggtcaaatggtatttctagttctagatccccgaggattcgccacactgacttccacattggcctttgacaaaattcaacaacctttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattgggaagagaggaagtcaaattgtccctgtttgcagatgacatgattgtatatctagaaaaccccattctctcagcccaaaatctccttaagctgataagcaacttcagcaaagtctcagcatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggacacaaacaaatggaagaacattccatgctcatgggttggaagaatcaatatcgtgaaaatggccatactgcctaaggcaatttatagattcaatgccatccccatcaagctaccaatgactttcttcacagaattggaaaaaactactttaaagttcacatggaaccaaaaaagagcccgcatcgccaagtcaatcctaagccaaaagaacaaagctggaggcatcacactacctgacttcaaactatactacaaggctacagtaaccaaaacagcatggtactggaaccaaaacagagatatagatcaatggaacagaacagagccctcagaaataacgccgcttgtctataactatctgatctttgacaaacctgacaaaaacaaacaatggggaaaggatttcctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgactaaaacaccaaaagcaatggcaacaaaagccaaaattgaaaaatgggatctaattaaactaaagagcttctgcacagcaaaagaaactgccatcagagtgaacaggcaacctacaaaatgggagaaaattttcgcaacctactcatctgacaaagggctaatatccagaatctacaatgaactcacacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgtaaatcaaaaccacaatgagatatgatctcacaccagttagaatggcaatcattaaaaagtcaggaaacaacaggtgctggagaggatgtggagaaataggaacatttttacactgttggtgggactgtaaactagtcctttctttctttctttccttcttcccttcttccctcctttccttccttccttcttccctccctctctccctccctctctccttcttccctccctccctccctctctctctctttctttcttttctttcactttctttctttttttctttagagatggagtctcattctatcacccagactggagtggcacaatcttggctcactgcaacctccacctcccaggttcaagcaattctcctgcctcagcctcctgagtagctgggattacaggagcgcgccaccacatctggctaatttttcatatttttggtagagacagggtttcaccatgttggccaggctggtctcaaactcctgacctcaagtaatccacccatctgggcctcccaaagtgctgggattacaggagtgagccaccgcgcccggccctcctcaggtttcttgatggatgctttgtcagttacaggtgctcactttttcacatgggtgaagaacttcagtcaggagaaacttctttcattaagtccaaaggaacctcctataatagtggctcacggtcctagtttcacctccagaaaagcataaaacggtatttgtctcttctttgacttttgctttcccttctaaacatctgaatatttctcaaactactcctcacatgcgatggtttctaaaccctcaacacccttttctgagccctacattttgccagtatctctttgaaatatggtgccaagatttgaacacagtcctccagatgcaatttgattgaacagaatacagtagacctatcatttccagttttcagtcaacatttcccaaattatgtctcaaaggagattttctgcagagaaagaggagttttgtggtcaaagaaatgtgggatactttgcgtctattgatgcttttcttcatttgccatgcactttaccatatgtgaggtactaaagacccaagtacaatcaaccacagaagctaaccccttttatttcatggaacacttactaaacctcttggtttctagcatttcctggaacacaattttaaaagcacacatctaaatgctcccattaaatgcagcctgaatttgtacgagcttatttagcagcaacttgaaacaattagttcatgttagctagaggtcaactaaattaaccaaatatctttcacataaactgccacaaaaatgaagtctcttctgttaagaacttgtgctaccatcttaaaatggtctatatcaaaatggcagtggtttattatcttcctgactacatttcatctttttggtttgggcacagcttgttgaaaacattctgaatttcaattctgctatctattatattaatgatttctcccagctttgtgccatctgcagctccaataagcctatattccatgtcttcttccaagacattaataaaaattggggaaatgaacaggaccaagggcagacagaatctaagaactctcatctaaacatctaagcatatagactcttgcctgtaactggatagaattatccctctagttttatatttgtataactcttgggaatggtgataagatttgttgtaaatacatcttctattattattttccaacccacattttatcatttatcatgggagactcaccaaacattttgccaaaatctacagtatttctctgatttatccatctagaaccctctcataggactaaatgaaagcaatttgttcataaatgctttggaaaaccattttgtatatatgcaatcaagacctttaaaaacttttaaatgtgcatgagccattgcttctaggtaatttccctagaattagcctagaattctttttcagccgggaaggggagtcttacgttctacaattcctagagtcttcccttctggctgttttactgataactgaatttggctttgagaagccttttgcaaattctttcaaaccctgaatcacacaatagcctggactgtaatttgtctggattataaatcttggcttcatagaaagaagaagcaatcatctaactttggcagcaaatactctggttgttttactttttttactttgaagttcattcgtctccctgaagaaatcagcctatttcttctgtgttcttctcactccaaatatatgtataaaatattttatatggactttaagcctttctaataatttaccccaggcttcatatgaaagcctcacgctactcatttgcaattcttctaggtggtgtgctctctccttccagagttttgttgcttgatcaatttaacatgagttcatcagacagttccctgggtaggctagttaatacttaatattcatatcccaggttgaggaaatgggtgcagttcttccacatggaattgatatgccaagaaagaggtactcagttattcctttctgactagcaaaatggcaggaatcttcattttcactgccatgtatgtctatacccaaagtaagcaaaataataataacgattttcaaagttgtataaatttccctactgctttttcagatcacataatccaccttgtgtaaaatatagccagagttgagaccagtgctcagtaattcacacatcccaccaagggaaagagaaacaaagccagagtttagaaaagttgcatcccctctgagtcctacagaatggctctaaaacacttacttgaccaggtcatctggttcaggaggttctgaagttgaactgcattaatctctggatgctaaatagaaagcagattggcaagaaaaaataactgttactgaaggctcattagatggcagaggggtcatatgactggccatgaaattaaactgggatttcctaagaacttcacaatgctttttaactgggtgccaaccccagagaaccctggcagggcatgactttcaagaacagtgattctcgaaggtgctatccaggtgctgctgaagtttagccaacaatttggtttgaatttcattctcaataaaatgtcatcagtcaaaactccagattttaatcttagagtttattaaaagaaactctttatatgaacatttgattttaaaatatatcagtgaaatataagtatcaaacatctgaatttttaaaactgaggcatattcataacatgcaatttttagttgttttatatagattgggattctctatgagacttcatttgataaaaggattgcagcatcaaatgtttggaaaccacaggtatggaggaaaactttaacaaacaatacatataagattctgatttatcctctccagctacattaaacaaaattccagatgggcaaggcaggtaaattgtgactttaaatcaggagtgtcactaacatagggggctcatattctctgttttagtgacattgctcaaatatcagaccccagatttccagtatgtttctcgccctgttcctaagtgtcttgcaggttaggagagcatggcctccagagccccgcactcacaccattagcccttgccagactcacatctgggtcagcccaaaggaagaagccacagaaaccaagcgtgtgtcccaggccctcccccttcttatcagtcccaccttctctccaggtgaccactcatgggccccttctccctgcgctcccctccaatgaccctccccaaggcccccagagcttgtcattgtcatgctctgcaccccccaccccctgtcccactcccaactctgacattctactctgctatatcccattttctcagggatgaaagattaaagttgctttccctacaactaatcaatgagcgtccaagaacagagaatcattttacaggagccttctagacaatggctccactcatttgtctaaaaacttgaggactttaatagaaagtggcagtttgggcaataggtagccttaaatcacagtttctaagcagcctcaagcaggtgcaaacctatactttataaaatgagaagctccacttcgtcccctgctcttcctcaccccccaccacacctgttcaactaaccttttcaaagaatttggtgaagaattcatcctgcctttcattttggtcttctatctcctataggaagagacacacagaaagacacaattattcacctgtataaacggactttcgtgcacaccctaatgtctcatggcttccaggtttctgaaatccatgagcttgactttgcatcgtctttaattttacaccatagcatttacaaacagcccttgcttctccaatttttcctgactctggggaaatcacaaacagtgaaatggacaaaagaaacaccagataaagagaagcagaagaatgtagagatgtagctcatactgccggggttctggaccctcagtgacaaggacctgatcagaagggtagttctctactctttgttggtgcaaaaacagcaaagcccaggtactgttaggatacaacgggtaatgtttgccatagaacagggtctgtaaggatccgcatatctcctcccctgactccttaacttgaagggagaaacccaacaccctggcttggaaagcagtcccagccatatggaattccaccagactactcacctttgagaagacgacaccagaattgctgccaatttcactgagaacaaacaaacaagaacaaactcagagtttcctcttgggaattttttggccaatcttccccttctcctgggagctcgtcttccacgttccttcactgaggcaccacaagggcccacccagctctcacacctcacctcctgcttccccttgaactgtacattccagccatgtgcacagcacactgcttgtaattccctgcaccctcatctaactagtcttaaaagatgagcatgagacttagtggtctgacgtggcagtggggcctgcctgagatcaaatcaaactacctgtggccgagacataaaaaacaaacaaacaaaacaaaacaaaaagcacaaaacctggcaggtaaaacaatcataggcaaaataatatgtttggttgggatatgtgcacattaattcaactggatacagtagtagaatggaagcctgctagttcatgacagcctcccttcatttgaacaacccctatgcatcttataatagtcacctcctccctgaagccactcctgcttcccccaggaccatgggagttggctcaaattctcctccttgaggctcttgtaacaccctgtgcatataaaatgcttacactggatgcactggaagatcaataactgctcatatatctgtgttctttccagaccttgaacttcaggagggcagaagctatgtgtgttttatctttttctctctaatgtctagcatggtgttagtttgtgagtggaaggagggtgggaaggaacgggagggatgttctccatgcagaaagtcacctggtctcctgctctccccatctcccttttgtctcagcagcagagatcctggtttctgccatttccaaccttgccctccttgcctgtcctcgtccaagtggtccccaccctctaggagagaccttgtgtccttactaaaagatgtgcttcctggagaagaccctgaggacgaactctgacttctggtgggcctccaatatgcagggcacgatgaggtacgtccctggttccagacacagctcctgactcacttctttctccttgagaaacctatcaggctggctcagaggagtgtttctctggaagaactcagggggcagtctcctctggtcatcatggtactgtgggtagaggacagaagaacagcaagggaggtgatgacccagggctgtggccaggcctgaggccctcaaagctctgagccaggactaaggtggcctctgctctgccaaatccaataggccccagtggaggatgaaacaagtggggaggaaaggaaaaaccagaatatgtgtgtggagggctgcacctttgctggaacctatcaggggctacataaacacgtgtcatttgatttgacttaccttaaaaacaacaccagcactaaatgatgtgaggaatgtccctgtgccttccattttatggctgagggctctgaggcttagacgggttaggtcatctgcccagagtcatcagctgggtacagtcccagcccgatgggaattaaggacagctgagttccaatgctcctgttctttacccttcctgatgctgcctccatgtatgtgatatggcatgacttatggacacagatacagatggaccacgaccacctccccacctacaccacacagctacacacagataagctggacattccgcatcatctcagggaaaacacccttgtaaaggacaaagagaactgggcaagagctcagaagaccaaaatcagggctctggttccgacatttcttgggtatctgctttatctgattcatattctctctctctctctctctctctctctctctgcctcctttgtttctccatctctccctatttttctctcttgcttactctcccctttgttctcactcagggctatagagggagaggagacccataccaggatcctctctccagtttatacacaactgctaacaaagacatcacccatccaaataaacagatatttagcaaattcctcaatgtttgggaaataaaatacatatcctgatgaggtaggcattttttttataagacaatgagaactagggaatcatccaattgccctctttgccatgggctactaggaatctcagagctaaattgcataatgagccacggtagctgtcctgggtttagttttcctggtagaagcaactgcctacctagctctcatccctttgttatttttcaatggctttgaaattttgtagctgatttgcaggtttcctctgtttacagttttttattgtaggttgacccaaattctatttagaagtaggcatgacataaataactttttctttttaaattaataggcaaatttgagagtgttcagtattcctgtgagagaaacaacaaacaaagaccctgcgtaaaatggtttctctacaataatccttttacttgattcaatccaacctgagaaaattaagcattttactcctgttttctttgggaaataaaataatagctgcctccctcagaagctgggattccttgggccttcctacctgacccctcctggcggccacagcagctgaagcacggaggtgttcttgtccctctgctcatgctcctgccacatgtccccaagcctttgtcctttctccctagggaggtgggctgcatggtctttgatgtcccatatgttttaaatctattttattttgggtttcataacccagtcatgattgtaatttatcatctttcctatgctgtgatggccgtcaatattagccctgggtatttgtgtaggaatttaataaattctaaaatgtattggttctctgctaggctctaagactttcccatagatgcatgaggatctcttgggggtctttggataaaaaagattaacagatgcactttactttcatatacacacaggcagcgggcagacattctcatcatctggcattatcatagcttcttacgcagtagaagcctgctccagtctaactaaatcctgtggaggcttggccacatgtgatgtcaccccaaactagggccacccggtcaagtgcagaactcaccttgttcatctaaaaaacaaaaacaaaaacagaaaaaaaaaaaaaaagaggagagagagatctcattaagcagggaatctggctctttcataaaccgaaacccgaatagaagctgatatacaaggctctacccagaagccgtgtcccctcccacaagacctgctgttctatcagtgacattttaatctatcattggaaattctggaaaagagggagggaaagaatgcttggcttttggggagaggaaaaggaagccaatattgatcatactatgtgccaggcacaataacaagcactaccacataatcctcttttattctaccctttgcctaaatatcattgtagaaactgatggcctagtgcaagaaggtgacttgttctaaatcacatgttcctaaaggacagagcctggatttgaaaacccaggtctgtgaacagagacagatggtgaagaagacaggaaacaggaagacatggtaactgttggtgacccccacgcttggtcccatgcccctgtggttcagaggtccacctaccctatacaggtagaagccaatggcgaggagaggcttccgcttgcggcacctgtgcctgggcttctggagcagggacaccagcacgctgcagggcctcagggatctcctgccctcctcgggcctccagacagacagcaggaactgcgggttcttccaaaatgtgtctggagcagaacacagcaaggtgagaatgggccccggatccccatgcatcctgcttgccgaaccactaagaggtgaacagtctgaggacgcctctgccaggattgacaccctgaggcccactgggacagagtcggggtcccttcaaccttggatttacgccctcccaccttgctcttccacctggaggtcttctccagacacactgactggagttgttcccaccactgtagcctttgtcttgctcagtgcctggcccaggtgttataccccacaagcatgtgctacctgagtaagcaattgtattaactccctggggaggtgaccatgatcctaggggcctttgcattttaatagacgcaaaaccttaccttaaggtcagcttcagactatgggggaaatactgtgtcaaaagggggactccagagctaaggccatcctggcctgctgaggtcacaccccacaggccttgccttcaaaagggatggctcactatctccacagtggaggaagggacagggtcaccaaacctgtcccatcttgggagtccagacaggtttgtctcccgtatctagtgatcctgggaagccctgggtttgtgtttctcccaggctccaggtgagaaagaccagatacaatttctatttcaatcctgcctagttagggggtggttacttcagtgttttcagtggtcttgtcctaaaactaaaaaagattctcccttgcccctgcttttatcatgcctgtgtgcctgtgacccccggtgctgactgcgacagggcaaccctctgggaagatgcagccccacaggctggcagcttgactgagaggactctgccttggtgcacattgggtccaaaggtaccccatcttccctgtggttatagcccagggccccaacacacagtgaggcaagcagagcctcctccccactcagccaatgcagaattcgtgctgcaaccccctgtgcagtcattctgacacccccgcccacaacctcaccctgagagccctgctcctgtgcacatgctcaccctgcagcaactgcctctggccaccagctgtgctccgcttctcccatctcccctcccgcatggtgtacgtccacttctgggccgcctcctggctcaacaggcctggggtcagtttacagataaccaggagcacgaaatgtgttttaaagtcctgcagcgtcatcctgtggagagaagaaggaaaagcacaaagagatggaccagataacgcctagttatcaggacccatggggagggtgaaacggagcagtgggcatcccagccctctcatggacaaagacaccagctcttgtgcagagctgagctgacgataggcacatcagctggggctggctagatccctgtgagggtccatcgtggggggctggagctactgagaagccccaccctctggctggaagcagccggccacatggctgaccgggggagatgttccagtttctggaatcatggtgatagcagctgaattaaggcatagctaactagtcatttgttttatctataaatgttcaataagaattacatatcagttcttaatcattaattcatgaagatctttgcccctacttgctaacttgtggcctgcgacactctatttaagctgtctgatgctcagtttacttaaccataaagtggaaaaaacaggaatttgcagagcttgagttcagtgaaagaccttccaaagggagagggcggtggcaggctgtactggatggttaatgggagcagtccttggaacgagggttgacattcacagtaacggtggtgagcaaaagcaaaggagaactgatgggtccatttcagacacctagaagcagcatcagctcaggatgtcttggtggcctttcaaaaaatgaggtgagcagccccagagtgggtggcagtgttactctgctctggagggcactggtcaggggcctatcctatgacaagactttgcagtctcttcctacctcatggccttttcaggacaaaaaaggcaaaacctgttttgaatacactgagcaagagagcagagaggaagccagagaggaggaaacagcctggctgagccctcgctgagctccaccctagtggcctctactctcatcacaaagacagtgaccgtttatttacaggcactgtttgtcctgctagaccgtgagctcctaaagggatggtgccttattgatctctgtacatgaagttcctggcacccataaggcatccaataaatgtctgctggatgggttttcaaatgtaggccaggacatttgtccaagtccctaagtccaataccagaattctccgtcattgtctttcctcagaagcagaatcttctccttggggctcagcagctcccatttacttgaactgaaaatagaaaagggaatgaaaagcttgtggggagcatgctagaaattctttagtaaaggctctatagtgtcattatttattattattttcatactacctcagacaactaaatttcccattccatattatacagtagcatgaacatgaattgatagcttactatgagccaagcactgggctagattcttgacatacattatttcattcaaggctaaccacaactttgttgttttcatgttagagattaggaaactgaagttaagagagattaggtcatttgcttgaagtcaaatatctattaaacgtcagagctaacatttgaacttgcatttttcaaagctcatcatttgaacttctacttctggccatgaaggagtaagactgtcctgatagcctcctaccatcaagaaataaaaatgggacaaaatatgagaaactgttttcagatattggacagcaggcaacaggggtctgtgatcccaggaggctggaaacaaacgaggtgagccctaacatcacctaggctttcttcctgaaggtaatttcctggccagcgctacagggagagggactcaaaaaaagaacataacagtctggctgagtggaggagacagaatctggagtttggggagatccagacagccagaatttgctgggcaaagtatccgaaaggagggggctacatgaaaaaaaggagttccaggaaacttcacaggggttcccttgcgtctttggctgagctttaatctgtgctttctgaaagcgaaactccctaagactggaccgtaagcaggacacagtgctgggaatctcaggcattcctaccggacagagttaaaagactttatttatttattcacttatttttgagacagactctcactctgccacgtacgctggagtgcagtggtgcgatctcagctcactgcaacctccgcctcccgggttcaagcaattctcctgcctcagcctcccaaacagctgggattacaggcacatgccaccacacctggctaatttttgcagtattagtagagacgtggttttaccatgttggccgggctggtcttgaactcctgaccttaaaagatctgccttcctcgacctcccaaagtgctgggattacaggtgtgagtcactatgcccagccaaaagactttattgaatacatggaatctttactagagatcccagagggtctacaatttagtagtggaatcaaattatccctgaaataaaggtttgtcttgaccttccctaaaagtgcttaaaaacttcaaagtatcaaaacaatccctaagtaatgtaactacctactttaaaaaaagtccaatattctttaaagaaatacaataaaattcagtactctgaaactaaaatttacaatgtccagcatgcaataaaaagttattagccatatgaagaagcaggaaatatgatccgtgacctggaataaagaaacagtccatagaaaccaccgtagaaatgagagagatgatagaattagcagataaggacattaaaacagctattataaaagtgccgcatattctcaaggatgtaaagagaaacacggacataaaaaggggagaaatggaagataatctcaagtgaaatttctagaattgaaaacataatatttaaaatgaaaaatatactggatgggattaacagcagattaaacactacaaaataaaagctcatcattttaatattcactatacctctggatccaagaacttaagaaggttgcctaaactaagatcacacagctagaaagtaacaacactgtaattgtacccatcatctatctctaatgttagtgcttgttcctctatgaaagaaaccgccaccagcaacaatatgatgctagacttctgtagcatgttaaaatttatgtatttctttggatgacatcttcccacatagattcagttcctctaacaacactgtttactaatgtgtaacaaatataatgcagcacattctatcaggaggaatattcaacttgtgtttctaagccttcattttatcaatataaaaatgattaagtgataatgtgtatatggacacgtttgtagactctgaagacctgtaaaggattaagtattatacatcttcataatgacagaatgaaggactttaggacttgacctccctttctgcctgtgccctacagccagtgtctagcctgcaaaacccgcatttctttagggctgccattaggcagaaacaacctaaatgtaggcacctaatcagaatgcccagaggctactatatgtaatcagagtgtagagtccaatccaaatctgtctacctttgactcagcaaacccaggtgtgctgaaccatgccagggaaagacactgaacccaggcaccaaagaccttggttgagtcatgctgtatgaccttaggcaattcaattaatccaagtttctctattagtaaaatggggataaaactatctactttgtaatagcgttgtttgggggattaaatgagataataaaaattcaaaaggtttagcacaatgctggcaagccctcaaacaaacatcagctttaattattataatgaaagagaaagcagtctctataccataaagcatcttctaaatgtgagggattgagcttccccgtctaaaggcttcctgatccagcctaagaccaaagaaagcacacatttgaatctgtgtgcaaatggcagcctcctttgcctaacctacctgttctcacccctccaagatgtccccaaagttcacctgtcactccagtctcctttccattccacctttccccaggggttccgtagcttgacgagatattcaggtctatgtttgcaggtcacctgcataaaatgagaggcagtttaggtgactgggctgagtgcaaacattccagagatctgagtgagactcgggcctggagctgagcacttgcagtggaaaatcacagccccagagagagctggtagaggagaaagtggctctgcttcttgtacttacaagctgtgagacctagggcaaatcagctaacctctctgtgtctccatttcccgatctgtgaaataaggtcaatagtcatacctatgatagtgggttgaatggtgatcttccctccccaaagaggatatgtacacttagaacctgtgaacatgaccctatttggaaaaaggatctttgcaaatgtaattaaagtaaggacctgggtttgagataattatggatcagggtgggccctaaatccaaagacaagtgtcagaagagaaagggagaggacacagagaaggccacgtgaagatggaggcagagaatggagttatgtagaccaagccaaggaacacctggagccactggaaggtggaggaggcaagaagggattggattcttccccagagccttcagagggagcatgtccctgctcacaccttgatttcagacttcaggccttcggaactgagaaaattaatttctgttgttttcaagctcccctgcccccaacattttatggtaattttttgtggcaaccctaggaaaccagtagaccttgtgaaaggaaaataaatcttgggaccccaaaatcactaatctaaagggaaaagtcaagttgggaactgcttagggcaaacctgcctctcattctattcaaagccacccctctgctcactgagatagatgcatatctggttgcctcctttggaaagactaacagaaacttgaaagaatgcaaccatttgtctcttatctacctgtgacctggaagccccctccctgctccgagttgtcctgcctttccagacggaatcaaatgttcatcttacatatgttgattgatgtctcatgtctccctaaaaagtataaaaccaagctgttctgaccaccttgggcacatgtagtcaggacctcctgagactgtgttacaggcgcacatcctcaacattggcaaaataaactttctaaattaactgagacctgtctcagatatttggggttcacaacctactcagagtagtgctgtgaggatgaaatgagtccacgtttgtaaggcagttaaacagcatttagcacacagtaagtgctatataaattttgttaataaatatggaaataaattaaaagctctgggcacacagaccaacatagttgttggagatctagaaggaagaagttaagtgtgaattgagtccaagaaatttgaaacagagttaaaggaaactggagtacttgggaagagttgggccctctagagaatatcagaggttctttaacttaaacctgctgacttcttatctccatgctttgcttacactgctccctccaccagaatgcccttctcgccccgtgcaaatctatccattacaaggaccaacccaacatcacctcctctgtaagagactcttctgacttctccccagcccaactcgatggaggtcttttctcttatccatgaattcctaaagtctttcatctacactctcttctctcagtttcaactttgcttcctcctcattttcagatatggtttgtgaccatacctgactgtaagccctttgtaggcaggtcctgcctggtgtgtcttcctctcaatgcctagtagagctcaaaagatggatagcaatggagactgtcataaagaagtgtgtcagagaggagtagaaatttgggagggaagaaccagatgaaatggttgttcttggcagcccagagtgaagcaaagttcaaggaagggttgtgaggtacagcagggtgggaggatggttggctgagggctgccccaggggatgaggttgggatgatgcattggtggtggcaaagcctggacccaccacttcaccgcaggaaatagatgccgaggcacagggacccaccaaagactttacccactctccagatggtacagaaactaaatccaccaagataagctagggtccagagagggaagggcaaggctgagagggaaaccgaagggccaacctcaacccaccttcctgattcctgtgagagtataggcatggccttccaccagcccattctccagaatcttctcctgcagagacaagagaggtcctgatcagtcttctgttatgtacagcttattctttgagtcgtgggaaggctgtttggctggagcaggggtttatggagagaagtgtgggagataatcatggtatggtacattgcagttttcaaagctctttggtatccatagtctcattccaccctctcattaagtgagccattctgcagtgatcatgccataccctcaattttacagaggacaaactctatttagagttgagtcaatgtgtgaggtgacacatttggccattagtgaaggcagggctgaactgagggcttcctattcctgttccattgtttcaagtgttatcaaataggaagtggaaagtgccttgcatgtagctggcacttaataattgttagcttccttctctgcacatcatcttctttttcctactgccttgcctgtcctgaggccccaacactgctgctctggtttttttgtttttgctttttaaaacggaatctctctcttgttgcccaggctggagtgcaagggtgagatctcgggttactgcaacctccgcctcccgggttttagtgattctcctgcctcagcctcccaaatagctgggattacaggtgaccatcaccatgcccggctaatttttgcatttttcagcagagacggggtttcaccatattggccaggctgatctcgaactcctgaccccaggtgatccgcccacctgggcctcccaaagtgctgggattacaggtgtgagccaccgcacctggccttgctgctctggtttgaacaccaggacctcagcactaggagctgggtggaggccctgagcccacacccaggtgagggtagtggtggtggatggagggcatgggtgcaggagaagaggacattctgccagtggcagcccagtctcacccctgagtgggtctggcagccaatgagggttctgttgtaggtggcttcgatgaggatgtcccagaggttgccatgggcttctgccaggttgatggtcattgtcacccctccagtgaagtctacaagggcttcagacacctgtcctgactgcaagtcttcataggaaccagagagcctggccagggaagaaataaacatgagaggaaaaaagtatcatgagtatttataattttatgtggcctcggcatccacttttaaataggagtctagttttctcataccaaaagcagagctcaggcaaccctgacatagtttccaataccatacccatcctgaatggctccagctggtggtcatagataaaacttagaggcatctctcctgcctagaagactgggaacccctctttcccaccacttcctttaaatggaccattcagacgtttgcctgagaacttagtgactgcctgtcactcacagcgagatctcaactagtgcctgcttgctttgaacccatcagttaaagctgcttgcgggaaacctgttgggacaacaccctggactcaagaaaaggcatgtgtccaccacaggtccattttctctctttccgcctgggccccctgacctccacatgcatgtgtgcatgtgtgtgtgtgcatgtgcgtgtgtgtgcatgtgtgtatgtgtggacgtgtgtgtgtgcatgtgcgtatgtgtgtgcgtgcatgtatgtgcatgtgtgtgtgcatgtgtgtgtgtgcatgtgtgtgtctgtgtttgcgtgtgtgtgtgcatgtgtatgtgcatgcgtgtgtgtgtgcactccatacatgccaagtaccctctagggtctgtaggtatgaaaaactcttaaactttcatattgcagttgtgtcgttgaagctgtgcccacaatctgacccctgatgatcaggccgccccacagggacccaagcaggtggatcccctgctgctactccttcatccagacctcttagctgctggggacagcagtgatcagctacgttgagagggtttcattcaaaacaaaaggaagaggcatttaaactgtagattagatgggccaaatgagaagtgaagcctttgcttaggttttctttgggtgtatcttgctactccttccttccatcccaggagcaaaggacagaatatacactcagagctcctatcccccttaattctatccattagggaaaggcaaaactcttgaatgcaggtttagatgaggtgacccctacataaaagactgaatacgttgtcacttctatgttggctaagacatgcctcaggatctcatttcataaactttacctgactccactcccctccctcaacattgagagagagaaaaagaagcgatgggaagggggatatttctgccggtttcttacttggcataggccttttccagaagtgctccccagaacaagttcttataggtggaggagacaaagaccagctggccagcctcattcacaggcagacggtcatcgatcaccacaggaacccagttcccatagtgccagaactggagggagagagtggccccgggtgaatgaggactgctgcagatggtgatcagcccagaaggtgaagacatggtcctccaggaaccctttttcctatgactccctctgggctgaggacccgggaagacactcacccagaaccggaagatgccagcatacttctcagtgaaactctgattcaggggaacaacccggctcaggatgtcctggtgcaaggccagagcttgcaaagcagccaagaaccagcagtctcctaagtcagacagcacacagcatctgcatgaatctactggggactttatgactgcagaaaatgcccggtcccaatggccaccctctctgggcttgtagcccagtttaggagaagggaattatatactgggaaggcggatgatgagtgagcagaggtggggctgggagcattggctgaaatccaacttgaccccaaaaccagagccatgttcctgggccagattttagatctggaccaggaattttagattcctgaatgccctatcctcaggaattgggacctcaacgccactcactttttccaaatcttgcctctgaaactgatttatgttcttctgggaaagcctcaatccttcaggactccatttccctgtctgtgaaatgggtatcactggacttggctgagccttccctgatgaccaatttactattttaaaaaggtagagttgaggatagatctgctttgatcctattctggcgaggctaatgactgctgtctcaagaaggacccattgtgggaactaaaatagagtgagcacattttccaaatttaaatttagacctgtaaactggtaatgaggactatgtgaggacttaggcagggtatggcattcccacgcatccccagaggaccagtttttataaacttcacggcaaagaacagaacatgtccaggtagcgttttgccagtgaatagccattttgggcctctctccagtggggatctctggcttctcttctttatcaaccactctgtcttggccaggcctggtcagcaggcagcctagtgtctgtctctcggggctgtgcaaacttacctactatcccctggcacagatccagccttttggccttggcaaaataaaactggggattgctgtgcagctcctgggaaagacaaacagaattgtcattctgacctagaacaaaaaagctcctggagctacagtgaccacgttttcccataccccaaaactgtacttatggggacaaagatacagaatataggtgtaatcagtgctatcccagaagatctgggatacagaattctgtcctttgtatttctcattccttcttatagctcgtgtaagtcagagccctggagaactctgtgtagatattgagaaatagcacttataccaaaaatgccttttcttagagtttctattaaaaatggaaacacttttataggaggtattttcagttttcctagatatcttctctttcgcttttttctcccctattcctccttcttattcctgacccctaatatgatgttctttttggcttttcctgatgcgatgcagcctgtgatggggtggtaggggggttgtctctgctccgtggcaagatttatattctcagtctttgcgcggacacagtttccccaagtcagatgtagaacagagtctctatgtcagcagttcccaggattttctgagagaagtaggatcttggctgccatgtagtttaggaggctcactgcagaattttacacacagtagggacttcataagtctggggctgcaggtatcgatggtgatgggtgagtagggaagagaaaaggaaagtctgtggcacaggcttacactttaccctgttcactagctgtgttcctgaaatcttgtaggtaaatcaagtttcagggagatggattacatttgaacacattaagaagttgctttttaaaggaattgatgcattttatagagtgaagaatacttttgtaaagtgattaatagcttcttaatttaaatgtttcatgaacctgttttgggggtaggaggttggagagatgttaaaatttatctctctggcagatggtattggctgtgactcaggaagccttgccatctcagatgaagctaaacagtaccttgatatatttttggctatagctgttctgcatatttctgggcaggactgagggagggctacatcttagaccattctcaaaatcacccttggttttttccatctggaaagtgagaatgtgggaacatacccatcccttctcatggagatcaatgacagtaagacctggtgtgatattgtgaaatatatatttggtcttcatttgctcagttttctgacattcagctcctaaaaccttgggaacctctagagtgataagagtgtccttcgtatgctaatgattgactggtgactggtggtccctaggtagcttcaggatagggtctggtcattggaaagaccaaggcaggattagaaggttgggagtttcagccccaccccctgatcactggggaggggagggaaactgaaggttaaattgatcaccaaaggccaatgatgtaatcaatcatgcctaggtaataaagcctctataaaaacccaaaaggacagggtgtaaggagctctgaatatctgaacacacggaggtccctggagggtgccacaaccagggagggcatgagagctccacaccccttccccatgccttgccctgtgcatctcttccacctggctgtcatctgcatcctttgtcataccctttaaaataaatcattaaatgtaagcgaagcatttccctgagtcctgtgagcctctctagcaaattaatcaaacccaaggaggggatcatgggaatcacggtcctgatttatggctggtcgtgagtacaggtcacaacctgggacttgtgattgccatctgaagtaggggcagttttgtgggatgaacactcaacctgtgagatctgacaccgtctctaggtagacagtgtcggaattaaatttcattacagaatacccagatggtggccaccagagaattgcttggcatgtggggaaaacctcctacacatctggtgttagaagagtgtgttgtgttgagtggagaggagagagtaggaaaaagcctgtttttttctcccatatatcttaggcgcagtatctgaaagccctaaaccctggggaaggagggtctgggctgacacattttgcctcaccgggggcctcttccactgcaggcggggtggcagcttctgcagcagggagccactgccgatggagctcagggtggccgggaagctggtgtcttcaaagaggcagccattcctcaggcactctgccagcagggcctcaaagtcctgttggggttgctgtggagacgccctcctagagtaccttggcgccagcttccatctgcatcggaaaggtggccacagagacatggcaggtggtgggtacagtccagtgagtcttcctgaggagtctctgctgctcctgaaatggagagaggacggtcagtttcctcacttcctccttgtgctttgccattgccacagagacgaggggaaggatggagagaatgggagcggagaagtcagctggtgagaaagagacagaagcaggtggttcgattttgtcccagagagtgtgggtccttgagcactcactcaagtgcttgaggacctggtgggagatcagggatcttgtggcaaaagcctacagaagggaaagttctctcaagcctcagggctgagtcctgggcccctgactgcaccaatgtcacgggggtcccttctgcttagtggggaggcaggagaagagaagcaggaagctggagctcagtcccctgggccggagggtcctgtgcctgccaaggtagtggggagtagtggctgcctgctcaggcctccaccaggcctgccaactcctgcctcccagctacagacacacagcattcctcctgcttcaatgtcctccttattcttccctgcaaaacctcctcctacattatctttattttttttatttatttattttttttttttgagacagagtctcattctgttgcccaggctggagtgcagtggcgcgatctcggctcaatgcaacccctggcttccaggttcaagcaattctcctgcctcagtctcccgagtagctgggattagcaaggccgcagggggtgctgggggccagcagctcccacgtggaggcctcccaaggatgtctctcccatcccaggagcccccagctgcgctccgggtcaagggtaaaaccccaggctccagcacagggtgcgtgggtctctcacagaaggcccccacgggcggtcacaggctctggcagggctgcaggttggcgtgggcgagccggcagtgcatcagatacagacgcccgccaccacacccagctaatttttgtatttttagcagagatggggtttcgccatgttggccaggctggtctcgaactcctgacctcaagtgatctacccgccttggcctcccaaagtgttgagagattacaggcgtgagccaccatgcccagcctacattctctttacaaagaaatccttccttgaagactttcttgctaatgtaaaagggggacaaaaaaatcacacacacacatattgtgccaaataccaacagttgccagtacgtgcccattctccccttttccttgttaccagaatccattttgataacccagctacaaaacttgatttcctggagcttcttgcaggacaggttggctacacaatatagtttttcattttacagttgcaaaaccactaatcttattagcctccccatttttcaggtgttacaactgaaacctgtccattcattcaccaaaaattttactgggaacttatcatttgtcaggcttgaggtaggcactgctcaccaaagacagtccctgccctcatggctcttacagtttagagggtgggagagcgagaagggttaaatgatcttcctggtgctatacagggagattttataagggctgtatccagaacccagagccctgactcccataacaatgttcagctctcagtgctacaaactgcctattacaccccgcacagtgtttgggacagaatgtacatgccctaaaagtaactcgcaaatgtgcttatactgagtgtgacttctccctcatggctgtaggagtgacctggggtcctctccatttgtcaaggtcctgcccatcccccaaagtctaacttgagtcctttccccaggaagccctccttgagtgcctggcattcgctgagatcccctcattctgtctatggacccattgtctgccccattgggcacctactgtcttggtgcttctcaaattatcactagtgaagggcctatgttcttttatttccgatttgtcatagaaatttaatgaaaatgaataaatacaaacataacattttaaaagatacataaagtcaagtccccctttaagattttttcaggtcaggtgcaagggctcacatctgtaatcccagcactttgggaagccaaggtgggcaaatcacttgagcccagaagttcgataccagctggggcaacatggcaaaacttcgtctacataaaaatacaaaaattagctaggcatggtgatgtatgactgtaatcttagctacttgggaggctgagacaggaggatcacttgagccgggaggtagagtttgcagtgaacagagatggcggcactgcactccagcctgggaagcagagcaagactctgtctcaaaaaagaagttagattcaacaaaaattaaattaaatttaaattatttgatcaattgctataaaagtttctaaacacttgctctcagttttgtaggtagctcatcaagcactgccagtgaccagttggtggagtggccccactgtggttctgctctgagtgatgtatgcacagaagcctcttctgcctaatggcttttgaatcctctgcaggattagcactgctggaatgttgtttgtctcacacccttacctctgagagctgagggcagtcgattcctggctattcttatttgtcacgggtgcctgtgtacttcctgggggaagacccagccctcttctaacccaggtcacagaaactcaaaagctgttactcaggtcttttatttttttgactccaaaaaaaaactccaaaaaaaaactggagtttttttccctaatgtggatgagtaggcaaagcttcccccaggcttaccccattttcttcccaggaagtttcttctaccacctgcacatttataaacaaacttgaggcctcacaaaggcaaggtctccctttttgccccttcaagcctttacaacaatctttattgcttgtcctgtgaaaaatgatagagggtcccttggcttcagaacctccctcaggctcatgccctccttaccaagtgctgggtcatacctggattcctcttcaagcctgcaaatactacatcttgtgacaagcacagtacatcatgggctcagaagacaaaacacccatcacaggttcctctcaccctccaaagtttagaatgaggccacatgtgtgcgtgcacacacatacacacacaatcttatttgtaaataagtattcctaagtcaccttagggagaatataggcccagatgaaaccagttggcggttcttgcatgtttcctatatattacaaaccatggatgaaattggctcatttccagattggcacagctctctacaaagggccagatgggtctaggtcacatttggaaattcattttgactattgtaagtgagcagcgttggagcaggtccacaaaataagactatgcaaatagataggtgaaggctaatggggctcgagctatttaagaatgtgcagcctaaaagcatcctccatgggcctcagagttctttccttggctccccataagctgccaggttgttctgcagtgttttgcatgtcagcattactattattttttattagagacagggtctcactctgtcacccaagctggagtgcaaggacacgatcacagcttactacagccttgaactcctgggcttaagggatccttctgcctcaacctctcatgtagttaggactacaggctcatgccaccatgcgcagctaacttttttttttttttttttctggagagatgaggtcttgctgtgttgcccaggctagtctctaactcctggcgtcaggcagtccttccacctcagccacccaaagtgctggcattacaggcatgaaccaccgtgcctgtccaaaatttatttatactcaggaagtaaacagagagtcaggctttgatcttcacttcttccatactggctattctccccttatctatagatgctgggtgctaggaagggcgttatgatggtgagaggtgtcaaataacctggtgctcagataacctaagtgccttgatccagaggaggaggcctttgaacgctaactagcttgtgaacatcaggagcatcaccagacaagacacctggggatacaccagccagcagcgcaaactccaaaccccaatccctgtatacaggcagggtttccttgtctctcctgataaccctctgcctatttaatatgttagtgtttactaaaaggtaaatgggaacattttaaatgtgggagaaggaacagactctagatacaccttgtgtcaaaatttactccttcaggtgggtctcagtgatatttcagtagccagtgtgagcaggatgacaggagccagctgtgcacatctcttctcaagtctgtattccatcatgccatgttagtaccttgtaattggccatcatgggagtgtccataccatggaatgggtaaatgctacaaatcagagctacttggccttttaaaagaaaaaaaaaattgagagctagttgttgaatattaccagcacagcactggtcaaccttaagacagcagattgcctggtcctatgaggttgtccagctggaagtttccgtgttgtccaggaatacagagtccatagccacaggtgagaatctgtgaaggctttacaaagggtggtcttacaactcatttggaaagagaggttgatgtcagtgaaaacattgactctcacaaactggacagaaatgaatactgtatctctgccattgaaagttcagtcagggccaggagcggtggctcacgcctgtaatcccagcactttgggaggctgaggagggcggatcacgaggtcaagagatcaagaccatcctggctaacatggtgaaaccccgtctgtactaaaaatgcaaaaaaaaaaattagccgggcgtggtggcaggtgcctgtagtcccagctactcgggaggctgaggcaggagaatggtgtgaacccgggaggcggagcttgcagtgagccgagattgcgccactgcactccagcctgggcgacagagcgtgtctccatctcaaaaaaataaaacataaaataaaataaaataaaataaaataaaagttcagtcagactgcaggtttttatacatttgttctaatcactttcaagtcaggagaattagttttcacttagttatgagttgacttattttcattttaaaatccaaataacatatatttattgcagaaaaatcaagggaaagaaaggaaatataaattacccatatttccactactcaatgatagtcatagttaacattttaatgtatacttttagagaaaattttctatgcttaattatttttctaatgaaagtgaatatattatacattgtgttttatactttttttacttgacaatatctaatgaacacttgcctttgccaataagttgaatatacaagaacgtatttagttgttgcaaagcatgccaaatcataggtcaaccaaaatttatttttaaaatctactgtttctggaatttcatgttatttcttctttttcactaaacagtgacagtattactagagtttaactatgtctttgagcacatccgaattattttcctaggataaatttgggctagaatgaaatttatttaacccaagaaaagatatttactaaaaaaatctagaggaacaccatactttctgaggaaagataaaagatatttccttaaacagaagataagaatggtgattactaccattcttaatcacttttaattgtaattcctagttaagccaataaaacagaaagaaagaaaaaagaaagaaagaaagaaaaagaaagagagaaagaaagaaaaagagagaaagagagggagggaggaaggaagggtcacaaaaatcagaaagcaaaaaaaatgactattattcacagaagaggttattttacatgtagaatatctaagaaaatattttttaaaaaccataggaaataacagaattcaagaaggtcaatgaatacaagttaaatacactatacagaaactcggtggtattctttttaaaacagcaagaactaactagaaaatgtattaggaaaaaaaatctattcttcatagcgactcaggttactagtttgagtaacctggtgccattaatcaaatacaggagtcagttacaggttctggagcaaaatgattttagataaaatcatcatagataaatatgcaatgaccaatgaagttgtatatagatcatggccccaatattattaaatgagcacgtgtgcatgtgcacacacacacacacacacacacacacacgatgggaagaaaatatatataaataagaatatgaactatctctggataatgtgactaagacatttattttactttattagactgttctatatttttggactcctcgattagtatgtattacttttatcatgaggaaaaaaatgtgtttaataaaaatacaatatttaaaaaaaagcaagtcagtggttacctggggctaggagagggaattgctcaggaaggagtgcaaaataacttttggggtaatggaaatgttctatattgactgtggtggttgcatctgtatattttttcatcaaaactcaatgaactatgtacaacacacttaaaaacatggccaggcacagtggctcacgtctgcaatcccagtaccttgggaggccaagatcacttgaggtcaagagttcaagaccagcttggccaacatggcaaaaccccatctccactaaaaatacaataattagctgggcgctgtggtgggcgcccgtaatcccagctactcaggagaccaaggcaggagaattgcttgaacctgggaggtggaggttgcagtgagctgagatcccaccactgcactccagcctgggtgacagaataagaccgtctcaaaacaaaaaaaaaaaaaaacaaaaaaaacacaatgtggtacatgtttattatatataatcatgcctcaatatagttgattcaaactaaaattttaaatttatatagaaaaaccaggggatctgtctgattcctgtcctactggcatcatcatgatgaactactgccttgatttggaaaaataagatctgcccaaatcctggctttctttggtggtggctactttttcaaccatctctgaagcagttgagaattctgggctccattttaaagtgggaaaaactgagatcctaagaaatagaaaggaatttcccaggaatttcaccagagtgcaaaaataggaactaattcccaggggtccattcagtgtcttgagtccctgccctgatgttcagttcattcacacatttactgaacacctactatgtgctagacactatgtctcagactgggaatgtaacacctggcctttgatcaacctacagggtagagtcaggtctctggaacggaagcaaaagaaataagtaccatgcactcactcacatgaacctgtagaatcctcctgggggatgatggatttccagagaactctggcatcttgccacaacccactaagttgtctcaggcaaaattgtagtagaaacctaggctctttgtacaagactctgtctacatgataaaaagcaccagattgaaaaatgatcaattccctgctctcgacagtcggaacaaaagaacaagactaactataggctttgcctgatttatcttgagcagggattgtacttcttttgtgtaataggtggtgtgcagtggccatggagtgctgggtttgggattggaaaacccagaaggcaagtgagtttgccacctcttccccatgtgcccgtgtgctgactcctttatcctctctgagctggcttcctcaccctcaatatgggatgacatgtactgtgcctactctcagaactcaaaagagataatcgtgtgaaaagacttgacaaaagtctaaagtaggagttggcaaactacagcctggataaataaagttttactgaaactacagccacacttatctgtctggtattgtccgtggctgctttcgcattacaacagcggagttgagtcattgccacggagttcttaggggccacaagcctaaaatatttactatgctgtccttcataggcaaagtttgctgagcactgctctaaagcactgtttaaccaggtagattgctgttgcagggctaggcacaggggtaagctccaagtaggaactcacagattaaaatgtggttggttgaatccatcattaagaatttatcttaatgaaacaattttatctctaattgattcgttgactttttaatagacccttaacatttacagttacaatcatgtctcaaaacacttgcaaatgtggcctgcagtttctctctgctaaagtttcacatctaatcccttatttagatgtgataacatcagacattcctgggcagttttcaggtggttctgtggttactgattacgaacaggaaaacagcatctctatgtacatatcatgacctgttcataaaagatgaaatgattttgtaatgttaatggtttgaaaggctttaaattgtttttcttttactgtttagacatctgtctgcatttagatcaagtttctaacagaaaaccccaagcatgattcttcatttattagagcagacatttgcctttcagtaaacaatgatgaatgtggcccaactatgagttcttgaaggcgagaatggtataggctttttaaaatctgtattcccagatgtgatcattcatgatatagtcacataataccatgaataaacagatgcttgataaatgctggccaattgactcactgacagaagggatggatgtttcttcacttggaaaatgtaaagaacaataaagcgtgccctcccctcccctcttatgaagctgaactgagataaaggaagttaaaaacttcctgtgaactgtcaatcacttggctgctcctctggtgtctgatcacattgctggggcctgatttaggttgagggagcctctttaacatccttcccctccaaaatgctcatccaggcttgccttagggctcctttcctgggtggtatgtgggatccacgtcaaagcaacctggggaagtaaaaccaaggtcagacctaaaagaaaaaacaagtctccaaagggaacatgcaccttgggagaaggtgggggagaagcggcaggaagtcccttaactggcaatgctggggtaggcgtcccctgggctgactgcatgcctctatggaggtctaagaacttggctgttggagctccctactcacccccagctgccccacttccatttgactttatgagacactgcatagtcacaaatctttgcagagaataagactccctggagcatgggtgtacaccttgagttgccacgacctggacacagctttccctgagcaaaggaacatccgctcggcctttgtggaagttgcaccctggcgtcgctcattgcagctgaaccaaatatgaggctagaaggaacttagtggtcatccaattcagtgcccccatgtactgacaggacctctgagcagttccagggagtcatggcctgcttggcctgactgttgggggagccctggggcatcatctcttctctccggcacaggcacaccctctttgtacagcctcctcctaaactatgacttcagtggagtcactctgttcccctccagctgccctgctctgacactttcaaccccaagaggtagcggcaccctagtctgagagtcatcccctactcttctttttctatccattcccacgcttttaaagagccaatccttctgattttttaaaacaaaatatcaaatgattctgaacatttgacaacacatttggacaggaaagacttttaaagcagatgtaaattcattcctttttttttttgcaggggcatttgcatcttcagagagtcatggaatttgagctagatgagcggtcagactgaggtagctcatctcctcctctgatcctgcatttgccataggactggccatttcacgtcacgccctcaaaaccacacagctcatggcctcaagtccaaatggccaggctcttggtgtgttagttcctttctgtgtacacaaacccccaccacacaccctctgctctgtccaaacttacaaaggagatgtcgcttcctcctgaccccctctacctcaaatctccctcatccttcaaagctcagggcaaatgtccctcctctccagagccttccctggaaacctcttgtcttctccttgtggggctttcctgcccttcactcacactcatgaactggggagagaatgctggttaacagccccctcctctcccaagcccactcctgggctggaagacttggccggtcattttaggctctgattaacgctactccagaagatcaaagtatgcagttaaaaacccaggcaaacttttggaaaaagtaagtcaattagaaacatcttaaaaaagaaaaaaaaaaaaaaaagaaactatttgacagtaaatactatagctaaacacatacaaactatatgatacaattccattcctggttattacccaacagaaatgcttaaatctatgcaccaaaagacatgtacaagaatactcacaacagaaatatgcaaaatatccccaaatgaaaactacccaaatgtccatgaacatggataaatattaataatagtgataaccatttatacaatgaaatacttcacagctctgaacaaacaagaattacatgctgcaatatgatgagattcacaaacaatattaagtagaaaaaatccagacacaaaaactctttgattccatttacataactttcaaaagtgacaaaaccaatctatatgttagaaattagcttagtggttacccttgaggtcgagcgatctatcaccaaaccaattataccactgatagttacatcaattccattccttttctactgcttgttttgatggtcaggagagagatttacaagggagtttgaaaagtgggagaatcaattcatttaaacaaggctttattgcatgcttccccatgggccaggcattgccctagatggtaggggtacaggatggattagacagaatttctgccctcgaggaagtcacagtccaacgaccaggctcacactctagaaagggccctcactcttcagcatgaggtgcccactctgtgaaatggccagtacctaactcatccaagaattctccccctagaaagtcaaagacacccctcaccctatcaggcctggaagatgtacccaggctgaaacacttaggtaccacccaccaaaacattgtcaccctgtgcctccataggagagggttataagctgaactgagagccgactacctcgctctggagtcctccagagctttgaggagtgatttccagtgcccataggccagcagaccactcagacaagggcaatttcgagatttctaatctaggcaagggccgtgccaagcaccacactgacagctatcatttgaggcaatatttcactcttatagtgtggtcaccgtcccagtgtgtttttcacatctaatttcatacaggaagtcagcccagcctcactgcttatcagaacagagaacagtcggcctccttgactctgaggatcccataaggcctcagtgataagctggctgcccccagattccttctcatcaggaggctcaggagacaactgggatggcctatgttctgggaaatgacagcacctagcagcatcagtaactctaccaaatgacttcgagagaaaccagagctggagggacctcagaaattacccaggcccaaagatactcccatctttttttttaaatgaggagattggggccaaagggctgaagtctattcctcaaggtcacactaataagtgatggcaaaactgaggacaaaattgaaatctccagactccagggttttttctgtatacactcacctgcaaagctcaaaccaggagaagcaaataccatcctctcaccttctaaacccagaccctgtagagtctcatagggcctctgggctaacttggacccacccttggaactaaagaaatttacctgcacaggagattttgcttctttaagcgcctgggcaagctctaatcccggtgcagtcagaagcatgcagcctgaaaccacctcttatat

SEQ ID NO: 1902 - DNA, 180315 bp, Homo sapiens
cggcggcggcggcggcggcggcggcggcattgtgcgcgcaccagcagcccggcccgggaggagcaggacgcgccggggccgcctcctcccgcacggacccatgaaccagccgggcggcgcggcggctccgcaggtacgacggggggccgggggcatgcaccgcgcgggggaccccggggggccggggcccggggcgctgcgccacttcattgcaagatttgcaaaatgcaaagtgcctgggcacgtttgcgggctttttgtgggcgcaatcgggagggtcggggtccggagagcacccccccgggcgctgcggggtgcgaggagggtgggggtgacgagggggtcttttggggcccccacccagcgccccctccggccccgggctcggaccggagcccagaaaacaaagcggcgagagaacagagcagccatttcagtttggacaattcacattttgcaaaaatgcaaccccttccagctctgccccctcccccccaaatttgcaattttcccctgaccctctctgcgctcggggtccccgatgaccccccgggaggtctttccccccaggtcccccatttttgcaacaatctttttttttaggccatattttcctttctcaattttttttttctaatttttcttcaaacggtagttttttcccattaaaacgacgccacctagaggatactattttgtaaataaaaaagaaattaaaattgaaaagaaatattttttatttcttattttttcaaaagtttgcactaccaggcagtggaggggtaagagattctttttttttcttttttcgggtgaaaattttcactttgatctttccagaagcatggagacaatttttatttctgaagccaaatccagataatatgtaaatgaaaattaagctggaatttgaatgaatttagttcttggaggggagaaagcaaaaaacctcctaaaagcaaagtcagtttgggtacccaactcattttagtttgagaaaaaaactaattggaataaagaaaggagggaaattgttgagtttagggaaaactgagagaattggctttatgaagcaattagaaattgtacttcattgtaatttggaacttgtttagctcagcgggcaaaaaaagactaatttctctatatggcaatatttaaagtttttctatttccacgaacgaaggatttaaaagagaaaatagaacctaaaatgttggctttggacacacccaaaaattgtagttttttttttttaattttgcatttacattttactgcatttaaatcctaagattctaaagaaaacagaaactagaaaagttacagtgaaatcctttctttctttttttctgtatttgttgggttttgtgtgtgtgtgtgttttttttgttttgatggaataattaagactgttttctgattttgtttcctgaaaggtctaggcatttcttttttgttgttgttttatccagaaaatgtcaggaaccttttttgagcaatattaagtggaaaaaatgtaaattcatacattatacaaattgagtagcccacagatttgtaggagagaccgccattaaaataagatatgcataattaacattattatgaaaaaactaacagtggattcacagaagctcattttttatgacatgcaactgaatcaattgatgaagacaaggattgaggaatccttggtaaggaagaaaattttcccttttctgtcttgttcacccttccaatttgaaaaatttattacttaaaaaaaatttagattggtttcaggcctctttgattgtgatgtggggttggtagtttatcaatatttgttatttttcaaaaacctgattactttcaaagggggaaaaatccattagccttgatcattttggggggtttgtgaccaaaaaaaaaaaatgcacaaattttactgacttaacaagaaaaagataaaagagggatgggcaaaaaggagatgaaaattctgattcttatccatcttccttggtagaacacttactttgctgaagaaatgtgatataacaccaactcagctggttttagcagcaacaaaataaaggaaaaataatcaaaatacaaacaaaagccaaacccaaggtttgcctttggaatatgaaagcatatatgcaaacaatatttcatgtggaggttttggccttaaaatgaatcacatgaaggtgaaacaaaaaagaaaaaaaaatttaagaaggcaaataaatattgaccgaattgaaatttgacagatgagaataaagtacccacccaaagatgaagcgttttgtgataaattagtatctaattgaacttgctggggattttgagcctatcccccaaaagttacaatttttctgtccaaaaacagcatattgttaggacttgcagggcgggatcttggagggaccttggattggaaattgatggtgggtcacctggggcaagaaaggaaaccctttgctccttttgccagccactagctggtcttgggaaaactggtggccccagtccatagattcccaaccctgttttgtggaaatttggatgtttaagtggaataagtcaaatatattatctctgtgaaatatatttgacaatggcagaggtttgacatttcccatcatcgccattgcatttgggagattttatttttttagtaacgaaatccttcagggctgactggtcacattctgacatatttggaatgagcttttttttttttaagtagcataattaaaaaaatttttttctgttgaattatttaggccgatgagtaggacggtcaaggaatttataatttccaaggggctttggaggcctcatgaggcagaaggcctgagtttagcagtgatgaaggagagatgggctggggaggggtggaggggggtaggggcatctgagaaaaagtcagggttgtagataacaggttatttctggtgcaaggaataaaaatattgcagcacgtccctttgtgtggcctggatctcctgacacacaattcagcttccttcattccattctgctgaaattttgttctgttgtctatggctagaagttgaaaatcatttctggttttgtagaactgttttttttttttttctgttttttttttttttttaaattggttattctgatcatgtttgttgtaaaggaagtagaggtgcatgatggttctattgggggcggggccagttttcttttgtttctattggtgtctctctctggattgagatctgaccttggccttggctctctcacctcctattttaggtggacgtgtgaccagaaatggacatgtgagctaatttttattagctcctgtctgttcaccacattctcgtagattattgggcaaaatatctggcaaattggacttgggggtggtaatttgatgatgggctgaattattttggcgaaagatcgtttatattcagtttcacagtggagactcttattacttaatgttttgcttttctgcctaaggaggtttttttttttttttaattttttctaacaaggtttgaaatttcaagggcctgctttatagtttgactttggagcaagctaggaaaagaggtttgcttatacttccagctctgcacagaggtgaacttgaacaagggttcttgcttttgcagaacgaaagcaacaaagatggctggtcagtataaggctgacctctccctcgtcctagaaaataaacagccaatggcttgtttcacttgagaaactgggttttaaaactcctccagtgtcagatacaatatttttctcacttttgactcagctcttggcatgctgcttcctctgacctcagaatccttacgtcttctccttggtgggtgataagaacttccttgccatatatgactgatgtatataagccgacttctcatggtcatgaggaaattttgaattttttccatgttcttgtgatgttttgggtcagttgtaccttctttctggtgatgtaaaatgaagtggctcttttcaggagccctagcccccacaaggtcttgctgtgtgaccttggacaaatcactttttccttcagagcctcaatttttgcatttataaaatgaacacttgggatcagatcaaggataataataaataggtttcatttctgattgtaactccaaggaattggttatggctgcctggatcactgtgttgagaaggattctgaggccatatcccgactcccatattctagagagaggggtgcagtggccaaacagcattgtaaatcagagtggagagtgtacctcttagttaccattcccaggcgagaccttgaatcatgggccattagtggcctgtgaagtcaatttagtgaatcacaatcagaattttttaaaaacaagaatagactagaatataggggaacaaaaaatagcagaggcataccacagggtacaggtgagtatcctctcatgaaacttgtatttatatttgtggatgtatgtgtgtgatttgaaatagatttcctcctgtgggtcacggccaaaagagtttgaaaggtactggactagctgaaccgccatgatgtgctgcaggtatactgcactttattgcttatactttatttttgcatttattatctcaattaacttttaggtgaaccctgtgggttaggtgtcctgtgccacatattttgagccctggttgagcccacttcaagggccacatatgaagaaagctcagccacatgggcagcccaggcacataccccagcttgttggccttggatgagtctggaaggacatatggaaaggcagatacaagtttgaaggcagcgtctttgcaaggtcttcttgctggagaggagatctaaagtgtgtggagtccttgtcttttgttccccacttttagtttaaattgccagagaaatttttctggagttagagagtctgtgtttgtgctatatttaatttaatcagacaaaaacacagtctgtatttttgtgtgtgtgcacttccttaaaaatcccagaatttctgtcttagtctcctcatcttttaaatgtgtcaggtcagcgctaatagaaatataattcaagcccccgttgcgagccacatatataatttttaattttctcacagtgtattaaggaaagtaaaagaaacgggtgccattgattttaacatatttaactcagtatatccataatactatcctttcatcaagccatccatatgaaaattattaatgtgacaagttacagtcttttgcgggggtgctattgagtctttgaaatctaatgtattttactcctacagtacatctcaattctgaccagccacatttcacctgttcagcagccacatgtggctggtggctactatattggacagctcaggtttggaccagttgtcgtcatcactggctggccccagaagggtagcaacacctttcagacctcttggttttgttggtgagacttcctatcagaatctcacatgctctgaggcatttcagcctgtagtgatgatgagttccatccatatagctctcctggctagagtagcccacatttcccttttatttgtcccaacgcagacttctgccagggttaggccactgtgctgtagttaaaaatgacaaatgatggctagtaactccgggatgatgtgttgcagcctgtgagctgttgaagtcaaggagtgtgagtccgggaggctgttgctttttgaagtgcattttaaataaagtgttgccagagagaaggatgaagttgcaaaaaggcagcaggtggccaggaccagggctggggtctgaggagaggaaggagatcagaggtaaaagatggcctggcaatgaaatctatttctgagccaaaaacatggcatcagcaggaaatccccccaggccaggccttaggtcagatgcatagagattttccgaatccaccccaattgggaaaatggaaagctgggtttgaggtctgccagaccagagtttgaaatccagcctcatggtgtggttagctttgtgtgacttcgggaaagtcactctggttctggaaccacagcttctacatctgggaaaagagggttaatgatcccagccttgcagggttgttttaggattaaatgaaggggtcacatgtggagactctcagccggtctgagggcctgagtaggtggtcgacgcatgtgagttgactcaacccagtggccagggattctccatttggggagattaagtcccactgacaacacttggggtagtcctggaaacctggtggcttatcgttagcaggcaaagttaggcgacaagtgagaatgtacactcttggctgttgctttaaaacagcctgccatccatgagactttcttgttaaagcattctggatgctttcattccggggctgctctagctccttggaatgtttctggatttgtttctgagcctgtggcaaggctttaaaagggatacatctcaatcgcgggtggacctgtatgtctttgagcttctgctcatgctggggcccttgcctctggtgccccttccctcattcatatctgcttcgtgagaaaccagaccctcctcgagatcagctgcacttcttcttctgtagagctcccccaacaaatttccccaggtaggcttcctctccctctgcccccatggtacctcccaaacaatgtggacccacaggtcagagttggttgtttgcatttctgcttctccagccaacttgtaacatctgtgagggtagagatcaccggttattcattttagggtctggcgcagagcagcagctccataaatatttgatgacttcatttgatttttggaaatagctcagatcagtgggctttgggtctagtgaagagtggatgaccaatttgggcttggccatttggtcaaagccaatgttttattagggagcccgaggcacattttcttacagctggctctgaagccatggctcccctggaataataagtccaacagggatccttagttggggaaatgctcctttacatgtcttgggggatttttaaaatgttcgtctgatgactttcacccctgccctcctcactccttttgtataaagtatttctttaaagtggatgggggacccccagatgcctgatttgcaggtatggtgaatggggcatagcagtgccctgtatttatgcctggtcttcttagccaggtgtcctggaactgaacaccaggggcctgtttgcagaatatccaggcacacgggctccttcaacttgaagcacctaaatgtgtgatgtgaccccatttttggttgaattttggtttgcagatgtcaaagattcaaggaaaatttatgggagaaaacagaaccttctgtttcttggcttagtttttttcagcacgttttataaaatgctgtcatttttaacactttgtggccaatttcagcaagcaagcatagaatcctaagttaaggtagacatcgatcctcagtgttcatattcccacgtttccatatttctgaaatcaggatgccccttacagtagatttgttcttctagtgaactttttctccctcttatttcttctccaaaagctgttataaaatcgatggtgcatctatcagttgaaagcatcttgggattgagtgttgttgtcctcctggtggggaggactatgacctgtgggggctccatgctctgtttacctcacttttctctgggcttggccccccccccccccccccccgccctgtacagtgaaggcaggacttcaccttgggaagaaacatctggaactctgacttagtcctactttcctgccatgtctgtgtgtaggttttgtaattttgctgtggcctctctaaaaggggcaagtagcccgtgggagggaggtgaagtcctgtaaatgggggaggggggtctcttcagtacagccacatgcatgagctggcccgacaacagcggagcaccagtttgacatttccaagggtagaatgagcagagcatagtcggagagccaaggcacggctcccctctctgctccaccagttaatcattttgtggtgtttgccaaagtacttcatttccttgcaccgtattttccttacctgtaaaggtgagatgataatatattgatgatgatgattgaagatgatgatgcatagggttcttgtgaaagttgtgagagatgtaagaaaaaagttttgtaaagggcaaagttcttttcacttgcagcatgttatttgtgcatcatctagtccaaggatggtaaataagtagcatacatgctgccattccccatcctctagcctgtggcagacatcactaattgaccatggtagtcctttccattgagtatggccagcggcctcagagtccttagtattatataatgctacccatcagttgggcttagatgggacatgaagccagtttgtccttccttatcgacacacacacacacgcaccccatgggacatgaagccagtttttccttccttatcgagacacaaacacacagagagagagagagagagagagagagagagagagagagacagagaaactgaggccttgggaagaaggtggagtgacttacccaagacctcagtgaacaagcggaagtgggactaaaagcctcagatttcttcactcctcaaccagtgcttttcctgccctgtgtgtatacactgtatcaaaaggaattaaaattaatttggtcttgagaaatagcgagagaatcctgactcctcccttccctgttataattagatacccttggggttgtcatcaaagcagggctggatgacctgcttctctgcctgatcctggagtgatcaggtttcaaaggggagacgcctgtggctaggcagctggattggatggtgtctctcagcagtgtaagtgacgtggcagtggggcaaggcaggccctggggttcctggatgatgacctgggtttgggacaggtttgctgcttacacactttcaagtccacagacaagttctttagtccttccgtatcttaatttctgcatctgagaaatgggctggtaatgattcttcacaggaatgacataagataacaagtttgaaaatgctttgtaaactcttgacatacatgttactttttaaatacacgttactttttataactagtacgaattattagtgctatgctgggtaagttgtgtaaactgagtcacagactaagggccacaagatgagtgggtcccttctcttgtatgttattttatctttttgccagcccagggttcagaaagtttggagtttgtgagtctttcacagattctttcctgtttgcatctgtccccagcctcatcctgtttcaatcatgtatgtggcctgcctagccctggaaggccttggggtctgggaccccgacacagcctctacttgttcatctgtttagtgggaggacaggccatccttaaacccttccaggctttttgaaagcatcgtatgagttaatggactagaaagtgcttcatgaacagcaaagaactggagaaacatgttggcgacaactcctttcttaaaaaggaaaggaggaaggctgaggtgaggatggtattgagtcgacaaaaaagtgatataaatattttggctgacaaagcagaatgaggctttctatataagctaaagcgaataaatggagtcaggtgatgcttggccccccagtctgctatagaaaacacagggaaaaacattgctttctagtgaagtgagccctttgtcaggggtgaatctttgattaccaggggtcagccctgttcctgggtgaggacccagggaggaatgaaacctggtgtctcccccaggggtggaaatggctcctgcaaagtggaggaggcctgagtatctcttggcaagtccctggctcgcagtttgctggtagcactcaaagtcaaaagtgcttttggcttgcttactggatgtgttactgtccaagacagcatatctgaggagctagccattcttacctctcagctttgagcctgtgccatacaaattcctgcctgtcccaacatttttgtggaaaattgggggactaagggtgggaatttttgtcaggtgaaagtttgcagagaatttgtgttttgttttattttggactcagagtttttgcaagcgaagaagatgtagtcggggaacttagaatactcaaaaagaataaaagaatagacgaagacatttttggatgttggggaattttttttttccttaatttcatcaactgggaaaaataactataaacatttaattgtgtttatgtgggtgtttcttaaaatgtatgctggaaaagcagaaagtgaaactgatctgaaataaaactgaaactagtctgaaatgagacctcagggaagagaaacttccctggggtgctactagccttcgttggaatttgttgtgaggcctgcctttgttttgtcagaggggtctagagctataagggtaacagatagcatctaagcctgtgccatccagtatgtattggtatccactagctgcatgtagctaggagtagttgaaatgtgggtagttaatccatacaagatttcaaagacttagtagaaaaaaaagactataaaagtaataatttgaaaatactacaggttgaaatgatattttacatattagattaaataagatatattattaatactaatttcattggtttctttttactttctacttttttttttttttttttttttttttttaacaatgtggctactagggaaatttgaaattccctccatggctcatattatatttctattggacagtgctgatctaagccaacctgctccttttatagtagaggaagtggaaccccggagagggcaagtggcttgctcagggtcacacaacaccgtcatcagatacctagacagactgtaggactcagaacctggcatgggatggtgatgtagtggtgtaggcattagtgtaagtaggtggttgaaatggaggaggtaatgagagtttataagacagagaaagagagagagattagtaattcagggaaaaaattatgttgtttcccactctgcttatccctcccctaaacattagttgaacactttgaaagaaagcaaatccaacaagatgagcaaaaacaaatctaaaagataatccctgacaatttctctgcctaccaaaagattccaaattcgtttttgagtttgaactggggtatttttggatcaggttgcagttctgggcttgtttgggcatagagacccaggtcacattgggggctgtggactttgagtcctgcggggactggaagccattcttttgctaagtcgtgtctgcttcctgtaatgatttgggaaggaaggctgctagaagacccagagggcatccttttatagtgggcagagctggcagggtggggagtcatctcccttgacttccagcctggatcagagacctggaggtgggtgagcggcccaggcgggtagcagcagtctgtagttttccaattcagtactcctgctcttcatgttttgaaaggaagtttgagccatgtgttggaaattcagctttataaaattttatttttttaattaggaacttttcaaggactgaagtttagcattcttatttatctcacattatttttgcacaatggaatttatctgccttgaaatacaatcattgcacatttgctgagtgcttattatatgactggccttggactaagcattcaatatctattatctcatttaaaacagtcaccttgtaaagtagggtttgttttttttttaaatatgagagagtggaaattcagaggtgaaaggaattgcccaaggctacacagctggtaagtggcagctggattcaaatttaggtggccaccatattctaagctcacaacaccactttgaggtgttgaatcttaccattcccgttgtacagctgaggaaagcacagtaacttgcccaggatgtggagtcgatggatgggctgggacttgagacacggctacccatttgtctgtggtggattgttctgagccatggcgtctggggaagctgctctccccatttcatggggcctgggtctgggactccctggctttcagcccccagctccccatgagcctcagcagaccagcgggttttgtgttccatgctcacaaagcctttaataccacgtttgaaaacagttgcagaaggtttgctgtaattaattacatttgacatacttggaatcggggcctcccggattcagaatgcaaatttatgcccagacagatgtaaggtatgcttggagccaagagctctggcatgtcccagtcagggcctgcagcatcgctcactgccctgatgggacagtaacaggccgtgagaggtggagtcaggattcaaccccagggatacctggagcccacaggctgttggaggagaaatagccctggacgctttccagtctcgggtacattctttgctctctttggacctcagttttccctactgtacaataagggcttggactaggttgtctcagaaggcatgtgctgttagtttgggcaggagggcagttaatcagagaatcagagggcaattggaagtataaacagctgaggtaagagaggcttggaatagccaggtaagcaggaggcctttggaacagacaagagagatttacaaggtaaggtctgatttaagtgcaggatagtgctgattgccagggttccacatgcaaaaatcctccaatcagcgccagttcatcttcccacccacatacactcacctcactgtctgtattagacggttattgctgtgcaacaaatcaccccaaaattcagtggcttaacgcaacaatgatcatttattgtctcatggtttctgtgggctaggaatttggcagtggctcagttggtcagttctggctcagggtctttctgtggttgtggtcatatggtggctgaggcagagttatcttaaaagggttctccatgctcatatttggtgccaggattctgaagacttgaacagctgatctccttggccctgtctccccgctaccatctctctctctctctctctctctctctctttctctccctccctctccatgtgtggtctctccagcatagaggcttcatatatggctagacttcttacgtggcgtcttgaggctgcaaagatgcatgtgccaagatagatagcactaagcagctgcagcctcacctgttatgacttagcctccaaagtcatgcagcatcacttcaccacattgtattgatggaggcagttacaaaggtgtgcgccattcagagggcaggacatcaactccatctgtctatggaggcgtgtcagctttacattgagcatgtaggatgggatatatcttgatgtggccatctttggaaaacaagggccaccataccatcagtgtgcccatcaatctgtctgactagctatctacctttccatgcatctctctctctacccactcacccattccatctttccacccttcagacgtctgtccttctgtgtgactgtctgttcttctgtctatcccaatcacctaacacattttgaggacctgtgtgccaggcacagctatgtgcattcaataatgagctcggagggagaatgagactaatgttgattgagaacctagtgaatgttagtcccttgatcttcaaaacaactccatgacttagaattatcatctttattttcctgggaagaaaccaagacacaagctaaataacttgcccagggtcattcagccaactaatgtcagggtcaggacttgaactccaggacttcctgactaccctgtctctgcataggatacaggctctcttttggtttctgagtgttaaatgtctactaagagttagttctccacttccatttttttcccaagcgaaaatagtttttcttccctgactataaaaataacatgttcattacaaaaacattcaagcagtacaaaaaaatgaagattattctttttaaaaaatcacctgaaatgccgagataaccgcccttcacattttgatgagcattattcaagccatctctacatatttaagtacatatgattttacgcaaatgggattatattccatgctgttctgaggcctgatgtctttttctttttaaattcatagatatatttttcatcatcagcaaatgtagataggtcttcattattattttactgactacattgtgtttccactgtatgcatggcccaaaattcagtgtgcgattagattttggttatttctaatttgtcattgttataacctactctgtgagaaacatctttttcgtacagcttctcacttgtgtgatcatctccttaacatcactgtttggaaagctgactgcaggaccatggtggatttttattctacatgtagacagaacttgccaagtgtctcccagccaggtggtatccgtttacatttctattaggagattgtgagtgcccattttacacatcctggccatcaccttgtgcttatattttatatctttgatggcctgatgggcaaactaatggggttgaatatctgttggtatagttttatattttagttggtatgttttacttgcattatattttggttgatatgttttacttgcatttcttttatgaattgcctgttcaacctttttgcccatttttctcttgcggtgtttgtcttttcctttacatttttaaagaaaagctctttggattttggagatattgactttgttatttagattccatttttttccccagactttttaaaacttagttgatgttatttagtggaagtggtggttaaatgcaatgtttactttttaaaaatatttatatttgtgtgttttggattcttcgtgtgtatgtgtatatgtgtgccacatttaaaaagacttctccatattaagaatttatagtgaaaaggcaacctacagaatggcagaaaatatttgcaaatcatatgtatttggtaaggggttaatatccagaatatataaagaaatcctataaatcaacaacaacaaaaaataactccattaaaaaatgggcgaagaagttgaatagacatttctccgaagaaatatacagatggccagtaagcatatgaagagatgcccaacatcattcatcagttcaaaaccacagtgagatatcacctcatacccattagtatggctgttattttttttaaaaaagtgttggtgaggatgtggagaaattggaactcttgtgtgctgttggtgcagctgctatggaaaacagtagggtgtttcttcagaatattaaacatagaattaccatatgatccagcaattccatttctgggtatatatctaaaaattcaaagcaaggtctcaaagagatgtttttccacccatgtttattgcagcattatttgcaatacccaaaggtggaagcaactgaaatgtccatctacagatgaatggataaacaaaatatgatgtattcagccttcatttttaaggctgaagaatattctgttattaacactactggattgtacatttaaaaatggttaagatggtaagagaaacaagttaaatatttacataacctaacaaatcaacaatatatgatagaatattcagccttaaaaatggaggaaatcctgtcattcttcaacatggatgaaacttgaggacattctgcttggtgaaataaggtggtcacaaaaagacacatgctgtgtgatcccactcataagagaaattgaagtcaaacgcagaaatggaaagtgaaatggtagttgccagcagctggtgcaaggacaatgggcagttgttaaataggtgagagtttcagttttgtaaaatgaaaaagttgtagagatctgttgcacgacagtgtgaacatggttgtcccttagtatccgtgggggattggttccatgccccgcccccccaatataaaaatccatggatgcccaagtccctgccatcaaatggtgtatttgcatagaactacgaacatcctcctctatatttcagattatctctagattatgtatagtacctaatacaatgtaaatgctgtgtgagttctgtatatttagggaatatgacaaggaaaaagtctgtacatgttctgtacggatgcagcagttcattttaatccaaggttggttgaatccatggatgtggaacccatgaagacagagggctgcctgtatacttaacactgctggattgtacatttcaaaatggttcagatggtcaaagaaaaaagttaaacacgtccataacctaacacatcaacagtttatcttgtaggaacatgcaagaaatatttatgtctttataccatgcaatatatgcataagtggtcacagtagaattgggtttataaataatatgaaataactggaaacaagcagaaaagcatttacagaaattatacatttcttctatttttttatataggttttgttgtacttaaatggtttatctatttggaatatatttggtttaaaggagggacatagggatcaggctctattttttcccaaatggtgagcccttgctataacgccaataattgaatgatccatcttttcctgcctgatttgaaatgctgtctttatcttacgttaaacttctatgtacttaggactgtttctggactgtctgttgtgttctcttgatgtacagatgtacaggtatcacactgtttatcactttaaagtaaacgttaacattagaatcatgtcttaagagcagacttacgaaatagcagataaattactgcactgcctgctgtgctcactaagttgggccgctttctggtggactccttcactgggcagactcgccttgttagctagactggcatcaatgccattatagataaggaaactgaggttgagtgaggttaagaaacttgctgtaggaagtagcagagcagagattggagcctgagtctgtccaaccccaaagcctatggagtcctgttcaaaacatgctatggacgtgccagtatctttccctagggactatataagtaccttattgaatcagatggaatatgatagttgtggcttatctgaaatgtttccctggctgcagttagttgcatgctaatatttgttttaataagttaatttttaaacaatctagtgatattatagagaaatcagaaaataaaaagatcatcctaaataaatgtcaaccctcttacatttaccattaaaatttggacacctttccctctggttattttgtaagcatatttttattatttaagtcataaagtattaagaattttgttcctgccttttccttcccctatcttctctgttaagctgctttgtcttcctaatgacaaagccatttttcaagactacataatattcacagatgagaatgaaaataatttatttaactcatactctattgttgaacatttaggttggttctgattttccacttataaaattatactgtaatgaacatcttctatatataaaaatattttgatattttaaaaccatctccttttgatacagtcccaacgagagattattgggttaagggtacatattagtttaacacatttccatatttccacctgcccattttctggcatttattgatactaggctttgggaagctttgttcatttggaaaataaatttagtatattctttaaaaaggctttgctgacttatcattatgaaaggagtttatgttcaatgaggagaactagactatgtatgcaaaaaaagagtcataataccacagtgctccaagatgattttgtcaatttcatatctatccttgcattatttttttatacaaataatagtttttcagtaaattatttttaaatctcacattttattagccagaattctctaataaccagtttttctgcatttatgctgatagtttgtatttggaggatgattcttcatctttcaaaatcttaaacatagtttgtatttggaggatgattcttcatctttcaaaatcttaaacaccttttcaatttatccatccacctgactgaccattacatatttgtgccaactatgggcagtgacccttaataggtgccaaggtgctgaatcaatatgaattttgttcacagccttctggaatgtgctgtagaaagttcagcgctctcagactgattgtcaagggtggtggagggaaagatgaatcttggtaaagggaatccaaggcaacttcttgagggaagtgtcatttgcacttagctttgtatttgtaattgtaaatgtcttgaatttataaaatgacttggataggacaatattatgttttttccacccggtaacatggtctgtttctttattcattcacgctcctttatatgactcaagttttggagttttccaaataagttttgagcacttatttttaagtttattcctagatatttgatatttttgaccgcagttgtgactgagatcattgccctcattgaatattttgcctaattaatgtgggtacatagaaaaactactgatttttatgtgattgttaagttagtggataatttattgtattaccttcttagttccaacagtttcttgtggtttctaggtaggcaataatatcatatgcaaataatattcatttcccttcatcttttacaatattgtacttttttctcttatattatgcattgactagacctcctggaacaatttgaataataacagggataacaagtattcttgtattatcttatttcttttcttagtgagaaggattctagcgttttgtaatcaagtatgatattttattttggtttcagaaatgtatattttttatcactaagcatccttctgagttgctaagagttttttatttttaaaatttgtgaagatggaggtgagtgatacgatagaggagtgattttcaattttctgtatttgaatttttcttttgcaatggaggttgaatcattcccctcccccactataaagctatttagtaataagagggggtaaaaggatgatgaatttttaacaaatgcctttttattatgtacccagatggccatatggttttttccctttgatctgccgatgtgatgaattatattaatagattttctaatattaaactatcctggaaggaacccattttgtttatggtgtttttattcttttaatgcatcctgggtccaatttgcagcgttttgtgtctatatccattagtgagattgccctgcagttttatttttagtgtgctgtttttgtcattttttaagggggttatgctagtataggggttataaattagaaagctttccagtgatctgaaacatggaggataaatacatttaagattatgtacttattggtagtggtcgctgagattgctgtgttgagaaggattctgaggccttgtcatgtgtaaacaatttagtgttttgtaagagtgtaggaaatgagggtttaagtgtgcatgccagatgtttatttgtagtccctgcttggaatgatttatattgcacgggaattatcttttcagagtttaaaataacttgccattaaactctgtcttgtcaggtttttggagataattattttctactgtaatcctttcttcaataacattttggcttttgctcttttcatgcccgttttgaccatttatattttctgagaaatgtattcatttcatcaagaatttgaactgtatttgcatagaacagaatataatgttattttaagaatgtcctctgtatggttctatttcctaaactgattttttttgtagttgtattattttttttctttattccttggttgaatgactggtattcagggagtattttgttgatttctattgttttattctttcccccttaaatttttaaagttacttgtcaattctaactacttccaagttattatacttttatggtaagtaagcccaccgttctgctttctttagatttttaaaaattcttgagtgaaagcttggctctttatttttctgtttagtaataaaagtgctgggttaatcaatgaattttcctctgagtacatctttggtcacttacagatgtgtaagtgtagcctaacgattatttaaaagtataatttaaatttctgtgttactccttttcaataagtgcttatttttattcatttttagtttattctgttatgagaaacattaccaataatagtttttgctttttgtaatttattgaaatttttggattccttttaaatattaatttgtggaaatgtttcatctgcttgcgaaagaagtaatttctgtttttaggatttattttttgcttgtattcacacattacataagccacttttatatatcattgactttattaattgtatttttcagattccccatagggccttagatatattattaagtttttctaattatttcaagaaattgagagcctgttaatgtcttctaatattataatatttcttttgattttaccatttgctttatatgttttactttatgtattttattactaggtcatttaacagaagtatacctgcctgctacattttattatgggttgtacccttaatctgtaaaaataggccctccttgacctgttttatgctttctactttcagttctggattttctaatttttatagttcatttcctgcttttacctttaattctagagatttttatgaaagcacttcctgctttctattgttggaatttaccttgtatagatttacatgtttattttacttttgcttgttctgtgtacttaaaaaatagctactatgtatttcttttggatatcatgctttcttatacttaaaaactcagagtcttgagatctgtgttttttaatatggaacttacccccgtttatatttattatcataactgatgtgttttgtttcatctaattacagtttttccccctatgtactagtacaactaagaagatgtttttgattccttcatatatgaatggcagtttggataaatataacatttttgggttatgcattttatccttcagtactcaagagatgttctgtagtcttatgttattaatattttagaagataatttcgaggatacacgatattttgcttttgtgcttaattctgttcccatccccagccttcctgaatgcctgtatcactcttttttcacccttgaaatttgaggcttattccagcctctatgttttaatgccttttaattagttgctgggaacatggcatgtactttcagtctacagatttctttcttaataataggaaatgttttgttccatatgtcccattggtctcatctttttaaaatggtagttatctctatatatccatatacccctattgtttgccttccgtaattatctttacttttggttattttaatctctttaaattttttttagttttatatgtgtttccccagcttttcctttgcatcacttactcggttttctgcactgacagttctgccctttactgctttggatactggatttcgttttttgttttgttttgttttgttttgagacggagtcttgccttgttgcccaggctggctggagtgtggtggcacgatctcggctcactgcaacctctgcctcccaggttcaagcaattctcctgattagcctcccgagtagctgggattacaggtgcccaccaccatgcccagctaatttttgtatttttagtaaagacaggatttttccatgttgggcaggctggtcttgaactcctgacctcagatgatccacccgcctcagcctcccaaagtgctggcattacaggcgtgagccactgtgcctggcctcttaactggtttaatggtgttatttgattccttgcacttttcattcctagagcttctctttctgtttcactctgttcttgtctttaattttactgagcacacaaaggagtgtgtcttagatgtctttctgttttccagagtaacactgtgctctgtatgtttcttctctcaatcttgagcatgatgcttaactctatttttgtcactccattttgtttccttcgccctccccctgtttgcctcatttattcattcaaaataagggaagtctcgtgtttggcatgtttggcttggcctggtctatatcctaaaatgatgtcagtagctgcttcctcagatttttcgttttttttttttttttttaagagatggggtcttgccttgtcacccagcctggatcatatctccctgcagccttgaactcctgggcacaagcaatcctcctgcctcagcctcctgaggagctgggactacaggtgtgcaccaccatgcccagctaatttttaaattttttgtagaggcggggtcttgctatgttgcccaggctggtctcaaactcctggcctcaagcaatccttctgcctcagcctctggaatagctgggactgcttcctcaaaccttgagtggaaagaggagggctagatgttacacatttatagatcagcgatgcagcagcccggggttaatgaggtgaggctgagactgtagttacctcaatatgtggttctttcctttggcttggtgaagctgcgctgggaagtgcccagtggtttatgctcaagattctttcctggtaggattgtggggtgggtttgaaagccctagctggaagtagcttagcttctcttggcattccctgtaggtcctgtcaccttggttttcctcttaccagcctgcctcagagtctccaggagggtggctgtgagatggtccctcatgatgtcccgtgatttgtccccacatctgtaacatctagcggaaattcctcagtaggtggcttgtgcatgactccttttctagattttaagaccttttttccctagtttttttttttgtaaagtacacatattaaatttaccatcttaaccattttaaagtacagttcagtaatatgaagtacattcacattgttgggctaccaatctccagaactcttctcattattccaggctgaaactctatgcccattaaacagccactccccatttccccttcccccagtccctggtagcctccattccactttctgtctgtgtgacttagatcaggggtccccagcctccaggctgcagaccagtacaggtccgtggcctgttgggaactgggctgtatagcaggaggtaagccagcattacctgagctctgcctcctggcagatcagcaacaccgttagattctcataggagcgcgaaccctattgtgaattgtgcacacgagggatcttggttgcgctccttaggagaatctaatgcctggtgatctgaggtgggacagttccatcctgaaaccatcactccccccacctctgtccatggaaaaactgtcttctaagtaactggtccctggtaccaaaaggctggggaccgctgacttagatgactctaggtacctcatagaagtggacttacacagcatttgtgtttttgtggctggctcgtttcactcagcataatgtcctcaaggtgcatctgtgttgtagcacatggcaggttccctctttgttaagggttgaataatactgtcatatgtacctaccacattttgtttattcatttgtctattaatggatatatcagttgcttccaccttttggctgttatgaatgatgttgctatgaacatgggtggacaaacagctctttgagactctgcattcatttttttttggtatgtacctagaaatggaattgctggatcatatggtaattctgcatttaattttttgacaaactgccatttctatttttatttttttattttttgagaccgagtcttgctgtgttgcccaggttggagtgcagtggtgttatctcggctcactgcaacctctgcctcccaggttcaagtgattctcgtgcctcagcttgctgagtagctggctggaactacaggtgtgcaccagcacacctggctaatttttgtatttttggtagagatggggttttaacacgttggccaggctgctctcgaactcctgacttcaagtgatctgcccacctcggcctcccaaagtgctgggattacaggcgtgagccaccatgcctggccgacaaactgccacttttaaatgcgattaaccctaacagttttttgcacagtagttaacctcatcactactttgggtgggctgtacagggattctttccttcatcttacagatgagtaaacaggcacagagaggaaggggaaaagtgacttctttgaggtgaggcagcaacccaagagaacctggcagagctgaggccagaacccgagctcctgtctcctagcaccgtcctctcccgcgaacccgagctcccgtctcctagcaccgtcctctcccgcgaacccgagctcccgtctcctagcaccgtcctctcccgcaaacccgacctgctgtctcctagcaccgtcctctcccgcaaacccgacctcctgtctcctagcaccgtcctctcgcgcaaacccgacctcctgtctcctagcaccgtcctctcccgcaaacccgacctcctgtctcctagcaccgtcctctcccgcaaacccgacctcctgtctcctagcaccgtcctctcccgcaaacccgacctcctgtctcctagcaccgtcctctcgcgctaacccgacctcctgtctcctagcaccgtcctctcccgcgaacccgacctcctgtctcctagcaccgtcctctcccgcaaacccgacctcctgtctcctagcaccgtcctctcgcgctaacccgacctcctgtctcctagcaccgtcctctcgcgctaacccgacctcctgtctcctagcaccgtcctctcccgcaaacccgacctcctgtctcctagcaccgtcttctcccgcgaacccgagctcctgtctcctagcactgtcctctcccgctgctgcgagagagcgtttgttgcacttgagggtctaaactttgtctccagttctcctcagggcagaatctctccttttcctcaagttctcctgcgtcgttgggcctcagcgtctccaacatttaaaacgggcatctccttgccccgtctcctgtctaggcagctgttgctctcgcccttctctgtgcggacttggccagcccggtgctttgccagacacttgcagggaactgctcttgcggctgagctagcatctgcttccccatctggtctcaacttttttcttaattacccactgaattggctctaacaaaatgctgacaacttgaacgagacattagctgatacatcagcgcccgtgccagggcctcatgggcttttccgggacatgctaaacccgggcccagcaaaagaccttgttccctggccagagtccccattctagctgagtggaagctccagccaggggacagggttatcacggggtctcgtagctcataaacgccactgcttcgtggctgaactaaggcttacagcttcttaagtggcctggtggctgggtcccaaacctgcaagcaagttttgttctctctcctgctgcctccttggtccctaatcctctgagtcttttattccaaactcctgttctccggactatttctgttttgttttgtttttcctctgcgtgtctaactggtcttgaagctgggatactaagtgtgtcgcagtgggggggacatcgcgctgagcatctgtggccttgaggtgcctcttcatgcctttttgggcctgtttttgcatctgcataaaggggtccaatgcagtgcaatacagactctctttctgactttctgtgattctgagaagaaatggcagtgcttccattttctcagctaagtagggtaagaacaatcagaagctgcctacgtgagggtggagagtgcagacaccggagttcgccagcctggattcaagtcttgcctctgctccttcctccctgtgtggctctgagcagtttgctaaacctctctgtttcgtctttgtaaattgcagggtcaggggctggttcagagaaccccatgtggagttagttatgaagattaaatgaattaatacatgtaaacactcagcacatagtaagaactcagatgctacctgttttctttccctcccttttaaaagtcatgtgccacaagttaattttgctcagtttagggtgtgtggctatctttgcttgtgtagggtcctttctagctttgtttagtttttatccccattttctccaacttctctgctcctcccctacctccaagccgcttattctaatgtatttaacatgcatctttttgtttatgtgtttttagagacatgcactattgttttgtgtgcatgctttaaaaatttacataaataatacagtgtttgaatctcattctgtttctcacttttgtgcctctgctctgtttttgagatctgtccacattacttccagctgcttggtgcagccaccacattttacctattcacctccgagcattttaatcaacgcccagtatcccattgtaaggaactaccatagtttatataaccagtcccctttctgatgggtgttttggtgttcctagttttctggctattataactggagaaccagtgctgcttgtggtgtagggctgctggtgatgaattccttagcttgtgtacttctcatttgccttaactgtcccccctcaccccaaataaaactgcaatgaacatccttgtacatgtttccacatggacccctgggaggccttttttatgatgtgtacccaggtgtggaatttaggatagaatgaaatagagaatatttgaaagaagcaaaaggaatggaggctggtcttgaactcctgacctgaactgagtaagtcataaaatcactttgccaataaagaatttgactgcctgttgggcttgccttgaatcccatctaaggacctcttttggtttttcaatttttaacttgaaatgcatgagcgaatacatgttctttgaaaacaatacagatgacacagaaataagtggaatgaagaataagaatggaaaagaccccttgacattactttccattctcctaagccccatttccagtgtgtaagtcctggtgacagtggagtatatcaccctaggtctttttcttatacatttacagatacaactgggagccattcatactgttttacagcttagcttttctcacttaatagggtgttcgcaaggtcattctatgttagccccaataaatctgcctctgttttttttttttaatcaacactcagtatttcattgtaagcatctatcatagtttatgtaactagtcttctggtgggtattttgatattcccagttttctggctgttataaccggagaaccagtgcttcctatgtaggtctgctgctgatgaattccttttggttttgtacgtctttattttgcttttgtttttgaaagatatttttgctagctatagaattcgaggttgacagggttttttgtttgtttctttctttctttcagtactttaaagatgttgcttcactgtttcctggcttgtttctgatggaaagttggctgttattctttgttcctctgtgtgtaatgtcttcaaaatttttttcttactacttttaggattttctccttatctctcattttaagcagtttgattaatgatgtgtctgtttcttctgcttgggatttattgagcttctgggttcacaccaaactagaaaactttcggccattatttcttcaaatatctttctcttctccccttcttcacccctccttttttttttttttccaaggattccaattgcatgtatattaagccttttgaatctgtcccatagctcattgatgccctattttttccatcttttatttttctgtttcattgttaataattattgctgtcttcaagttcatcaatcttttcttctttaatatctaacctcttctttttttttttctaacctattcttaatactacccagtgtatttttttaatcccaggcattgtatttttcatctctagaagtttggtttgggtctttttatatctcctgtgtccctataaggtgattatgttttttttcctctaccttcctggacatatggagtatatttatgatggctgtttcaacatccataaagtctatcatatgtcatttttgtatctcttcctgttaatttttctgctgctttcatgcctagcaatttttgattctgaattttgattctgaattttacattcctgattgttttagtgctggcagttttggggtttaagtatttttgtgctgtgttttgctctgttattggtgaagtcttagctgtatttgtttcctttgactgctctaacaaattatcacacacttagttgcctaaaacaacacaaatttattgtcttgtaattctggagatcagaaatctgaaatgggcctcactggattaaaatcaaggtgtcagccgaggttctagaagccctaggggagaatctgtttccctttccaacctttagaggctacctacactctttggcccatggcttcttcatcttcaaagctagcaacattgggcagagttcttctcacgttgcccatctctctggctctctctcttctgcctccctcttccacttagaaggacccttgccttgagcccactccaaccatccagcataatctctctatctcaaagtcatctgattagcaagcttaattgcatctgcttgtagcctaacaccttcacagttctggggattaggacgcacatgtctttgttgggtacagggagggcattattctattattctgcctatcacagtcattaaattacttggaaaccgtttgattttttttttccaagactgcctcgctctgtcacccaggctggagtgcagtggcatagtcttggcttaccgtaacctctgcctcctggttcaagcgattcttgtgcctcagcctcctattggaggcacacgccctcacacctggctaattttttatttttagtagagatggggtttcaccatgttagccaggctggtcttgaactcctgactcaagtgatctgcctttgcctcccaaagtgcctgtttgatctttgaggcttgctattcagccttgttcagcaagaccagagcaaccttcagaatagagcagggtttggcaaactacaggccaaatatggggcaaatcaggcttgccttctgtttttgtaaataaaattttattggaacacagatatgctcatttttgtgtactgtccgtggctgcttccattccacaacaatccataaaacctaaaatatttattttgtgaccctttatagaaaagcctgtagaccaggagtctacagtcaaagtgaaatttctccactttggctattgggagtgtgaactgttcgtagccctggatgagctctgagaatggttctgcttggttctttctccagcctcaggtgctttccttatacacatgcgctgatcagcacttgggtgaagccgttgaagaattgcagctcattctccgcatgattctcttctctgattccctcccttgcatgtttcaccttccttgctcttcccaaagtctaaactcatacctcctcaacttcaggagacctctgagctctgcttggttttcccctccctgccctgcagcttgatcattctccaggcagcaagatgggacaatcgtaggacccaccttgtttgcttccctctcttagggtgttttgcccagtgttgcctgttatccagtgtctaaaaatcattgtttgatatatttcgatcagtttcttagttgtttaaggtgggtggtgaatctggtccttcttactccgtcatgactagaagccaccagtgcttcttgtatcagtattattttgcattgatgagagtagttttggaagatagcataccagaagaggcattgtggggtcatagactctgtgcatttcaaagatattaccaaattggcccttgtcaaggctgcgctgttttatatttctgagggtctcattctcttagcaggggttgtggggatagatgatgaatatgaaactgctttgagctccataaagtgctgggaagatgccagaggttatggctctgaagaaagggcttctcctggctgttcctcctttggcttagggtttctgatgggcatttcgctcttccatgctatagtcaggttgtagggtcgttttagtcactgccatcatgtaggactgttatttccttagcaagtgggggtggctggggaggaggcttcctttagactgctgctttctttcctgacatctactgaacctacaaatgccacataatgttccaagtgctccgtggagtcattgtgatgtaatttaattctgcaccacaagctagagagtttgagatgaaatggaaactgagagagctggtgtggtttgcttaaggttaagcagctaattcctagcaaagtgaggattctttctgcctttaaaccaaacctgccagtttatacaacaaaccatccattatagtcaggacgccttaggttttaagtgacagaaactcatctcaaacttgcttaatccaaaaggggacgtgtattggcatgcctactgaaaagtccaggggttagccaattttaggcatggctggcccacatatgcagatgatgtcatcggaaatgtgctcttctccatctctcagctcttgtttccttgtggtgacttcttcaggcaggccctctccaagtggtggcagaaatggctgtagcagcaccatgcttatttttcacccccagtggagtagtcctggaggaaagagagcatctcttttccaagggctttaacggaagtcccaaggaaggctctcattggcccaatgagggccataggctcatccctaagccgatcacagtgcgaggatggtgtgttgttattattggatggccctgggttatttgattctcttgttggagttgggggctggggatagcccattgacaccacttaggttgtggggacctgaagggatgagatagttctgtactgtaagatgggatgctgaggaggcagaaacaaaactgtccactgtatcccctttggcctctagagcaagctcacccactctggcccttgcagctccaattgttcatggtgttcacaggtctgcttggcccctgccctggtgagttttttcctcgcctggcttgacagtggcattctgccctcccacttgctggccgttcactgttctcttgccaccccgggcagggactttcccaggcaatgaggcttcctggatcttgttcccttttgctgaatccttatccaataatcagaaccaagaaacccaggcccagcaggctgaggacacctccacaccacctctttcatcatgagtaggcaagcgctttccagagggttgtccaggacccccccgcatgagaggcccctggggccacctgtagactggtgtttctgcatcgctgggaggtacagttgaatgtctaaccaactccccaggcaatgcttccacacggaaggttgagagccacagttagatgactgtcctcaaatgagctggggttttctttcaaggactctctttccttccgatggggttgtttgatttatcctgattttaggattcccctccttcccatgagagctgcccccttcagaatcatgggggtgtcactgtgagagcttgagtctgcagtgtgggatccctttctcaagaggtcagcatgattattttccatctagtgctttgtgggtctcaagacttaaattgggaggaatgttaaaaacaaggatgacgcacagtgtgcctgcatttccatgaaacagtgacacccagagcctcagcaggatggctcctgagaactgggaggctcgggcagtcaaaagaatcttcatgtcttgagcctttggcttgggaaagttcagtgactgatgtaacagcacatttcacttgttcgtaagttaagaccctaacatttatagagaaaaacatcatctttacccactacgagatttcaaaagcctttttagctaaagaactctttcataaatgcaatctcacacaggtgctcaggatgttaaatacatagataaaagcagtttaaaaaaatggaggagggaggaccatattatgacttttgtgggccttaggcacttttgtcttcgtgggctccttcctccatacaaaaatattaaaaattattttgtatgactgcattggtgtagacatgaatatattaatattctatgttatacatttttttttgacctgaaagttcatcttttaagttctgattttaaaaggaatgaaagcatttttgtgggtctctaaaagtttctcgggccctgggtgctgtgtctgatggggaagtcagccccgaggcagcaggttcctatctgcttggcccctctctggttggcccctcaggcagctggaggaacccagtttgaagaccgctgtgcagagttatctcttgccccttctcaggctctgcttctgcctcactggggagtgaggatcacagaatcacaagataccataataaggatggaatgtcaaggccattcataccccagccaccctcaccctccaagaaacaggtcttgcccttcaatctctgaagtgccattcttgctaaatgatcatctttcctgcctctgcttgggccccttctggggacggtgatttcatgactctgttttagtcctcctttttagtctcctatggggcttcagtaagttcctgggtcagtcgccatttataccccaaagccggtgaatcccttagtggccaagtcattgctgagctgggataggagccaggagtctggggttcgaggcgcagctctgcccctcggctgctgtgggacctgagcaaggacactctctctctctctgagcttgaggtgcctcatttggaaaaggaatgggttggagggaatggtcctgtcgcctgttgcagttgtatgcagtgatgctaatggaagatcgaggcatgtcccggcctgatacctgcagctcaggtcattctgggacttgtggctcttgcttggtggttgggggctagaggccttgtgtgtccctgtccccctgggtctgggtggagtatcgtgactgggactttgaccacagatgtggataaggaaggggaaaaatcaggtggcttcagaccatggctgcgctctgtatgtgctacgaggctgcagatggacttttcctgagatttgtttagggaaacttgggtctgtcagggctcagtgggcagctgtccagaaaccttggggtgtcatgtgatgcccactgaggtttggggagaggggaatgagggtggtgacttgctttcctccctgggacttgctagcccaagcttgaaggtgccaccgtctcagggcctgggcttgcttggggatgggtggtggctccacagggtggaaatgttcattcctttctcccgagtccagcgcctcctggcctctggtgcttgcatgcggatgctcccatgctgtatcccgctccccgatactcacagcctagccttttttgtttgtttttttttttttgagacagagtctcgctctgtcacccaggctggagtgcggtggcgcggtctcagctcactgcaacctctgcctcctgggttcaagtgattcttctgcctcagcctcccgagtagctgggattataggcgtgtgttactatgctcggctaatttttgtatttttaatagagatgggatttcaccatgttggtcaggctggtctcgaactcctgacctcaggatctgcccgccttggcctcctgaagtgctgggattacaggcatgagccagtgcggccagcctagcctatttttatgaactcaccactccccgcctggctgccccttatccctgctatactaaatggctctcctagatacaccttgattttccacctccccactttgctcatgctgtctctcctgctgaggcagttggtgccatggcctcccagaccacagaaagagagtagggtgcaggatgagtctccatttctggcctctaagtaggggagcctcctgaccagccagcttctaattccaggtctgtgtttgttcacctggttcctgctcttcactctgtaattattgattcctgccgagtccacttagctcgagccagctggggtggacctgcagcccagcatcagcttccggggcttagaagttcctggaaacagtgacttattattggcctaataacgagcgtgttcctgccagccaggtgtgttcaggtgtgcgcggctgctgtgaaggacgtcttcatgggcatgcatttattttcctttcgcttggatctggctcctcagggttgtttcctcttccaccattacatttttacttcagtaatttgtccaattatctaccagggacaatatcactttcctaaagtggttcatctgaaagcccttttctccatcctctctcctgtccttccttcacacctgtgctcagggcccgtcttcccgtcccagctgacaagaggctcagagcccagcctagcccatatctgaatgaattccaagttagcatggaactttctgctttttctttttttctttttttttttgagatggagtcttgctctgtcgactaggctggagtgcagtggcacaatctcagctcattgcagcctctgcctcccaggtccaagtgattctcctgcctcagccccctgagtagctgggattacaggtgcctgccactatgcctggctaattttttttgtatttttagtagagatggaggttcaccatgttggccaggctggtcttgaattcctgacctcaagtgatccgcctgccttggccttccaaagtgctgggatcacaggagtgagccaccgcgcccggcctgaaactttctgctttctaagcactgtcttaaaacacaattaaaccaagtttgtttttctttgttataacaaatagcaagtgctctttatagaaaaagaaaacacagaaaagtatgaggaagaaagaaaatcacctagagatccctactcagatgttgacacttttgacattttgagcttttttccaagtattgtttttgttttgtttttttgagatggagtttcactctagtcacccaggctagagtacaatggtgcaatctcggctcactgcaacctctgcctcccaggttcaaacgattctcctgtcttagcctcccgagtagctgggattacaggcacctgccacgatgcccagctgattattgtatttttagtagagacggggtttcaccgtgttatctaggatggtctcgagctcctgacctcaggtgatccgcccgccttggcctcccaacgtgctgggatcataggcgtgagccaccgtgcctggccggtattgttttttctttactaataggtgggatggatacaaattctctcctgatttttttaaaaaagctcaacattataagattcctgtttcccagtgttattgcaagccttgagggttttgactgcgggtattccatgaggtggctgtaccctcgacagcccaacagtggcctgttttgggggatgttttgctatttacaggttttccttattgtaaatattgctgaaaagaatatcttgtaagtgaattcattttcatgttttagattgtttctcagacttttcaatctagaaggagtcttgttgatcacccagaccacttctttagtgttagcttgtcctagaacgcgaaggagggcctgaaacacagattgctgggccccacccccagagattctgattcagcaggtgtgggcggggcctgagagtcttcatttctaataagctctcagctggtgctgatactgccaccgaccacactttgtgtggcaggagccagcctctgcttcaagggaagttgaggctaaggagattggaggaatggtgaggagtggccatttcccagccagaccagtgagtggctcccatgctggggcactgatcccactcttgctgcccctgtcccctgagaacatacaggagaaggcagcattcatctacacaaagggatctcctccatttaaatttgattaggatgggattaggatgggatttcagcaactcaggcctggcagatgcaggcagcagacgtgtgcttagtgctgggatatgggtggggccagggtaagagccagtttaggaaagaaactgtcagagaatatggtgaatcattttaaatgtgagtgagtgacagtctttctaggatgcaaggggttaagcaggcagcaggcacagcctccccggagccaaagggggaactcaggagtaagtcgggactgcctaattaattcaattaaactattttataagctctgctggtgtcagtaaattgttaaagtctattaaaaaatcagtggaacgtgatgagggttggggatgccacatcaccttcctagagttcctcccctcgtcttcctcccctgtcgtgggatgcaccaaaggagggatgggaaggtgtcagaggccctgtctggtgctgccactgacctctgtgggtgccaagacagatcccaccccccttggcctcattttccccatctgtacagttaagtgatggaccagcgctttaacatccctttagcaacagttacgaggattttctgatctcttctggcctgggctgttttgtaccagggaaccttgggccttcaagaaaaccctccaaggtcagaggcggctgttactccagacattctgcttggtctctgctcttccttcacagcaagttcatctggacagtttccaggggcagctgtcagggcaagtgatctataagggaggttcaaactctggaaacgggagagtgagcagagtggatttcaccaggaaccgctgccacgtgtaagagctgctttctctaacgcctgtgctgagtgaagggaagctgcccctagaatctcactcagtgcccacctgcccacacgcagggaggtggtattccccccttttacagatgaggatactgaggctcacagggttgaagcgatctcagtgttaactggtaagtggtagagttgagatttgaattcaggattgctgtccctcaaagtctgtgcggttgaccgccttcttctgcagatagatttaacataaagctacatccccctgacaaaccctgcaatgtgcagcattggagtcacgggaaagaaaacactagcaatgttctttagccagtatccagttgtgaggaacctgcaggagggggcgacagccctacccttggaggtatgaaagcagttgctggctgaccactaaggcaggcctcttagagccaagatcctgcagctctgggcccagctgttgcttcatacttttcagcagtttatgccaggcttgggaacttggcagatatcactccttggttcttgaacactgcagtcagtgtctatctttggtcagatcttgtttggctaaaccagtagggcaggcagcaatggtcttgagggagggagggtgggtgctgtggaaagactgttgtcttgggtttgagggtagacttaatgagctgtggatctttggcaagtccctttctctcctaatcttagaagttgaggcttgttgcccttacttctgaaatgtggctcaggctgtatgctccacggggacatgggagaggaaggtggaggtgaattgagggctagataaacctgtgaatggaacacactgtgtcttagaaattcacagtggccattgggtctttaaaggctctgaaaagtcctgcagcaaagaaaatagatgaattttgtttattcagcctcccccaacctggaccaccctttccccctctaagcacactttttatttaacatgctgctggctaatataaggagacatgaacactgagttattaccccaggagagagctgctttttaaggcggttgctcccccggttctttctgtgatgagaacaccctttctgtaaatgggataaattggcccttagcaaggtagtgtctaagtcttctaagtcgggtttccttaaaccaaagtccatgtttgttccaggatcccagaggcctgccaaattccaagagcctcttttggttccctctggcagccaggccttcaagacgcaggatataggcaccttggggctctcctcacgtgcgcttctctgtagagccattaatctcagagccactaagcactgaagcagaagaacccattgggtgggactttaaagttgcctcagtgtatgcaacaaaatcccaatcattcggagttgccggtttatgattttgtaaactgcagttgacctttccaaaagatttgctagggaaaatgctagtgtaaagaagatcttcaggggaagagctctaaggtgtgtaaggaatcattctatttttaagccttttgaatgctcccattggaatataaacactatgctaattataaaaacatcttttctgttccaaacgggtgtaacaagatagagagggctgggtaggggaagggaggagtgtttaaacagaggttgaaccagagatcaaacaccatctggccacaatagttgctcatctttaaaaattctgatgtcccacctgttttgacaacttggatgtaacagtcagtaggagcgagcttgactggccccctcatcttcccagcactggcctccaacctgactggctcatgaaacttacctgcatagcccctgatcctttgaaatttgcacccctgtctaagaacagttttctctaatattttaagggcacagttagcataaaattgctcattttctcttcatttaactatagagggaaaatcttctaccttacttagcaaaactttcaaagataaacagttttagcagcaactgaccattattgagcacctactatgcatcaggctttgtgcaaggcgctggagtttggcctccatgtagcttgctgcctgctatggtcggcatcactgagtgcatctgaggttgctttctagccaccagccaggtgtcactcaaagcttctgccctgcctgtcgtatggtggacctcagcagaagattctgaaatagtggaagtggttcttgctgttgacatccgctactgtcaaagatgagatgaaggactagatgagcccctgagaagtcaggccgttggttccctttgagctttgtggatgccaaggtgaaggggtggaggaactggggggagactggtggcttgaggagggtcagggacaccagctggaggaggtgtgcaggcttgtgggtagttaatgctgagattggtaaaggggaaagataaagccatccgagactctaaggaaaaggtagaaagattctaattagccaaggctttgtatgcaaatggcatttcaagatgcttaaaaataccttttgagggaagctgaaaatattaggtggtctacttgagcagggagtatttggggagtggtgggacataaaaggtgtgtgtggggtttctgggggaaggaggaaaggagggagggatagagagaggtagatggatggacagatagacagacagacagatactagctattcttgtggacgaccctgtaaaccaggtagagaattttgctaaccaaggaaatgaataatccccatgagggcacagcctgtgtttgctttattcattactatgtcctctgttcccagcaagggctagacatagtagatgcttattaaatattcgttgagtgaatgaataatgataattatagtatttatcacatttatctttatggcagcagctatataaggagatagtattatctctttgtgctgacaaaggtgggccattctgagacatgcgcgtgtgtctgtgtgtgtgtgtgtgtgtgtgtctgtgtgactgtgtgtgtgtattgcagtgttggagagaagggcaggaacacccgaaagctttttttgcaacagctctgtgaaatattgatcaatttgattccattgtatgacccagggacaattttactagcagaaaatatgaccgtgttatatggctgcaataaaaaatcacagccatgagctcaggcccagaaaacgaaacaagctgatgatgtagcctggaccggtggattccgcatctttctgctagagttcatttgctgtttgtgccttcgtggtcctgatgataaggttacaggtctcagccaaaaacttaagaagagcctaaaactgatttcagtttgacccctcataagcttctcttgcagttaggaaatgcccactgttgttctgttgtagaggtaagtgtaccagtctaggttgggagctgtcccgtggaaagggaagggcactgaaggttttgaagcagagacatgattgatcaatgagtatcatggcacttaaccgtggagagttaagaatcatgcaggtggcagttaccctggtgtgagcgtgcctagaagatgagaactgatgagcttttggtccctctcagaatgagaacatgtcacccacctaactgtgattctcgtgttgcaaggtgtgtatccttcacccaacatggtcccttaacacatcttcgtctggtgctcaatcagaaaaacattgctctgtcccaattctggaggacaaactggttattgggcttctagaaaactgggaagacagtctccagcaatggtaccttcttaagagattgttcaagtgaaatttaaactttatttactggctcgaggactgaatctttcctaagatgctactctgccaagcctttgggcggctaatctggcatcttgttcagaaggaagaggggcatggagagggtggaatggggtggccagctcccaccaaggcaggaatggagctgagatattgccacagttcagtctgactttgttttttctctgtcacaccagacattgcagcctcagggcctttgcacttgctgtttccttgcccagaatgctcttttctagttattttctgggctcgtccctctggatatatccttctttgcctagcaagccttctctctatcctttttttttttttttttttttttttgtgagataggggtctggctttgtcacccaggctgcagtgcagtggctaagtctccactcattgtactcactacctcccgggctcaactgatcctcctacctcagcctcccgtgtagggagggactacaggcgtgtgccaccacactcgtctatttttttttttttaaatcttttgtagaggcgggattttgccatgttggccaggctggtcttgaactcctaggctcaagcaatccacctgtcccggcctcctaaagtgctggggttataggcgtgagccaccgtgtctggcaagccttctcttaagtactgtttaaaattataccatctccccattccatcctcctttttggcttcatttttcttcatagtactggtaatcatctaatggttattttactgtttaaaaaacaatttgtatatacttcctctctatcttcccacctctctttcccaataaggtaagttttgtgagggaagggcttaacacattttttaaaaaactttgatttcgaaagatttcagactcataaaaacctctagaaatactaagagtttccatacactttcacctagcttcctcaaatgttaacttctatgcccatagtataatgctcagattatactatgaaattaatatttacacaagaaattggattaatataatactgttaactaacctgtagacctattcacatttcaccaatggccccattaatggtcttttttctggcctaggagccgatccgggatcccacattgcacttagttgtcttacctctttagtcttcagcagtcaggggcagatccttggtcagtctttgaattctgtgcccttgagtcctttaaagagtccccaccggttgttttatagaatgctcctcctggatttgtgagacatttgtaggatgacggagggtatgcatttccggcaagaataccccagaagtgatgctgttttcttctcactgtatgacatcggggacctagggtattgatgacttactactggtgatgttagtgttgaacacttagttaaggtggtgtctgccaggttccttctctgtaaagttactcttttattctttgcattaataagtgttttgtgtggcgatattttgagactatgcaaatatctcatttttcatcatgcttttctatccactaattttagcatctattgttgcttcttgcctacaacagtgataactgtggtgtttgccaaatagtgatttcctatttccatcatttcttctgtatttattaattggaattgtactgtagaaagatctctcctttctcctccatttatttatttatttacctgcttatttagatcaatttagactgctggatgtctattttatgggttataatcaattaccatcattatttttttttctgatgctcaaatcattccagatttggccagtggcagccccttcacgcaagctcctctgtcctttgaacaagtccctgtcattctttgagcatttcttactttctgagtcttcaggatgtaccaggctcatcttgcaccccggccctggaatcagcccttaccccatggcacagagcaaaggtttttgtctgtatcactcactgttgtattcttagtgcccatggtgtctggcacgttgtggagtcacagtaaataaatttggtgtgaatgaacgaatgaaaactggaaaggaagactcagtggccaccttccagaggccataattcatatcctcactagcctcccctagttagtctgaattagcagtttaggaggggaggggctttccctcatctcctcacgttttgtccctttcagcttgttttcagttttatccagtctgaaaaggatcccagggcatcccccatctcgtagagcagaaagagccaagagtgtgagcagccaaggggagcaggctggcaggaaagtgagacagggctggcagagcctggacctgcttgtggctaatgacttggttgaacagcagccgcggcagggagagatgctctggtggctgatggcagaggtcctgggacccccactggtgtgtctgtagctgggggctgctgagagcctcttgcagtctcccgagatgcacaggcctcgcttgaatatttaatgaatttttctttataaaagattaaaactcagccacattggctttgagaaagcctgtgataatcagatttttatttatgagttgaattgtatgtgtgtgtgcatccctgaggaggaaaactggctggcgggcttgccatccgtgctggcaggctgttatgccaggagcgaacttggcgagtggtagccttttcatagtcaggagaggcctggcaggcccctgggccggctgctgctggtgtcctccaacggcggggccagccctctccgtgaggaggtggaactgtccccatgccaccttgattccacggtttggatttgcagagcagacagactcctgtgttcttgctgattctacacagtggtcctgggaagtgggccaggcaaggagggttgcctctagtttgcagatggagaaactgaggtccaaaaaagggaagtgactggctcttcgtagtctaatgagtctggaagtcatgaacattgtaaaagtatcacagtcaactgcagagctgatgcacagccttcgcgtcaccccaggctcaccttcttatgccatcctcgtgggtggggatgctgaaggctgcagccagggtctggtccagcctgggctacacaggggcctgacacctggttggacctttgaacctggggagcaccagggccctggcctgaatgtcagggcctctatagctcctgggtccagagtggggaatcactgttggaagagatcccaggtatcccaagttcattctcccttgggcctttgtactcccaagttcctgacaggcctcattcagccagttgccatggcgatgcagaagtcacctgcttgatctctgacacttttgtttcaagtgaggctattggcgtggagccctttaggggctaggagaccccttaatggtgatttatggtggggaggagcctgcggggtgcagtccatgtagtgtgctgtagtgcttgggagaaggtactgtaacacagaagtagatcttgattttttacttattttcagagtcacaattttttttttttttttgagatagtctcactctgttgcccagactggagttcagtggtgtgatctcggttcattggaacttccaccttctaggttcaagcgattgtcctgcctcggcctcccacgtagctgggattacaggcgcccgccaccatgcctggctaatttttttatttttagtagagacagggtttcaccatgttggccagattggtctcaaactcctgacctcagctgatctgcctgccttggcctcccaaagtgttgagattacaggcatgagccactgtgcgaggccaagagtcgcaatttttaatgagtttacatcataaggtggtggtaaggattaaatgaaagaatggatatgaagtggcaagcacagtacctagcacatgggaagagccacatcaatgacagtttgtgatagtatcaataggatttagcattggagatttgtgcagtttgccatgtggctagttgtagttttgctaagccatacatttgtgtcccacctagctgagggtgacagtgctacctgggtagcccatttcacaagtggaagtcagttgtgtggtgtgtttcccttgctagcatgcacgctccatcaggttaggggcaatggctgacctattggtggctccagctcagcatgtgtctcttagaacctgacacagatcagatgttgaatacctttgctattttaaaaagttacttgagcatatgtattcatttatcttgcagctttggcatccattagaccaaggctggaatcctgggtcctgtgtctcccacctaatacctgggtgttcctaggcaaattatctcgcctttctggtccgtttccccatctgtaaaatcaggccagtgttatgcacctagattctgctctggacttcagagagaatgagtgcaaagcacacaggcaagcctgtcccagggtagcatttgttggggactgcctgtatgatgtctggtttcactgagtggaagggttttcatgaggtcagagattcagagttgatttagccatccacatgttaggctgagggtgttctctctttagccagtcccttgaaaggcttcttcatggttatggcccagcagagaatccagtctggttttccagagtctcgaaacacccacatctgaagatgaaaccccggaggcaaacagagttaggagtcactgagcttggaactgaccagctgggaatgtgctgtggtcttccttgagaagatggggaaacagaacatgatctggaaagaaggaagaaggaacagcttctgttcttctcaggggaaatgggactttctgaacttcatcattctgaagtgtcccacagatcaaatcctttttttgactactccttacataaaatatttttatgacaaagctttctacaaagcaaaagatgccttctataaagtgaatcatcacttcggatgcttcctttgtataaacctggcctttcttatgttgtagggagggtttttttttcctgttatttgtattatccaaagcaatacatgttcgctgttgaacagttaggaagttccaatgagcaaaaaggaataaaaaaatcaaaatcacccataactttcccatgcagagataatcactttggatgttgatttttgatgtatcgatactttgatgtatgtactgaaaacacatatgacatgtacataacttaaaagcttgttcattcaagaagtatttattgaactcctactctgtgtgtgatcctggggataaaccagggaacaaaaaataaacacaatttctccaggggacaatttatgcagataaaaggaagagaagaaattggaacagaaatgggactgaggaaaggcctgaaactgatagtgaaagtcgtcatgggctctgagagttttgatctcactgtggagtggttaggtatgaaatggagggctggacggggcagagggaagataagttggcagctgcccagagggccaataccttctatccaaagaaagtggttgtggttggtgtcctaagttatgtacactggcagacaggggcaggccggagagggttttgttttggtttgtttttttttttttttttttgcatgcggatgcccagttccagcaacatttgttgaaaagagtatccttactcctttgaattacctttgtgcctttgtcaaatatcagttgactatattagtttgggtatatttttgggctttctattctgcttattctgtctgttctgtttattgtgatctacttgtttattctttcaccaacactacactgtcttgtttactgtacctttatagtaagtctcgaagctgggtagtgtcaatcctccaactttattgttgttctttgggattgtattggctattctgggtcttttgcctttcagtatatacactttagaatcagtttgttgatatgcacagaacaacttctggacttgtgattgggattgtatcaaatctttagataaagttggaaagaaatgaaatcttaacaatacggagtcttccctccatgaacatggaatatctctttatttatttagatcttctttgatttttttcatcagagttttgtagttttccgtggatatcctgtacatgttttgttaagtatttatacctacgtttttatttttttggcactaataaaaatggcattgtgtttttaatttcagatcccagttcttcattgctgggatatgtgaaagcaattgactctagtatcctgcaagcttcctataatcacttattagttccagtttttaaaatggattatttgggattttctatatggacaatcatattatctgtgaataaagaaattttttttgttttgttttgtttttacaatctgtataccttttatttccttttcttgtcttactgcattagctacgacttccactatgacattgaataggaattatgagagaggacatctttgccttgttcccgatcttagggggaagacatttagtttctctccgttaaatatgatgttagctgtaggttttttgtagatgttcttgatcaagttgaggaagttaccctcttttcctagcttgctaagagtttttattatgaatgagtgtcaaatcttgttaaatgcacatctatgatatgatcctgtgactattcttttttagcctgttgatgtgatgggttacactattgattttcaagtggtaaaccagtcttgaactctaagaataaatcccatttggtcagggcatacactttttaaaacatttttaggttcaattttgtactattttgttgatcatttatccacctttgttcagaagagacattggtctgtagttttccttttttgtaatgtctttatctggttttggtacagattgagtatcccttatctgaaatgcctgggacctgaagtattttggatttcagacttcttttcagattttggaatatttgcattatatttactgattgggcacccttaatccaaaaatccaaaatttgaaatgcttcagtgagcatttcctttgagtatcatcttggcagtcaacaagtttcagattttggagcactttggatttaagatgtttggattagggatgctaaacttgcattagagtaatgttagtgtcgtagaatgagttaggaagttttctctctgcttctacttcatggaagagattgtagagaattggtatcattttgtccttaagggtttggtacaattcaccacttggacttagggctttcttttttgaaagtttattaattatggattcagtttcctttatattaatagatacaggcatttttagatgatatgtttctccttatctgagttttggtagcctgtgtctttcaaggaattggtccattttatctaaattaccaaatttgtgggcaaggagttgtatataacattcctttgatcatccttttaatgtccatgagatcagtagtgatgaccccgttcgatttctgatgttagtaatttgtgtcttcttcttcttcttcttcttcttctttttttttttttttggtcttggttagcctggctagaggcttatcaattttattgatcttttcaaataatgagccattagtttcattaattttctctactcatttcctgttttaaatttcattgatttctgctctaatttttatgatttcttctgcttgcctttggtttatattgttcttctttctctagttttctaaggtagatgctcagattattgattttatattgcattcagtgctataaaatttcctctaatcactgcacttgctgcttcccataaatgttgataattgtattttcattttcgcttagttcataatagtttttaatttctcttgagatttctgcattgacctgtgtgttatttagaagtgtgttatttagtctccaaatattttggaattttctggcagtctttctcttattgatttctggtttaattccattgtgatcttagagcagattttgtgtggtttctgttcttttaatctcgttagggtgctcttttgggcctaaaatgtgactatcttggtgaatgttctgtgtgtccttgagaagaatgtgtattgtggtgttgttggatgcaataccctataataatgtcaattagatccagttgattgatgatgttgtttaatttaactagatactgattttctacttgctggatctgtcagttgttgctagaggatattgatggtggatttgtctatttctccttgcagttctgtttttgcttcacatattttgtttctgtgttaggtacatacacattaaagattcttatgtcttcttggagaattgacccctttatcattatgtaatgcccctctttatccctgataattttccttgctctgacttctgctttgtctgaaattaatatagctactctaggtttttttaattagtcttagtatggtatatctttctccaaacctttacttttaatccaaatatatctgcatttttatatttaaagtgagtttcttatagacagcatgtagttagttgggtctttttttttttttcaatcctttctgatgatctctgtctttttattggcatttagaccattcacatttaaagtgattgatatggtatattaatattaccacatttataattgttttctatttgttgcccttgttctttgtttcttcttttgtcttccattctttttctcccttctctgcagcattttatatgattctattttcttccctttcaacatatcaattattttttaaaaatagtgattttccttagagtgtgcagtatacatgtacagttaatctgagtccactttcaagtaacactttgacgcttcatggttagtgccacatatcttataacagagtagtcccaattcttccctcccttcccttataacattgctgtcattcatttcatttatccacatggtataatcatccagtatcctgttggtgttactattttgaacaaactgttatctgttaggtaagaatgagaaaaataaaagattttattttactcttatttattccttctttaacactgtccttctctttctgtttgtttgagtttctgacccaaattacttaccttctctctgaagaacttttaaaaatatttcctgcaaggcagatcttctggcaacaaattccctcaaattttgttttttgttatttctccttcatgttggtaggataatttcactggatcagatttctaggttggtgttgttttttttttttttcttttaggactttcagtatttcacctatcttcttgcttgcatgatttctggagagaaatccaatgtaattcttatccttattcttcttataagtaaggttttttggaccccttttgcaaaaatatttcaatattttctttttgtcttttattttctgcaatttgagtatgatacgctgggatacagtttttttggtttttgttctgcttggtgctctctgagcttcctggatctgtggttttgtgtctgtcattaattttggaaaattctcagccattgctacttcaaatatttcttctgttttttctttcttttctttctggtattaccattacatttatgctataccttttgtagttatctcacagtttttggatatttggctctattttttacactcttttttctctgttttttctatttatgaaatttctgtttttagcaatttcttttgattctctcttagtttccatctctctgcttatattatcagcagttcttgcatgttgtccaccttttccattagagcactttgtgtattttttactggtattttaaattcccaaatctgcactgtagctcatgcttgtaatcccagcattttggaaggccaagatgggtggatcgcttgagctcaagagttcaagaccagcctgtgcaacatggtgaaaccctgtctttacaaaaaatacaaaaattagctgagtatggtggcatgtgcctatagtctcagctactcaggaggctgaggtgggaggatcacttgagcctgggaggcagatgttacaatgagctgagatcgcacccctgcactccagcctgggcaacagaatgagaccctgtctcaaaaataaataaataaaaagtaaataaattcccaagtctatgtcatatccgagtctggttctgatgcctcttactgtagctgttcagttttttgccttttaacatgccttataattttttgttgaaagctggacatgttgtatctagtagtaggtacagaggtaatcagcattttaatgtgaggtttaaagccttgcatgatgtattaggtaaaaggaactgaggtaaataggcctttagtgtgaggttttatgtttatcaggctaggaattaggctgtgtttacaatttattgtagctgtcagtgtcagaggctaaaatttcctctctggtccttgtttttgtctcacctgttgtctttgggtttctttagagattccttaaatagtgaccaatccttgtagttctttcagctgtgatcccattagcatacaggagtcctgttgatgtggtgctaaggactgggcgaggggtagtgttctagaatcctctcattggttctcagtcttttagtgggcctgtgcccctgtgtcgtgacctttacatgtgcttgtgaaatttttctttaaccccttaggtgagacaggaaggctagaggagtctggagttggatattttcctttcccttgtgttgaaaactagaggggttggagaaggacatttcccttcccccatatcaatcagaccctggtaaaacccactttggttagaccctagtaaatagtttcccttgagggcaggcttttgttgaatagaacagtatgttctgcaggtatttcaaaatgttactttgtccctaccccaccatgaggagatttttcttccatcttaactctgagaagctggtgaagctcatggaagttttcgtctttcaagcgagttcatcagcttgtcttaagttgcaattctctttatttgctgtctctccacttttaggggcagtggtttgctctgtgacctcagttctctgatggatctaaaaagttgtttagtttcagtttgttaaggtttttttcttgttacgaggcatggagtgacagcctccaagctctttacatgttggaatggaaaccagaagtttgtatcatctctttttgaaaatctctttgtacttcagtttggatagttcctattgaactcttccaatgcagtgatttttgttttttatcagctatatccagctactgatgagctcattaaaggcattctccatttctgttgctgtgtatctgatttcttgtgttttcgtttcattctttcctatagtttccatctctttgcttatgttaaccatctgtttttggatgttgtctaatttttccattagaaccctaaacatattaatcgtagttatttacaattgcttatctgacagttccaaagtctgtgtcatatctaagccagttctgatgtctgctgtctctcttcaggttgtgtttctttccttgccttttagaataccatgtaatttttttgttgaaagccagacctgacgtatctattaatagaaacagaggtcatgaggatattagtgtgaagttttatgtttatgtggctaggaactgttctgtgtttaatgttcgctgtagctggagatgccagaagcttcaatttcctcttttctttgttttttgttttctctcccttttcctgttgtctttagatttccctagaaactccttcttaaatagaatctgtgtcttgcagctgtctcatttgtaatccactcttattatattggagtctttttgatgtggttaagtattagggagaggaagtagtctatactctcatgattcaatctcaattattattattttttaagtgggcctgcatccctgggctgtgatcttcagaaaaatttcatagccttttcttctccctttatgtgagataggaaggctcgacaggctggagttgtccagttgtccttcccttaggtcagataagtctgtggtaaggtagattctttcaagggcaggcctttgctctggagaacagcacactctatgctatttcagaatgatcacttttcccctggtgtattttaaatggttattttccacccccaactccacattcatctcactgaaggacaatgggattattgtctaatctccaccatgagaacctgttcaagctcctggagttaaaatctatgaaaatgtgatgactcccctaagactggaccccagattttaactctcaagctagtgcatactcagcttctagcagctaagtcagttactgtttaaacgttcctaccagttaccagccccagccactgcagctcctggtaagctgtatttctctgcagttgactgtctctgcagatttcagggtggtttgctctgtggcctcaatcctctgatatatctaagaaaacttgttgattttcagtttttgcagcttttttcttgttgtaaggatgggagtgatgacttccaagctctgtacatatcagggctgaaattgaaagtcctcacctggtaggtgttgatgttctcctatttcaaaactctgctggaggctgtggcacccttaaattagctgggagacagggatacagtaagggctgtggtttgcttagtatccctgcctcttgtcagggacaaatgttgggtggaccaagctgggctgggaatcctgaattcaggtctgaaatgtgctctctgggcctcagttttcccagctttatagtggggataaggccaaagctcttccagtactctatgctttagtgacaataacataacctttagttcacttgttacccgagataaggaaatggttttggaatgagttggtgtttcatggcagtacttcccgatgccagctttgtctttattgttgctttaaataacaaaatggctttctaataagaagagtggaaatagcagtcatcacatgacattgtatgaataaccagtaactcagagcttgtttatcttggctttttcccccatgatgaatgtgtttttaaaagcatttcctctgataacagccttggcctatagggctttcacgtgttctgggaggagtggagtggtcctaggttgtgataaaccaatggccctcattcattcctccttgtttgcaaaggagacctagtgttacacgttgtctgtaggttctgaagccaaaacatggggaaattgcctcgcttctggaatttcccccaagttttttggggaaactgaaatgtatgtcaaggttaccttttactcattttcttagatgttacttaagtcatttaggggcaggaaaagcgttgcacatgctttgtttgctcataaaactttcatgttgggtttatacatttaaaactagttagtttaaatcatagtcccagttctactacttgaattcccttaaaaatgtttagttgtagatatgcattgagcttcatgatgggaaacttcataggtttagggggcgcctatttttttttaaacttgttcaaaaaaagcaggcttgtccttgaatggataagaaattattgccattttaggcaaacaaactcagaggtgtaatttctatttttaaggctgtttcccagcatgtggcctggtgccccgtgaagatgaagtgctcattaatgtttgttgaatgaagtagtcagtgcagtaacgtactcacatttctgtcctttaaagtttgacaagaaggtgcctagaagcgaaggaggctctgattccttgccttcctcgctcagcagtggtctttcttttgaatcaatggcattgctgctgggggcaacagtggtagctgttggtgcctctggtgttggtattgaactgtcacttttctgggctcaggactgtgatgatccaacaggatcagtttttcacataaaactatttctcttttctggattttagccttattcgggggcagcaaaggaagtaaaggccaataagcacctgacaatatttttacattaaattgtgtgataattactcccccttcattagaatactgggggaaatactgaaatttacttggagttttacttttttaggatagaattcagggagaatagttagatatagaagaaataggaaagactggacacaggaatacaccattcactgtttttctggatggtatgttgagtaagggcagagaggtgctgtggagtgggcagaagtggggagtgaatgatggcctgattgccaaggagccaccttctgtcactaattcagtgataagcatggaacacctgctgtgtactcagcatagaggcatgaggtggtccctgccctgagcacactcgtgtcggggagatggcagtttaggagcgtggggcaggagtgttgaagattgagtaggaggtcttcagatgaataggacaggagcctttgaggcagaagggacagcatgtgccccaggctcaaagtcagggagtggagggcacagagatttgaagttgtgttggataccaggggcgtgttgagagatgaggcttgcgactccagatgggcaggtttaatgcttggctgggttggaatttcatcttgggagtgatgaagtgtcaggggaaggtttaggtgtgggaaggaccagatcaggctcacgttttagatttgggctgatacagtagccacaagccacatggggctgttgagcccttgaaacttggctagtccaaatcgagatgtgctgtaagtgtaaaatacgtaccacattccgaagacttagtatgaaagattgtaaaacatcactaataattatttcagtattgataggttgaaataacattttgatacatcggtttaaaaaatacaatagtaaaattaatttcactgtttctttttacttttttaaatgtgtctactagaagatttaacattgcatatgtggctcatattttattcctgttggacaatgctgttctctactccttgggctgagggaaggctgtatagtgtagtgattgattcattcatttgtgaattcatttattcaacatgtatttatagatcgtctgctgtgggctggggcctgttgtgggcattgggaatatagcagtgaataagataagactcctgccctgacaactaaatgatgaatggaattcagatactgttaagtgctgcgaagaaaaaggaaacggatttgggatagacaggggcaggtaatggagtggagggctatttgagtttgggagtcaggaaagacctctctgataaacagaggcgtgcatgaaatgaggaagcaaaccttgcaattggtggggaacagcattctaggtgagggaacagtgagtgcaaaggttggaatgagcagtagaaaggccacagtggctagatggagatgagggggtgcggctggttaggcaggggtagccaggtcacggagggtcatggaggccactgggaaggggttggaggattttataaggttttgagcagaggtgttgacaggatccaatttacattttaagaggatcccctggctgctatgagggaaagaatggaaattagaagactggttgggaaacttagagggagcccaggtgaaatgtgatgctggtttggaagagaggacagtagagaggtggtggagagagagtgaggagaggctacgttgaatgaatgtcgatgtcagaccagcaggacttcctggcttccttggatgtggagcatgaaggaattgaggctaaccccagtctaggtattggcctgagcgctgggtgattgggagcaccattgctagatggggtgagactctgaggaccaggtatagggggagtggggtggaggtgtggaatgggagccattaggtgaattttaagatgcctctgaggtgccccagtgctgatgttatgtaagctgttggatgtaagtctggagcgcaggcgagcagtggtcagggctgaatattaaattgctggatcatctgcatatagatggcatttaatagtgagacttgacagctcacctagggaataagcctcagactcggggagaggaggaggaaccggtcaatggaccaaggagcaaccagcgaggtgggaagatgccagaggggtcttcaaagccaggaagaaaggagagatcaagcatgtcagctaagatgagatctgaggaatgtccactgggtttggcagcactgggcactggtgactttgggaagatgacttcagtggagtcctgttggggcagagctggctaatttgagaggaatggaatcaacagaatgggaactgaggtagagccagtcagcgtaggtgcattttgagtttgctctaaagaggaacagagttaggggcatgttccctagtgctgacatcacagtctgttgctatgctgtggaaagcctctggtcgggaagggaaaactgatgttgcaggagagcagggaaattgccagctcagtgacctcgggtccaagccaagagaaagaagtacaattccactggggcagcacgcaggaagagtgactttagagtgcattagatctggtggtggggagatgagtagttttctcctgattgcttctattttctcagggaaagtagctgttagtggagagcaggttgtttgaggtttgaggagagaggcgaaagtctcaaatgcccatctaggatcatgaattgaggagggaaattgttgggctgtactaagggcccactggaggtttgtggtcacacatttaaagtcagacaatccacatggttttgtgtgttcttccagtgtggggtaggcaaggagttgacttggggttttgccagagaataaaaggagagagaggtctaaagatggaaagattaggcaaaggggcaatcattgtgatgggcttggtcttggctggggagggatagcagtgggggaggggcatggcagggcaagggtgacagggtggtggattgcagctcctgtgggggccaggattggtggaagggtctgggagtcaggagacaggatgcttgaaattgagatcatggcatggtggtgtcattgctaaggacaaggtctagggtgttacctgggagcaggggttgagctggtgggctggggacaggggagagaaaggggactgaaagaaaggagatccaagaactgattgatcagagtcagatgagttgttagtatagccaaaattgaagacagaagtaatggcggcaggaaagtcagtgagccaggggcccaactcacgggcacacggtgtctagatgatgccactaggctggtgggaggggttgtctggtggagggtgtgctgggcttgatggacttagacttcaggctgctgctgtttggaaggaagttagagggtccatgctgtagagatggcaaggagtggtgagggggatactcaccctctggggtgccccaggcccagcctcaggtctgccacccactggttgatcttgggcaggtgactcttcctcatctgcagagtgtagatgacaattacacgaacctcctctgtggattgtgaggagtaaatggacaaaacacatggaacgcgctgaagcccgtgttcggtttatggaaagcaccacagactggtcgctcttttcaccaaagcacatctgtccttacatggggaagattcatttctagagagagatttgcaaatgtgttccccaaaatgggattgttggagtgagaatatagcctcccaagggcactttgagagaaatgtacccggttggttatgagcattctggcctgttggttaagcattggtctttaggcacatcgtgaagaaacagctaatgatacaaactggattaaattaattccggaactctgtgtgactcgaggcagacgtgtggagtcagggaaggccttgggcgtgaggatgtgcctggccgtggcccgagcatggagaggctggggaccgccagagtatcctatttgtacagcctttatgctttctaagctcatttgctacagcaactccatgaaggagccgtgcaggatgaggaggggcgtggggctcagcatggttaggtcatgcccagggtccctcacaagcctggctgtccccaggtgcaagcccaaggggcataagacccagggcctgatttaatgcagggccacaaggctggtcaggggtgagagggacctcagtggcctggctgaagcccctgggctggcatggggctgccgacgagggtcccctaacctggcaggaagctgctttatggcccaggccctaggaaggagaggctcaccatgccatttagagtggccccctcctgatgacctctctgggtagtgcccctgtgggagcagatggacattgccccccactttacatcatggccagctgcagcgggttcactaagaggagcatctcaccaaggtgaaaagtgtcattgcaggaggtaaagccgcagctgccagcccaggggctggtcctagagagggcacagctgatgccctctgagcttccataaaggcacattgggatgagagctatttgcagtgatggaagcaccacctgcaccccacctggccctggaaacaccatgtgctgtgctcagagcgtgtccttgttgcgggtcgtgtcactccacagaatgagcactgcccagggctggaattggcaactttgaatttgttcctcctgctggctgacctctgaataaacagtcctcttggggactctgtgaagcctccttacctctactcttctccttcgagcccaatgagtcttaattggctccatctttaggtgtgatgatggatactgtctggactgcaaactctttgagggtgggtgaagtctctccctgcaccctgccctgtgctgtgtactcaggacctgctcggcgaaagttttgagtggatcacatgcctgcttacttgctcctaaggcggatttggggcctagggcaggagatcaggcccgttcctcccagcatctttagtgtgataatgcgcttatcccagtggggagcgtgggtcatctgagatcacaggctgggattcttttttttctctattgagatagggtctcactctgtcatccaggctggagtgcagtggtgcagtcgtagctcactgcatcctcgaaatcctgggctcatgtgatcctcctgcttcagcctcccaagtcactgggattataggctcgagcctccatgtcctgtgccacaggctgggattccttgtccttctccaggggaagccaaaggcagtgcagcttggtggtcagagaccaggctccagaggcagacagacctgggtccaaaacccagtgctgcctgaccagttatgttaccatgggccactcactcccagaatctgagcctgttacctcagttcaaaactaggaacaaaaaagctactccctgatggtggtataaggattaaataaaataagtaaagtgcccactatcgtgctagtaaaaacaggtaatttatttagcgagtagtacatatttgttgaaagaatgaatgggaatcttctagaattttctagaatatgtctgctcccagattatttgcttcagtttgttgttcaggagttgcacaggagtggggaccttctgccatgagcagcataggctgggaattggtgcagaatttggagactggaaggtgccttgggcctgtgaccaaaggtcccctctgaagctcgtctgtgtactacagtaagaatagtaccatcactgggttataagaatcagctgagataacatgtaaagtgcttggaatagaacccggcaataataccagaacctggtattattttcttggtcattgttttactttctgttttttgaagatgcttttaaatacctcttcattccaacattatttttaaaaatgtgctctatttattatttttttagcattttttcttgtttagctatttaatccatgtgggatttctttttgtgtgttttttccaagtgtctcactcttatctatttgttgataaactctttgtttttttactatatctgattttctttataaaacttgatggagggagttgaaacttccttccccaacctcattcccctcgctcaccagaggtaacaacaatctaatctaatttggtgtttataattctcagatctgttttataataatgctatatatggatgaaaccataactatcccaagagatcttagaatttacattttccttttgaaaaacttatttcgacataatttcaggaagttttaagaataagaatacccacctgcccttcacccacattcctcaaatgttaactgttcccacacttactttttcgtgtctttctctctctcctcctctttcccccaccccactgtctttataaaattctttttctaaaccatttgagacagaagtgaaggcatgatactcctttacccctgaatacttcagaaatgtttcctacaaacaaggacatttacgtatataaccacaatctttatcaggaaattaacactgacagaatactcttagcaaatctacagaccttactcatatttcactgtatattcctatgttttttataggaaaagaaaaccctggattctgagtgaaattgttttcctgtctctttcgtctcttccaatttaggagagctcctcggtctttgtctttcctgaccttgacatttcttatgagtacaggccagttattttgtacactgtccctcaatttgggtctctctgatgtttccttacaattatattcaggttaagcactttgtgcagtaatgcccagaagtgatgtggctttctcagtgcatcatatgaggagacagtattacttattgaatagtctattccttttcccactgatttgaaatgacacaatcacagttttctaaattctgatatatacatggatctgccattgggctttttagtcttttaaattgatcagttttacctaattatgtgccttttttttgttgtttttattactttgccttcctagtgtgatggcatatgttagtcttttaaaaagtgtttcagatttgtaccagggggctctaaaaatctgttcttctacatgagctttatatcaactccacaaggtctctcagaagtcctatcgggattttgactggaatcacattgaatttatagattaattttgagagaactgacatatttatgatattatatcttcccatgcaggaatgtgtctctttaggtctttgatgtttttaggaaagcttcaggctcctgttttttttttttttttttttttgagacagggtcttgctctgttgcccaggctggagtgcagtgccatgatcatagctcactgcagcctcaatcaaactcctggtctccagtgattctcctgcctcagcctcccaagtagctggggctacaggcacacatcaccacacctggctaattaaaaaaaaaaaaaagttttgtaaggacagagtcttactatgttgcctggttttgtcttgaactcctggcttcaagtgattctcccttgttggctgcctcaaagcattgggattataggcgtgagccaccacacccaacccatgcatatttcttaataggtttgcttattagtgttttgtagtgttatttgtaggatgtgattcctcctcccattatattttctttttttcttttttttttttttgagatggagtctagctctatcgtccaggctagggtgcagtggcgcagtcttggctcactgcaacctctgccttctgggttcaagctattcttctgcctcagcctcccaagtaactggaattacaggcatgtaccaccatgcccggctaatgttttgtatttttagtagagacggggtttcatcatgttggccaggctggtcttgaactcctgacctcaagtgattcagccacctcagcctcccgaagtgctgggattacaggtgtgagccaccacatccgttccgtcccattatattttctgattgattattgttgatatgtaggaaagctgttgacttgcgaatatttatcctgtatctggttactttgccaaattcccttttgttttaatagttttccagttgattctcttggattttttttttcaggcaattgtatctgccattaatggcatgttggtttgttccctcccaatatttatgcttcttgtttcttgtcttcaacttgggtagctagcatcaccagaataaatttaaataatatggtagtgatattgggcattcttggttattcctgacttcaattagagtagttctggtattatattgttaaatatttgagggaggtttttgagagataccccttatggagatgtaaagaaattcctaattatattgatcagtggtttttttgtttgttgtttgtttgttgttgttgttgttgtttttgcctcatactatctcagaagacttaggatgatgtcttttggagttgcattacttttgtaatttagtgccatattttatttgctaacatttatataggaattttggatctatatttatgtaagatttacccatacttttctcttttaaattatctttcccagttctaatgtgagaattatgttggctttgtaacaagaattggaatggtctcctcctcacacctcacgatttagaaaacatagatataattcgcttattgaaaatttgacacagtaaaattatttaaatattcccagtattttaataattcaaatttcttcctctaattattggcctatttgttttctatttcctcttgagtcaattttgggtaatttttattatttacaaaatggtctatttcatgtataattgaagatatattaatataaagtcttccttcctttcttcttccctctttccctccttccctccctctgattccgtagtcatagccactttttcattttttaatatttcaagtttattttttagtttcttaggcagacacatggtaggaggtgggattagccattttatcagtaatttccaagaacatgctcttatgtttaatatcaagtgtttcgttttctatttctttaacttctgtttatttttattcattttctgctttcttttggcttattttgattttattcttctcagttcatttcttttttgagtgactgctttggaaatatcccatgggttttgctatatagtgctctcattgttcatttttaaatagtctgcactttttaatttctcaaaaaaaaaaatactcctccaaataacctttaggttacatttccaagtggttaaactttttgtggcttttgtttagttttattgctttgtggtcagggaatatggcctgtataatttcttattttaaaaaggttattgaggttttttttgtggcctgtcacatgatcagtttgtaattgttccatggatttttgaaaagatgtgtattgttttataagtacatataaaaatacatcaaactggttaattgtgtttttcaagtcccttattactgtgtgttttttatcctcatgttctgtccatttctggaaagtatgcttaagtctcctattgtaactgatttttttcttcctgtttctccttttattttcaagtttttgttttctgtattttatgggtacgtaaaagttcatgactatatatctttttgtttaattttatgtcagttaaaattttgggggggtggttcttgataattattttgtttgccttggagttttttaccacgtctgctttttattgacatatgcctggtgtagttttgtccattatttttgtaaaaaaactttttgttttaaaataatgtaagactcacaagtagttgcaagtacaatgcagagagttcccacccttcatccagctttcgtcattgataacatctggcatctctgtaatcccctttattttagcctttctgactctttttgttttagctcctggcctacctgtgccccccaatttgtgatattctgccttttaacaggagaatttatatatcgttcatatttattgtgatttctcgtttaagtgtcagtttctttctgccacgtaattttggttttggttttccatgattttttttcctagcctatcattgaactgccaaagttttctttattcccctcttttctttctttatcttctttttcttcctctcctttctgcttgtcccttccccaattccttgcacttattgatttggaagtcataattgtatttctcatttctgacatttaagtttttaacaaacttatttaaacttgggcaagaataaatctctaattttccccaaggaatcctcccccaccacaaatatttgacctccaagggcatttacattttcctcattctccttccatagtttgtttttagtaaatatgacatggaattttatttccaacttaaaacttctttttctgcattgtttttgggggttatgtaagagcttccttgagattcacagctcttatttccagttactgtttagacttaatctgttttgttgggttactttctctttctttaaaaattctgtctgatgtcttctttcttggatttattttccttaatgtttttcagaaaatgtgcccaggtgacctgaatgtctctgcatatctgaagaggccattatttttttctcacatttgagtgatgagttggtttgcatttgaattctagatccagagtcccctttctcaggatcttgtagctgctgcagtcttgtcttctgcctcttgatcttgcagatgagaagtctaatactagactgagtcttacttctctaggggatttttttcgtctatgaaagcatttaggatttcctctttgtttttggagttgggaaacttttatcaggatgtgtctagatgtcttgttttattcttctttagtacttgcaccttttgtaatgaaaatttcagccttttgtactgttcttttctctgccatgcagagctgagtgaatattgggtcttcaggatagagagaccatgagacgctggcagccagattgcctaggatgccaggtgcagctggacagctggtcaaccctctccagactcactttcctcctctggaaaaggcaggtgaacagctcctaccacatagtgctgttgggagacgaaataggacacaacggacaaaacatttaggacaatgtctggtatggaggaagtggtcaatacgggaactgttttttctgtaattcctcgtgggtatcagagacggaggaagaagtgggcttttgagcaggactttgaaggtggacaaggtaagaccttctctgagcctcaatctccccactgaaaatgatggagcttgataggtttttaggtaatagttctccttttttttttttttaaatttcacacagaggagtggcttcatgggatataatttctcactcctgaatctcaagtcttccttcctcttccctctcttctttttttccatggtgtttggtctttctggtgagtgtgactttgttgaaggtaggacgcaggagttgaaagaagcttttactttgccatagagaaagagcggcctacctgagtctgttttgatatggtaaatgaaaaggtagatgtctttgagcttgatctatatctggcatgccctccagtcttctctgtatccatagccactctactgggctgtaagctcacctgtgtttccccaggcactgcatgcagtaggtgctcaagaagtgattttggagcagacgatgaatcagtgcttcatttttcctacatggagaaatgattgtatctcacttcactgggcaggtctcccttgcatttgctgttttataaaagattttatttgtggttgaatgacagtcagttctttcaggaaaatgagaaaaactggtttagaaccattgtgaaattccattttaatagcaacaagaccaggctctggcaagttcaaaaagggcaatcaagaaatgcttgtttgctcaacagaaagagctatttaggtggttacatggttcagagtcacccccaaactccatataattttcaacttctaatgacttttttagcctctaaggtaactggcgaaagtgtaatttatttagaggagtgttttgggttggtttcatcaagttgaggattgtcccaggtgcatctggaaacatcaccaggaagagaagaaactccactgggaaggagatagggtaggggtgtgatttccaacaactcttcactcctcctggcgtggtttacagagcaaatgtttttgagcatcttttttctgtctggcactggtaagacaagcaggatgccatccttgctctccagtggctcagagcaggcatgggaatggatcattgtgatagcctgcggtaagtgcgaactctgctcctagcttaagcaagccagagggtcaggaaagcttgcggctgggagaagattgttgggtgaggagaggctcaagggggagagagggaagagaagggagagtgctgggcagcagtgactgcgtgtacagaagcctggagccacgtgtgatgcacttggcagctctatatcctgagctctgttagggagtgtctgggcagggtgcagacccacgtgcagtggggctggggagctcctgtatcccatctcaggaaagcagttgccactcagctacaaccgattgttgccatggcagaacacaggccccagtgtggccagatcttctgatttttttttttttaagaaaagctgtaaatctgaagttttatgtaaaacctcccaaaatttcaaatcatgaccactaattgaaaaaaaaaggtcttataaaacccgaaagtcccactccgggccattggtttatgaaacctgtttagggactagagagaagcagaggggatgagggggactgaggttccctgccctggcctcggctgtgccctgtgtagccttccctgtgccggtggtcaggatagtggagggcttggacttcagtgttgaaacagagtgcaggtgactttggagaactttgctcttcccctaaccttgctttgctgtgattcagagagtaagagtcaagtgaggcttaggttttcaggtttcctcgttttaatgccttttccttccttactaaatctggatggggaacgtgatgggtgatagttgaggctggattgcctcttacaactattaggctccctttgcccctgctcacacctcgccctgcacggtttgatccaatgtggaatttcccctctttctaccttctttttctgctttattgaagatcggggagagggccagataaatacactcttgggcctaaacgagcccttgatgtgggcttttctgccacactagtcaatgaatgctcgtcttccccctagagtagatgaaaataaatcttttgtttaaaattctttctattttttttgagacagagtcttgctctgttacctgggctggagtgcagtggcatggtcttggctcactgcaaactccgcctcccaggtcaagcgattcttgtgcctcagcctcccgagtagctgggattacagttgtgtaccaccacacccagctaaattttttgtatttttcattgagacgggattttgccatgttggccaggctggtcttgaactcctggcctctagtgatctgcccaccttgtctctcaatgtgctgggattacaggcatgagccactgtgcctggccatacttaaaattcttaaatacataacacagagttatctaatagaaatgtcatgcaagccgcatgtgtaacttgaaattttctgatatccgtgttaaaaaaggaaaaagacacaggtgaaattaattttcataacatattttattgagcccattgtatcaaaaatgttatcaattcaacatgtaattataataaaaattcttattaaggtattacacatttttgattttttacaaagtctttgaaatcagtgtgtgttttcctcgtgacagcccatctcagtttggattagccgcatttcaaaagctcagtagccacagggggctagtggcaaccatgttggacagtgtggctgtaacagatgcacataaaaaagtgacattccgcagatatgaagcagtgtgcaggccacctgtgaacctgttaatgagaatgactcatttgatcgtgtcgtgatcagctctccattctcctcagggtgaatctaccagcccagttccctttccagccccatcccctgtctccctacctcactctgtcctgccaggctggccttctgttccttcctcccacgtgcccaacaccttccagcctctgagccctcacacatgctgttcccattgtgtggattatgcccccttccctcatctctctttgcttggtttaagccaaaccatgttttcaggttaaataccagtttttcaggaaggcatttccttatgtccttgcttccaactccagactagattgttgccccgtgggatgctgtcatgggggaaagagaggagtgtgttccttctccgcatgtacacaatgatagttatctatttattggtgagatcttggcttgacatttctctactgcattaggtgttgcatgtcaagagtacaggggccatgactgctttgttcactcgttttgtccatggcagcctgtatagtggctgcagaaaatagatgatcagtaagtatgggatgaatgacacagggctgagattcagtcttgtagagtaatctgggcccatgggacctccagaggatccagacccctaacagtggggctagggcgtcagcccctgtggccagtcctgggtctcctgctttgtcgttggcagagtcagcctctccctgtccctgccttgactggcttttggttgcctgtaaattatatttttggtggctgttaataaaaatatagggctggggggagaaaaaaagacttttcctaatagaattttattaaatggcactagtttaaaaatgtctcgtaaaaagttaattaatttgggatttggggatgaaaggcgtgatataaatgtcagttattattattacaatttcagcctcacgcttatgctcttgatccagtccctgatctggagtctctgctactcccagggactggcggctttgctgaaatgctggaggcaaatttgagctttgaggctccatcggggacaaagaggacctcgccaagttaggctgtcctgccttttcttctagaataatgcaaggccttgagagccagcaccactgtcagggccaagagctgttcagagcaggatggtcttggcgctctgcggagccccctgggccaaagcagccaggaatatcaaggccacaggcttagccccctcacggaaacctggggtgttaaagctttcggggcttcaagaaattacagccccattctcattttatggagagggaaactgagtttaaagaggggcggtggcttgcctagcccaaggtcacatagcaagttaattaaatttatggagaaaaaggcagtgaatgcaattagtgaagtgggggaagtcttcaaaaaaaaaaaaaaaaaagatgcaggcaatttattggtgacaagtctagaaactattttccaaggaaatggggagtcctgggacttctcttgagttcacagaggcaggcagcccttcactccttcaagacatcccacctttatgcccctgatggcagacaccgcacctagaggaagggactcggccctgacccagcgtgtaattaccagtgcgaggtagggggcaagctgcgatgttaatcagcatcaccgctgaagagtgagtgtctgtgtgcgtcttttgcctcctctctgagaggggctgtgaaagtacccctcgcaggatgtagacgggagtgtgtgtgtttatgtgctggaaatggcagcaggcaagttggggatctcatgttcttggactcatctgtccttgcagagctgcaagggagcctagtggctggttattcccaggacccttcctgatgccatctctgctacagaattcctgacaggtgtttgcttgtttccagttgggctcacccacatgttccctgcagcccattccatttgaggtggttctgggaaagcctgcctcctcctcactgtctttggttcttaaatctgtgttctgttttggggacgacacagacagcatctcccctgtccccttctgagtggaggcctgttgttatccagcaccaccattgacagaagtcatgagcttgcggagcctgctgcagaggaggggctcagggaaggtttgcagaatgaagcaatttggtgctctcgacaaagaatctgtcttggggctctttagtgaatcctttctacactggttggctgggatcgtccaggggattttggaatcagagctggatttgaacctgggctccttcacctgagcaagatatttaatctcagtaattctcagtttcctcctctggacaattgagataagaatacttactccacagcattaccatgaagaggcatgcgtgtagagtgtttagtacactgctgagcacatgtgatggtgggaataattataatgtactcatgacatatgacaccagccaggtcctcctgctaacatgttccttgagatgtccatcttattactgaagtccccaaagtcctgcacagggcctgacacacagacccctaccggaaccttccagctcctacagccatgtgcctctgattcttaatgactgttgaactgaactgagctgaattgagagttctgtcctgcgttttacaagctcagagtcaggccttcgggagaccccttgggatgaggctgtctgtatttccccgaggccagaccagccctggtgtggaggcttccgagctggttcgaggtctcccccagccttttagaatgtgaaagcagccaataagagtctcaactagaaaaacaagtgccgcagctctattgttgtgttttattggaaataaaatttttattctctttcttcccctcttctccgtgcaagaaaaccacagctgcctcagactttgaagtccttttaagttgcaggcctagaagaatgggagggagaggggaggtccaggccatccctttggtcgccatgttgccactcttgacaaagagcatcagaatggcagcttgttttttcctcagtcaatggcagagctgggtagattgcatggaagagatgctgttggcctctctgggaacagagcagcctcccccgccctcatctttattggatttcaatgagtctttctgctgtgggtcatacatgcagtgcgacctcataaatggagcggtggaattttcactccctttgtactgagggcctcaagcatactccatcgccattgtcaaccctggatgggtaaaacgcagaaaaccaggcagaactgattcctcccaggcagccctgagacctggaatatgacagttctaagtttctaggcactcgctagtcagaaggcggaatagggcaggaaagcagagatgacatttcccacctcgtgcccctgagtcttctctggaaatccagatcctcacacttttctgtggaatatatcagggccttcaagagaatgggcaaggctttgggcctcacagctttgcagttgttgcatcagaggaagcctgtagccatgggagttagaaggctctagaaagattctggaggccctgtaaagctgagatgtttttaatcaaaagttagtggattaaaaggccatgtgttatttaactggatgtgcctggtagctgccagttaagtgcctgttttgtgccactcgtccatccacatatttttgagggcccaaaatgtgccagccattgtgcgaggagccagccgtgttggggaagcagtgggagtccctgatgttgaagcagtgggagtccctgatgttgtggtggtggctacagaaggcagcgctggtaataacaggaagaaagcagtgccccccaccccacagatgagatgtatacccagggtcagatctgttgatggcattatttctgcacttaccagcttggtggggaaggttcctgctttgctgcattttgaaactgggagtttgctatgagatcatctgttctcccgcttcttcccaaaagggggaactcaaggacggtgggcagttgatctctgcctatttactcagcctgtaagtttcagagatgaagcttgaatgcatgtcttcccggtcatcagtccagatcttgtaattagatgaaatgggtgacggaagagtgaggctggtgcaccatgggatggctgtaattgcccgtgacatcaccttgcgtctgacttctgcattggagcttcacatcttccacatggaggtggctgctggctattacaaattgctgcatgcatttgaaaagatataattagagaaggagcatttccattgcagtcccacatgaagggctgggtgttcacagtgcaagtcctgtaattcaaggggtcggtggcagagatggtcctctgatgtgaagagttcctttgtcccccaccatccctccagacccctgtcctctgtgtggtccgagacaggagttgttcttacagtccctcggaggcgtatggttcttccttacggctggttcctctgcatccctaccactgggtcatccaacttaaatgcctctgttgtcaaggtgctcactacctcagtcagactctttccctggaggagaatgttcctcttcatcctgagctcagagctgcctccttctgatttctgtccccaggggttgtatgctccccgctcctctctcccctcccggactgaagggcaggtctctggccctacatggtccacctctgtcagccgccaccacactggctccgcctgggaaaatcctgcccgccgatgtgtaagtgtgtcactgccaataatagtgcgaagcctccaaatctgagggcctttctaggatcgtttcctgattaattaggtcagcatctccaaaatcaatttccagcgaagtcgcgccacctggtagcgccgttccctgcccagccaggcgagggagttggcacgggaggcaattccctggcctctggtgcagttcaggtcttgtctctacctcatctcttctgtgattatcctgactttttattttatctgcccccctcaaatcttccattaaacccccgtagatcctgcttcaaacaggcaattagactaacaacgtaattatatccctcaattctaattgtaactggtttagaggaaaaacaaagagaaagaggcttcaaaatctctggaaactaaaagcagcggttatggtttccaggtatttttcttccctgtgtgtttctttgagagccctggttgctggcaggctggcatctctgtagcttgcccaatgccataaggaccaccgtatctgttcccctcttctgagcatgtgctagttgacacccccacctctgtccttctctgggttcctggctctgctggctgtgtctctcattgtctctccctgtctcaaccactttcaccctattagatgtggtcagcttgccggtgttggaagaagtagcatttcttctggctcttgctagcactccatcatcgccagtaaccatgggttgatgatccatgtgagtctgtcttggggagattggaagccaggcaagctggacctggtcttggggtttgagcccagccaggcttatgtgacgaggctgccacagggagacgtcttgcgccacctgcctatactcagcattttccgagtctgttttttgagcaaggcctgcactctgtgaataagccttggtctctgcctccaggctgccctcggcctggggaaagaggcattcaaatcattgaatggtgggaccgctgggaagagtagacatcagaggggctccaacccggcctcaggtggcagggtgagatgggaagtggagtagggcagtgtggggacattcgagaggttccctggtggaagggatgtctaggatgagagttaaaagatggggaggagagttggccaggcagtgagtgtggaagcaggtccaggaaccctggtgtggccggactgtctactgtgagggtggcctcggtgggagctgaggctggagaagagcagggactatgtctctgaggaggaggagtgggaggggaaaggaggaagggagggggggacaggatcagacttgtgtcttacaaagaccaaacgagctgcaagtggaaattgttgaatgggagggggcttgattggaggctagaaggccagttggagggcttttgaagaaacctaggtggtttttcatgaataacaacttgctgtgatggggctggactagctgtgtggctttggggtggtcgcttaacctctctgtgcttccctttcctcatcagattaaagggagggtatttatatttaccttgctgtgttttaggggacatatcagaaataggcaaaggttctagttcagtgtttgacatagaataggcatccaaacaatatttgtgaatagggaccttttaccaggatggcttggagcactttttcctatatatatacgtatatatacacacatatatgtgtgtgtgtatatatatacatatatgtgtatatatacatatatgtgtgtatgtgtacacatatatgtgtgtatgtgtacacatatatgtgtgtatatgtacacatatgtgtgtacatatgtacacatatgtgtgtgtatatgtgtgtgtgtatatgtgtgtgtgtgtgtgtgtgtatatatatgtatatatatatatgtatatatactcctctcccattaactctagtatttccagaggatgagaactcaggcagttgtatgttgaggggcctcttgagtacatagtggcttttcagttatcatgacttttcccatcttggagtcgtgtcccaaaccttgacctcatggctaaggagaacaagtgtggttctgtgccattttccttttcttagaaactgggtttcccagtttgatgattgaatgtgctgacaccgtttccctttgggcagatgggactcaagttgccaccgcaaagcctggggtggagacttggtcatcattcagacattgatgagcttggagccccgctttctttcagtgactgccttgaggctttcgtggcactccatatgggccatttggtgccaggtattccggccctgggtttgccatcagttatgtggacggggcgtttcattaaaatttccattaactgttttttctttttttaagccagtgagcaatttatagattcattaactttttactacacttgtgaagccaggaagaggggaataaaggaaatgaaatatttggtccgcagcatttcactaaaagatggtggcccttaaatatggaggagaaaagctggataattaaggctggtttgaagaagcatttaggaagggctgggatcttccagaaggatccagaattggaatatcctggcaaggaataccaccttttaccaccccttccctgcacactgagtagctgatctgtccttttgctcaaaatgattgatttttttccccactgggtgtctgtccaccccctgatgacagcctctcatgggaagcataccgcctcaggactaactctgactgtgactctgaatgtatttccttgtttgggggtgcagtctgactcctcatagtcctctcattgcattcccttttgggggagttagggatggcatgatggttgagtgatgggccttggggccagataagcttgggttcaagtccaggccctgctgctaactagctgtatgattttggataaatgtcttcacctctctgaaacttatttttttaatctataaaatcatggtagttttaggaactctgagaagtctcaggaaagtgacagtagtatgttctaccacacactaagtggtgaggacaaaatggtttactaaggatgcctgacccacattcacattccagacttgccatgcagttggactgctcacctacaaacattctcaattgaattccattccctaaaacagcaaggcacatctcaggacatcagtttcccctgttggaaagtagatgaataatctctagttaatgaggatgttggatgagatcagacacatttaatgagccttttagagttgctggcacataatagtatcttaatacatactagcagtcatatatctattgtggttgcaactacatgcaatataaaaactctgctcccagggtctactgtattaaaaaggcaatcggcttaaagatgactttccccaagagcctcttagaaagagaaaatctcagtacgtgaacgtacttcgaggtcaccctgttcggctcccaggtggagcttggatgccctaagtgttgaacttcccattgaaggggtgtgtacccaggcctatcctcgggagagatggttaaaagcaggtctttgtagagtcacagtcttcttcaatcaggagtagcatggaaccctaggaaatcacctcatcctaatacctgcctctatagatgtacagcatgagtatttgaaagtataatgaatttttcctcaaaagtggtaataatggaaagcgaagcaggaaagaggaaagtatcattcaattttgagccatccaggccaagtgcttttagggatattgtatacgtgcatgtggtatttgttagtgtaaactttatgtaaagttatatatagagagtttgattctgttcttgtcacttcagccagttaacctctgcttcttcctctctgtaacggaaatcatgactcctaccttgtgaagaattaaatgaagtaatggatataaaaaatcactaaacaaatgtatgtgggggattgatagaatatgttattcctgcctcactccagactcaggcttccgggaacctgagtcatcttcccctttaaggatgctatgtagacacactctctgtgctgggctgtctggtgggcactggggaatccagaggcacagcccctgcctgggaaagatggatgtccagctgtgaagacaggtaataaaaagatgactgagtatagcagccagttgatcaatatcttttgaatagtccaggcaataagtgctttaagaaaacaggggagggagattgcccctgtggcctggaggaggtgggaatggaacccaaaaggaaggggaagggcccttcctttctttgcagaatgtagttaaatgaagcctttagcaacaactaggacaaagaggttctgggggttgagtctatgtggggtaggaatgcatttgccttttatgatactgttcagcaaagagcaaagatgtcctgcgtgcctctggagtgtccttgaatgtggaaagttctagggctctaggagtgggtttcccctagcccagctggtgtcatactgtggtccccagagcctctgatcgtcatccctataggtctggtcaagggatgcttctagagtgtccactgggtgcttgggtcttctgggcagggggttgaggagagcattaccctttcacatgatgagttttccgtacttctctcagcaacactggagttacaatatgctagaaggatacccaagcaacctacatgttgggggactgggctgtgtggccaggcatccatttcccagacttccagagttctttaaactccaagctgtgattccactggatagtgcagagcatggtgcagttcaagacaaggcagttcttgctgatgaggaggctggagtccaaatgggggactggactcaggtggactctttggttagctctgcagggcagtgtcttcaggtggatcctgcacttctggagtttcctatctgaactgatctgttggtttgacctcagttccatgccttccttttccctgctgtgctctgtattgcaagggattgcatttcctaggtgctcttgctctctggccttcaaaagtttaaccagtaggatgctcatcaggaagactggaatgtgaaaagggagggagaagcctggggtacttcttctcacccattctctccctctggtggtgttttctgtttagctccagcccttccctctatggtccactcccagtgggcagccttttccataattttacttcttgctggacagccccagtttctgataacaccatttcatcccttttatctctccagggctatgggtggtagcagcagctctcccatatgctgatatgcctggttttctatctgtctcctgtttgccttctctattcactcatcacctgtgttctcaaatccttatattaaattgcctccatttaaagggcctagagtgacttctcttttttttttttttttgtctatcctggaccctgaaggctattcccaaatcagaccccttagagagtttgactggctgttgccaccctgactcaccccgtggaagtcactgtaagctcatgactgccctaatgaattcaaggtaccagatttccacaccccacccccacactgcaaagaaaacagaattgtagaataatttcaaaatagtctggttgtctagatttctcagcaggcacccattgggatgtgcagaattacaatctttcatttcttcatgggcctctcattttgtaggaatatgagtgattccttcctttccagctgtgagaggaactattttgcgtatactattttgattttgaaaaaaattcatgcagttgttctccccctccccctattttcctgggctgttgatcttgtgatatatttatagagattgtggttggctgaccaggagttattttgcaataggaatttgtaagatttctactttgagtttgagcatgtgttccagacttttctctctttaaaaaaaaaagtcttacttagaacatctactttgcccttctgtaattatttctctttcacagcaaaagtaagccctgcactttacacatatttttttctatgtatatttcttctgtctctggtcttctttcttctttgatgtctctttttactacatattttaaaagccctcagcttctttcttctatgtgggaataggtttgcaaatgaaaatgtgaccggaagaagggtgctttgggggtcaggaggcctcagtttctctgtctgtaaaagaggagcatcccagcactttgggaggccgaagcgggtggatcacctgaggtcagtagttcgagaccaacctgaccaacatggtgaaaccccatctctactaaatacaaaaaaatagctgggagtggtggctcacgcctgtaatcccagctactcgggaggctgaggcaggagaattgcttgaacccgggaggcagaggttgcagtgagccaaaattgtgccactgcacaccagcctgggcaacgagagttaaactctgtctcaaaaaaaaaaaaaaaaaaaaaaaaaaaaaagaagagcattggactagattagagggggcaagcatgcttccatccccaactttaccatactcactgcagacattagtaatcaatcacagcactctttctaaccgagctctgctgtgacctcagaatctttctcaacacatggtcccaggcagccactactaaatggttagaacaggccattcttaaactagatgaaatgattccttggaccccattcaccactctggctctctgactattggaactacaattcctttatgttttaaaccagttgactgacttttatgaagcctcatcttgacgtaacacatccttaggcctaggtactatggagccacagagaagctgaaaacagcaggccaccctcacggaaactacagtttggtggggagcaaggctgcagagtggcgatgttcttaggtgtgctcaggcaccttcttggtgctctaggatgttgtcctgtggtcagggaaggcttcctagaggtggttagagtagactgtcgtctaggcagtgagacagccttagcaagtttcagaattaagacttgcccaaattttaataagtggtagtaattatagctaaagttaactactaataaatcattttataaaaagtaatgatttatataggtagtacttatatactgcttagtaagtgtcagacgcagttctgagagttttatgtattatgaactgatttggtcctcagtcaccttgtgaggtcagtactgttattatctgcatttgacagatgaagaaactgagtcacaaaggttaaatgacttacccagtgacacatagtatgtaagtggtggagccagggcttgaacccaacccatctgcctgtagatactatgctgggaactactgtgccaaataaatcccgccggccggagagatcagaatgtgtttggctttttaaaaagtatattaattttacttaccaccatcaatgtaatcttaatgacatcatccagatctgtggctcatgtagtgttgttagcactggctgagaatattatagactctctatcacttcatccacccaacagccgtgggatggggggatttttatctctattttacatcagaggaaactaaggctgagagacaggatgtatcgagctactaagtagcccaggcagaatttgaactcaggcctgactgactccagatgtcagagttggaatgtttctgagaggccatcagtccagcaacctcattgaacagatgggtagtctgagggccagagactgcctctcgagcaagtcagaggaggacctggtgctaacaggggtctcctagagtataaagttcctcctccctggtgaggccgtccagacatgccagacatgccagcattaccctggccatatcaaaggaggctgaagccttcggttcactagaagagatttgaggacagcctcttcccctactgccatacatagaaatacctaagggggtgacttaaagccttgtccctgaattctgggttcacctaatttggagtttgcaaccctttgtatttataataggtttttctctccatgaagcaaaagtttccttttttttttttttacccccaacccccacttcctgctgatctgaagtgaatatttatcacatatttaatgagtaatctgagtctcagcttggtgaggctgtaccaggacatggtttatggctgatctggttttaactcgctccaggcggttttccctagagttttctgtaaaatcataaacctggagagagaatttttgtggaattcagtcacatgactcactcttttgtaaattgagagattaactgtgactggaaagaactgagattcatttctttttaaaaaagaaaacaagcagagcagcatttatgcacccagaggagcgtgtccatgctgaaagacaagggggcaagtcactctctccaaggtcaccccaccagccttggaggcaggatggcataggatttgaaaatgtggatttggactcggagtatctgggttggagtcctggctgagtctttcccagctggtccctggacccagcatgcctctaagtcctcccctgcacatggggactggtgacatccccacctcttatggtagttgagaacattaaatgaaatgatgcatgctgtaccctgagccagggctggcacacgggaggtgcccagtggatgctggccacttctagattgctaggattaccttcatttgaagccctttatgttgagttgatgatactagctggcactacatagatggaaagaccctgttccaagcacaactagctcatttaatcctcacaatggctctgtgaggtgggcagtgggatctccccattttacagataaaggaacggaggcactgagagatcatgatgcatccagcgtcccattcacacgtttgtgcccaggctgattcccgtaaacactaccctgttgttgctgctggcttctttcttcctggtgtactgctggagcctgggggcattttgcttgctggtccctgggagggagaccaggcttcgccttgccttagctcagacctcagccaaccctccctggactttgacatctacccccaactggtcttggtgtctgtcattgccctaaccagcagcccatcggaggacagaattctgaccatgttactgccctgcctggagcccctgatggcaggtgaaggatatatgggagctccctgctatccctgagaaactcttttgtaaatgtgaaatttcttcaacataaaaagtgttttaggccgggcgcggtggctcatgcctgtaaatcccagcactttgggaggccgaggcaggccgatcacctgagatcgggagttcgagaccagcctgaccaacatggtgaaacctcgtctctactaaaaatacaaaattagccgggcgtcgtggcgcatgcctgtaatccaagctactcaggaggctgaggcaggaattgcttgaacctgggaggtggaggttgcggtgagccgagattgcgccattgcactccagcctgggcaacaagagtgaaactctgtctcaaaaaaaaaaaagtgttttaaaaaataaaaacaacacctcactgggccagatctaagaaaaacctcactctttgaaacaacatttagaacactttctgatcctgcccagctgggggaatagaatgaacacacattaatccaccagaaactgttatagtacgtgttggactcatgtgcagactgagggccccagccgtggtggcacctggtaccctgggatggaaacgaaactgtgccttgggtggtgagtcccacatagccctgcaggggaggctgctgcctttacctctctgcggatttcccccttttcctttatttttttatttttatttattttgagatgaagttttgctctcgttgcccaagttggagtgcagtgacacgatctcagctcactgcaacctccgcctcccaagttcaagcgattctcctgcctcagcttcctgagtagctgggattacaggagtccaccaccatgcctggctaattttttgtatttttagtagagacagcgtttcgccatgttggccaggctggtctcgacctcctgacctcaggtgatccacccgcctcggcctcccaaagtgctgggattacaggcgtgagccaccacgcccggcccccttctcctttaaacgtcgtgactcaggcctcaggtttggaggtgaattcttctattcttccatctctcccaggggcccaggtctgtgcatgaaggaaacgaggccctctgcacataatctaagactggcagaggtttctcaacagctgctgcagtttatttaaacaacaacagcaacaaaaatctgtgttcacagagcaactaatatgtgccggcgtcttgctgggtgttttcctcacattatctcagttgatctgtgctgctcccagtagctctcagtcctgcagctttctctcctccaccaccttccccaaaccgccatcatctcttccctggaaggggacagtgggctctctgtgctggctaccacctccagtctgcatactgcagctcgcaattgcttttggggtgcatatgccttccaagtctgtccataagcttccagctcccttagcctgacttacaggacttactcattcctgactgttgacagtgatgtcaaagacaacgatgatgatgatgaagactgtattagggtctggatccaatctgcatggctgcctatcagagagagaagaatccacctgtacctggaaactcacaagaagcagacaagacccacactggttccattccagacaggaatgatttatgttttaacactggacctcagagagccagggcttgagaaagacataaaaggtatcataactgagaggcgtaaagaaagtggtcattttccctggctttcccttgtagttggaaacttggccagtcaatcacaatgtctctggggcctcctgcggagaagatgcctagacctggtttggggacggtcttcacatttctgttccatggagcattgtggccactctgcagcaaatgaaaaggggaaagatcaaaccattgttccttccccttcagagctggaagctaccaagtccagagggaggcgtgggctctggccttggggtctagtcaggaactccttgtgtgagcctgtgcatgttgggtgggttgggcccttccttcattggtgaagccttcagagaaggctacaacccagcgaagttcacgggccttggtttcccagctgggcaaggtggtgcccttttcttcactgccctgcacgaggtgcatgtcgctccctgccatccagcctgtgttagctttacctgcatctacagttttattccccctgtcgagtgtgagctctgtgcttcctattccagtatccctcttcatagaagctcttcctgaccctgaagtctgttggatcctcttgtcaaagatgctgacggaacccagacttttcccttcagagcacgtatctcaggtggtaattataaactgattgattgaagccattaagtcatcaatgcctgtccccttcactgttcttgttgctgttgtgtccccagtaattattttagttcccagcccatagtaggcatttacatcataatacatagtggtatttgggcgaatgaataaggaaccaggtctgattcatcttcgtatcctccaccggccaaggccttgcccagaatcaaacatctaataggaacttcataaatatttatggaaaaatggcacaaactcatgtgagttccagctctttcaggccagggtcttctctggcagcctcttgccactcctcaagcgtggaacctagggcagtcagtggctttgagttaccgtgttcagttgggaaagaaaacacaaaaaccaagtacaatgtgttagatacataccactgaatgtgatctaagaggcaaggactaattagagaatttatcatatatttggtttccaggaacagaatcctctttgtaacttgcaaagctctttataactttttcagcattggccctggcacttttaaatggcattttttagggacacctggtgaataaatgctggagctgcctgtgcctgagttggagctctgtagctagacagaaaaacagttcatccatatggtttggggctaagttttatccattggttccataggggaagggccaaatatatagaggaaatggctgtggacttggggtgagaagatgtgtgaaccttggccaagccactggcggtggtatgaccttggataagtcacttagcccctccacgtgcttggttaattcttggtcaaagagggatatttaaaccacagtgttttccctgcagggttactgggaggatctcattcggcgtaacttatctgtaaagtactgtgctgatggttagtattctcatgtgtgggagagatgcaactccatttttcttggtgctaaggcccatgatttttggaatcttccttgactctttctttatgtcataccccacatctaatttaccagcaccaaccagtatattcagaactcaacctttcctcaccctcttcagtccctgccaccatcatcttttccctggactgctccgtagccctgccagccttctgtttcccccctggcctcatggtctcctttcaacacagcaaccagagtgatctttctaaaatgtaagtcaaagtatgtcactttgccaaaaccttctagtggctttccagagtagaagccaaggctcttcggtggcctgcaaggctctgcatgagctgacctcccatgatctctcctcctcttgtcctcatgtactctgccccaggtatcctgacattcttgctgtttgccaagcacaccaggcatgctcctgtcctggggtcatttgcactggcatccactttgccccagacaccacatggccaactctctcaccctcttacagtgttcacccaatgatgcctacccaactaccctacttaaaattgcagcctgtggctcctcccttgtccccagcattcctgaccaccctatccttccctgttcatgactcccccgcctcccccacacaccatagaactgattactttcaagcatgctatatgttttacttatttattacgcctaatgttagcgtctccccccacttgaatgtaattgccacaagggtatagatatatcccaactgcctaaaatgatgtctggcatgtagaaggagcttgataaatgtttgttggatgaatgagtgaattttccttatttgagtcttgtgcctcagtggaggagacagaaagttacatgttaagttttggggattcactggcttttggaaaggaaatagatatataaataaagcttgagttgtttcagaccaactgtcctctaaatattaggggacatagaatcatcctctgggcaggtcctgggttggtgggtgcttcttgcaagcgcagtgccccctgcaggcctccaggttaaatgcacttggttgcacccactgccgaggtcacatatcttcctgcaaggttaattgtaccagctggtcgtttaaaacaatgttgatgtttgtactaacatataaaaatatatgaaatatgtattatggtgtcgtatgtatttggtagtttgaatgtaatattcaaatgtattggtaagaattagtaagctacaagacttcaaagggcatttgagcatgcagagaaactcccatttctctctgggttcatgttcatgcttcccttccataagggtgcagagaagcctgaaaaatactgaccactgggcattcaaaattgtcccctagtggatttgacgtcatccacccagagcccagcagagtacttgccacatagtaggtttccaagaactatctgctgagtgaataaaggaatgattaattatttgaggtcaattgatatatttcattcaagcatgattgccaatgcaccattcatctaagcaacctcattgtcagtatttttttgagaaacaatcataattaacagattcaactatatttgccgagtatttgccctgtgccaggccctgagctgggtgctggtgacatggtcatgtgtgggatgtggcctttggaggaggggcagcacacaccctggggggtgacagacgcttcaggaactgcagccccagtcccagtcccgtagagttggttgatgtctgcgtgtcagcagtgttgggaaaacaatgaacagggacaaattaaatctagctgggggaggagggagccattcaattctctagagaccaagtaatttttgagttgcggtgggggaggaaaaggcaaaatcctaattatagcactgtgaaaatgtgctgcgccaggtccatcttgagcttggctagctgaggcgccatcttggaaatgccccctccaagatggcggcccccttctaacctcacagagctagggggactgtgaggcccccacatttgtggcagcacctcagcctccccgagcctcaggctcggttctcttatcgaagaaaggcatttcattcttcgagatcaggcagccaggacctaaggagctgtttttcctccattgtgcaagcatgacaaatcattaatttttgattgatttgcttagaattatgggcgccccagcattctttccgccgctgaacagctgtataacaaatgaatatatcagtgagcacaaaagattggagatctaagagaagcaattacattggccaccctcccccaccctcaccgcttcccgggcaatgaagggaggaaatttttaccagaaattcctcaagtggcttaaaaaaaaaaatgccattttataattgaattaaatctttatctcttcatcttttgcagcaggtttttccaaacacacagcggttccccacgtgcttgggttctatccatccaggaggaatctttaataatgaaatttcaacttgtgagaattaaaaccaaaatgaaaaaaaggaaaaaaagaaaagagcaaattctacccctcctttctgcttttttttttttttttttttttggttgctgctattcctttaagattttggaaccgtaccagtgcactaaatgtgacctccataacttttaaattaagaatttatgctggcttgaaatttatgaaatatttcagcatgaaagaaagcctttttccctcaggaaaattgagcaataaatcacagcactgtggatttactgccctagagccagcgagagataggatttttttttttttttgcttcattctgaaaaaaaaaaaaatgtaatcatataagacagcttagctgctatcctcccactctctagaatttttaatttcagctgtttctgcttggatttatttccaatattcctgctcggcttttcaatttcctcagttattaaattttaattcagtgcattagcatttaaattaaaaaagggtttattttatcgaaatcgttggccagcccccatcctggagcacacgaattgcctgtttctgccatttgcacaaaatgtgaaatgcagctaatgtcttacaacttacatttgcacaaatttagaaataaaatttctgggtttggaataatattttctttccaagaaaacccttaataagagaatggaaaagaacaacttcacattcatttgggagggaagaggagggtcgaatgaaaccaaaaatagccttgcccaggtcctgaggggaaactggtgaataaggaatgggtggggctgggaagaggggacaggcacccttattcggggctggagggcttagatacaccttcaccccagctttacgagagtgagaaggaggatctcactggggtcctccttattttatttgtcatagaggagtctggttttaaggttgggtcaactccacatggagtgggggagatgacctgatttaacctccttctccgcccccattttttacctatggagaatctcaggtgcagagaaaggaacgagcttgtctgaggttcaaaatgagactcagagccagggaaacaagctacatccttaaggagcacacagtccagtggcggaagatggtggaacaacagcagctgcagtgggagtttccattacctgagtaatgactatgtataccagggctgcgcttagtactttagtgacattactgtcattctggctgcaccgttggagaaggccttcgggctgtgtggtctggtggccactcatgagatgccgacttgcagcttgggattcggggaaggccttgaggcagaagacccatggtccaccccaggctggctctgcgactcgttcatcttatacatatcattctgtttttctgtgcctcagtttcctagacccaataaatagtggcctctataactatagggttgtcagtgattattttcattattatagccaagcactcactaagtacttttacatgctattacatgttttaccttatttaagctatctcaagtcccaagccagtcccgtgaagtaggtcctgtgatgagcatcttgccattttgcagagggagaaatcgaggccttggaaatacgtgtgacttgctgaagatcgcagagctagaaaacggcaaaaccaggccttgaactccgatgttctaactctaaactctgttctcttaagcttcggttcaaattgagactcaggtcagtttgcacagggtacagatgagtttgctgtttaggttgaatcatatgaaactgctggtgttagaacattttggcctcagcacatggcaatgtcagaggttcagcttaatccacttggaaggaatggctgtgatgtatttgtaaggacagaccacaccggcctggcgtgtatggaactccaccctgggagttggtgttcccaacacagtggactttggctctgtcgtcatggtgtagctggactcggccaggcccacacgctgtgattgccaggtgctgtgatactgacacatgtgtcttggacatctcccactgaatccattgtccatccatattccaatgaagcaactctcatctgccaccatctgaacatcccacaccctgcccaggtagaactctcctctagttgccccagtttcccagcagcaccacctgagtctctgcaaaagtatttgacaattctttgaatatttttagcactttctctttgttttatgaaaatgggtggaaaacagaaatgcatgcagctaccagtaacacgaagctgaagtatcattcactcaataaaagagaaacaaaggtggagattattaggcatgctgaaaacagagactcttatcccacactctgtcacgtgtttgctgcacttgagctggtcaactctgtgtgaaattgtgaaggaaaaggacaaaaatgacaactttaaaagtgtgtgtgacaagctaaaaatacacgcacagaattaagtctgaaaggcgagagatccatttgggagttaaccatttttttaagatctctggggcagaatttccacccgtaccacttctgctgcttatgatacaaacattcaaacaaattcagcctgtttgctttgcatacaagttttgaggaatgcaagatgttggaaagaggctgtaattgatctgttcttttgctcccagtgaaatgatatgcaaaccattttctgctttcttgtttcttctgttgaaataatacatgggcagctcattaatttcttcctccccgacctcacatttctccctccctattcgtccttaaccttgccctttcccttgtgtgggaaacaggagctgtttgatgtcaccccatttcccaattggctctcctgaatgtcggtgggaagtaaaatgctccagaactgaggatgttggactttggagtgacccagacctgagcttatagctgtgggacttttgataaatacattctttgacctgtgttcttgcctgtaaagtggggatattatggggtggaggggggaggacctatggtgaggattaaatgagagaaggcattaatgtccacatcctagcgcctaatgggaagttctccctggggagcaagtgtggatgcccgctgggaccagacgggctgggtgattataaggcaagagtggaggatggaggctgtggagagccaagtatgtcagctctagctgcctgtcaccatgtaggactaggtatcatggggttatccagtttaataagagaaggtggagatctcgccttttttcagtgcaattcttttatttttatacattgccgatttgtttgaatcgaagtccgccatctgattttgccagtttgcaacttctcgtaagcactcatcaaaaggtgttttatttcaggtcctcagtccttcatccgcaatcctgaaattcaaaaaaactcaaaaagtttttataactgatgaggcagcagaacttgacctgaagggagaaaaggctagtgacagtcctcattgttgttttgttgacgtttatcctatgtagggttacctatgcatatgttttacaatagaaatatcaatgtgtttgattagcgggggctctgccagggttgtttcaaaatataagacatagggcggtacattacctttctaaaattggaaaaattctgaatttggaaacacatatgcacctgaatttcagacctgtattatcctatgattcttattagaagtgttttgacaaagctcgggaatgtatcttcagctggcggtagtgaagatctaggtattgttcccaggtctgcaacctctgtcagcctctgcattgaggtccccctgagcactggtctaggagtcaggacccctggagtttgttttcatgagacttcaggtagctccctctgtgcccaaggccccagtctctgcatctgaatcagaattgtatgatttctgaaaatttcatttgatcagctttatgtccccctccccccacacccaaataaaagagattaagaactggcactctcttgccttctgctcatagggttgggagaaagaatattttaacataataggattttttccctctggttggtaggaataaatctacagctactgttttattggaaatcccagctgaaaataaaaatggtgcaattcaatctcagatttagctggttacttacttttcactgagtccccagggcagtgcagttgctgagtttgtgttggcagtgggtgctcagtgggatttaaagggccaagcaaatggggttgcagggaggtgttctgactccctcttaccactgggcacaagtttgtccagcctggaggagcgggacaggggcttgtggccagctcaccccacagtgtgaaggctggtattcagtgggagcttgatggggtggcagcaggtcaaatctgcatcttctgccttggctgatgtaggtgttttgggtttcttttgcaggctgacggagccagtgcagccggaaggaaaagcactgcgagcaggtacactccctctcccgcccccagcttgtccacccatcgactcaggtcttcatgactaacagttaccactctctggtcctcatcttccccctggaaggatgggtggtccaggccagccctccttggcaagaagtatccagacttccccaaagaatgtgaggtcatagaaagcattttccatgtggctacctgtgaccagaatccaaggatggttcattcctgaactggccattggccactcaagttgagaacttaggagtgaagcataagactaggcagaaagacctgggctggaattccatctgggctgctgcatggctaactcctggggcagccagtcccatccttgtccagaatccattggcctatgtgctagtgtcatgtgctcctctctcttcaccagtcatgccaaagcaggggatgggatactctgattagccagggtggagagggggcggcctttcctcaccctcaaggatggcaggagaggggagaggggtggtccccaatagagaactggactgtttttaccaaagaagggagagatatcagacaggcccaagctgtggacatcatgacaggtgtcacaggtaggtacttggtaatgttaacacccatgctgccgctgctgttgctgctgttacgttgggtagagcaaggctggaacggccacatgacctgtatttggggctttggaggcagaaagaaggtaagggacagacaagagagatggctcccctgaacacatacataaaatctagaatcgatcctagggttacctgttagagctgagggtcagattgtgaatgccaagcagaagaatttgcctgttagcctgtggaacactagttctttaaaatgttaatggattttttttgtgtgaggaaaaaaaggttctttctgtggcccagtaagttagaggacagtgggttaaacaaaattaaaaaggtttatttgctgtgagactttccagatcttttaatatgctaatgtgtgtgcttgagaagagagagccagagagagagagagagaatcatgtttctcaaacttcttaactatgggacccctttttttttgacgttcattgcattgagcaagtgttccttggaacatactttgagaaaccatggaaagatattgacattctctgagcaggagagtaatgtgttcggcttagtgtttcaggaataccaccctggcagccatttgttgggtggattggaggctagtagaatagaggccattataccaggccggaggtctctgtaacccagagacctgtattgtgtggcaaatattttacactttgcaggctgtatgatctttgtggcagtttctcaactctgccagtataatgctgaagtagccatggtgatacctaaatttgcccataaatggccatagtttgtcaacccctagtctaaactgacccctacctgagagcttctgcaactgctgttccctgtgtctggaatgttctttctctgatcttcccatgatgaatgccctttcatctttcagatctggagtcagttctaccctcagggaagctttccctgaccctccgtatcaaggtacctgcaccccagtatgtggtgtgtggccttcatagcctgtttatgctctttaattatttcattttcattattcgttatttcattcccttccctgtgttcctttttttctgtctctctgagaatgccagctccattggcagagaacatgtctgtcttgttcactgctgtgggcctggcccctagcaggctctcagtacgtgtttatgggatgggcacactagatgagatggaagaagatgtgccagtgatgtggagacagggagtgtgggagaggagcaggtagagctcagagacggtgcacttaggcctgtggtcattgggggtgacccaagtagccagcagctgcccagcgttttgtgtttctctcctgggtccctaggagtggaatttgtgtaagaacaatgtgtgaggttgtggcctgcggggcagtagcagttgtcagaccggtgcctggaagtgtttcttggatcaggaaatcaggactgaaaggggcattaagtttgtctagaccaccctgtcattgtgcaatggggagatcgaggcctttgggaggaaaggccctgcttaggggcgtataatgagtcagtggctgtgttgggccttgaacctgccaaagctggtgctttctccactcctcagtgctatgcccaagtgagggtctagccagcctctcccactttcctcccactttcactaagcacctgctctggtaggcccagtgctgtatgctgtgaactcaggctggttaggtgctaatttattcacccagccagacattctagtgtctcctgcatggcaggcactgttcgaagtacttcgtgaatgaagagacaaagcaccacccacccctcgtcagtcctgtgggaatgcggtctgccctcactctctaatgcatgaatctctcctacacgagtatctctgcctggtaattgtagccagagaagaacaggcaggttttcccacggtggctgcctgaatctctgaattgagtattatccccctaaggctgtagttggtggaagaatgctgagattgattggagatgcctgcccagtcagaggaggggtagggtggcacgtgagacattgatttgttctccctgctagcctaggctcttcatcacacatactcagtgactgagcccctgtgttactaccatggcgccggaatatgcatcaggaagggccacccaaacctggggttgtgtgtggcttaaggtgtaaaaacagactttctaatagtaaagactaccatttggtcaacatttctttgtcaggctctgagccaagtgatttatgtgtattaatttattaatttttcttttcttggagacagggtctcattctgttgctcaggctggagtgcagtggtgcaatctctgctcactgcatcctctacctcttgggctcaagcaatccttccatctcagcctcccaagtagctgggactacaggcatgcagcactacccctggctaatttttgcatctttttgtagagctggggtttcactgtgttgcccaggctggtctcaaactcctgagttctagtgatgcacccatcttggcctcccaaagtgctgggattacagataggagccaccatgcccaccctttatttattaatttaatgtaatctttttaacaacctcatgagagagatactcttattattcccactttacagatgagaaagctgaggcacagagaggtttactggcccaaggctgcctaggtggaggtaggcagtagagccaggaagtctacctgagtctgacttctgtgatgcacttactcaccacgccctcctgcttcttggtgggaagggatcagttaacacgtgttacaggagcctgtttgggaccagggactgtgctgtaggctggaggcctatcaagaaggtgggactctggaggagctcacaggcaagtttatagactctgtgaggaaaactaatcctttgaaagaccaacacactattacttacatagtgacttgatgttcagtctgagaagtgaattatatgttaaacgtcaagagaatgttgttgggcccagtgcggtggctcacccctgtaaccccagtactttgggaggccgaggcgggcggatcacttgaggtcaggagtttgagaccagcctggccaacatggcgaaaccctgtctcaacttaaaaaatacaaaaattagccaggtatggtggcacacacctgtaatcccagctactcaggaggctgaggcgggagaatcacttgaacccaggaggtggaggttgcagggttgcagtgagccaagatcatgccactgcactccagcctggacaatagagtaagactctgtctcaaaaaaaaagagagaacattgtcagtgtggtggccttagctgacaccactggtgatttgaccacggccaggtgggatttagatgggtagacactttgtagagcattagagctcatttaatccttcttcagatggagaaatgaagggcctgaagttccccaaagtcagaattagattagacggctctgagcagaatgaccttgaaggacccccagccctccaacgtgggcttctacccccagctatgctatggcacactctgctactacgccagggtccgctttcatcccagcgccttcctcttggcctggaacacataatgttatttctccagagggcctctggctaaaccccaaaatcaacagcatgggctgctacggaattagtgttaaattgagggggacaaggagaggttgtgtttctgatcttaagaaacaaccgaatgtggtttggtttacttccctgtaacccaaactgggtcgattttacaagaccagtgatcccagcacttgaggttaatgtcgatctggtgtgcaggttacaaatcatgtagcataactccagccaaaccccacttattctaagggtcagggaggctgtggggccttaagtttggaaaattctgaaggaaatgcagtttttgtaatcaagtaaatgcagttacagacttggtgtaataaataattgtatgtaaatatatctatttttcttttgtcagctgaggattttcagagctggaaggactgtagaaaatctagtccagccctttcattttagagataaggaaatctggggtagaagaggttaaagggctcattattttgttataggttgcccaacaagtgaacaggatcttgtagacaaggagattggggaggagaataagaaaaaatcaaatctcatccatgcattccacaaatatttactgagtgcctgctaagtgcttggcactgacctgggtgctggaggcacagcagtgaatgaaacagacaggaatccctgcccttgtagagctgatgttgtagtgggagtagagcagctgtaataaatacataaaatatatgcttgttagatagtaacaagtgttgggggtggggaaagcagaagagattgggagagccggagacagtgttgcctctctaatttgagcattcagggaaggtgagtcatgaagaaggatctgaaagagttgtgggggccgaagcaggcagtcatttgggagaagtgcattccaggcagagagaacaacaggtgcaaaggccctggagctggagtagcagcaaggaggccggtgtggccacggaggcccttggagaccgttgtcaggactttggccattcctctgcgtgagatcaggagccactggggagtttgaacagagaagtggcataatatgatttggttttaaaaggatcattctggctgccaggaggatgagatgtgatgataggtgttgccaagggttcaggacagacaggaccttacacagtaggcttagagctgagtttcttaagggctattttttttttcaggcctgaggacttcagttcagcaaaggattatgtgtagcctgcatccaaaaatgcacagcctcctgtgtgtttcttggatggccccagagtggagcagctgtactcctgtggtccccattctccatgcccccctgcaccccctgcctggtctgtcaggcatcttcctcaccacctctccagccctgctaagggccaagcagcctagtgcagaatggaagagcccagactgcctggattcagattctggccctgcccattgcctgattgtgtgaccctgggctccttacctagccttcctgcattttggcttcctcatctgtaaactggggattatattagtacctccttcatagtgttgtcaatgacgattaggtgtaataatatatatacccttagcacaattcctagttcaaagcaggtgctcagtaaacatttatttttattactaccatggtggattctggttcctaggaggagataacatggggtggcaattgattccttgtagagcctggacattggagagagggctggagggagggatgacggtgatggagctcttatttgttgaaggcctaccatgatccaaatatgtgtcttgtgtcttatttgatcttcccagcagccctttcagatagtgattggcatccctcatgttcagagggaattgaggaatagacttatatggagtcacccagatggtaaaatggctttcaatgtagctaagtcttgttctttaattaagccaagatttttcacgggtggaccattttatctgataaccacatgtgtgtggctgcataattatttatatcttcttcttgtttaccattttggttttcagcagcaaaataaaagtagccctaaacaacgcaatttcctttgcacaaaatttcacagcaatacagattgagtattcctaatccagaaatccaaaatgctccaaaatccaaaactttttgagcaccaacatgatgctcaaaggaaatgcttattggagcatttcagatttctgggttttggattagggatgttgaactggcacatgtagtggaaatattccaaaaactgaaaaaaataaattaaaaatccagatacttctggccctgagtgtttcagatgaggagtattcaacctgtagccagcccagtgctagtcaatgaacagtatggtattagcagagtgaattatttgagaacggggtatgttttgggaggtatcttcatcttgactctagatttatgttcctgttactggagttcagatttcatttctagaaatgtatttccagaaatattctcaccctaccaaaattcgggcaaagtttgtccacaaaaaaatcctaaattgcaggttgaatgggggcccatgtacttactccaaaggggccggttgcttttttggtgggcagagttcactctgcttaattagttaccatttaccattcaacctaggctctgtaaataagagagattcttgaaaattcatatacagtcttaggtttgccctctggagacagccacagaaatgcaaaccacaattcacgtccatcaagatccgtgagttgtttgtgccaaagggcacttgaactttgggtggtccagcaaagggaattggtgggggtctctagggaactcagtcctcccaatcagcacatgccccccacatgtgcttcttgagcaaagtaagaaagttcttcttgtgaacctgtggctgttagttcagagtgttcagaatcttgccttgtcctgaagcacaatattgagagtgcgaagtaggaggacctgacctagttgcttcttgaggcctttaataacagaggcccttgatctgagaaggcaacccaggaaatttgcacaacctcaccatctgtctggctctgctgacaaaagagaacatgctcacccttggctggagcaccttccagactccatgtggagtgtgacagttaacagtgtcgggacacctcaaacccaccttcttgatcactcctgcctggctgtcctgcagtggacttggctgcagtgtgggtctcccgtctctcctcctcactgctgcatggagggtgaccttgtcccccactccttttgttttcataggagctaaaaattcctcctctacttccatttatgagtactccactgacagcctgtgagctcatctttttcatggttaacctaacttttcacattttgtctggtgtatttagtaggggtaggagaaaagaactaactaatatgcattgagttcctattagatatatggcactttacatccatccatcctttaatcttccagagtatccttagtgtggacagggtatggctcctagcaacgatccctgcatctgctttgtcatccccaagcaccttgtaaggactggatcatgtagttaaaagagtcctgtgtgtgtgtccaagggcagcgtgcgtccaggcagtgagcaaaccagggctgagttctcactctggggtgttggggcaagagctggttggttgtcacgcccctagtgctagagactgcagggtggaggggaggagggcagttgtaatgccaggacggggacagcaccatggagagatagcaaagctatgtcagcagctgggcagcactgggcatcagctggcgacgtgggcaggaaggtggaggggtcacagttctgctggggcgcttccttatcctttcattcctaggagaagatggccagaggagttggaccttggagaattagaaaaaggagtagttgctaagtcatagccttggcatgaagtaatggtgaacagagggagtgtgtttatcctttgtttagacgtccagtgtgagggcttagggatggcctcgctctttagtggttgagctccctgacttctggggtctgcataggacctcatgtgtgcaggatggtctttgcagggtggtgggtctctgcaggacagcatgggcccctcattggcctctactccatacctgtctgttggggatattctatctgggagacagagaggtggcccctcagagaacagtgtacattgctaattggtcagaattgcaccattgccagacccattggtaaacgaaggtagcgtgtctgtttaaaatgccattaacactgcttctccttaacgtcctgggcaaccttccacatgccacagcaccctcaaaagaagttcccagctttaactgttgaaccccaccctgctaaattttggagtttgtgacttgacaagattgcccaagactcttgctttcccccagtctaggtttaacttaaccaggaaatttactgttaatatttaaatcatataccatctttgtgaactccaatattacctaacgttgtggctgactgacaccgtacaatgaggaaaattaagtgcctaagaattatctccaactaatgatatatttatgcattgtaggttactttgaatttctagactgttaagagttgtttaataggttaatagttttaatctattaatctaatcttttctacttgactatttattaaaatatatcagtgatacatgacagaaatggaagtacagatcattttgagggttattaaggaacaggtgatgatgtgaggatttgaaacttaggcggaatagtaagtaccaggcatgggcctcgctcctgtcatttgcggacactgtggttctgctccatgttctctctctcagctctcccaggctagtgatgaagctatgacctttttcccacgatggcttctctccttgtcactaaaagctggagactctttatgtctgaaggacatgtttgagcacagcagcatttgaaaacacatcagggagagagagaggcaggtggcaagcgcagagcccaggcgcctttctctgtggaagaggtgggacccttcattcctttcctttatttcatgtcggtgtgacttttagcatctaaaatgtgcccagttctgtctgtatgctcaggaaacagcaaaaaacaagggagtatattccctgtgtcttgggacttctggcatttagtcatgtatgtgttcattcattcaacaggtgtttttattattttctcttgagaagagaaaacaaaaattatccaaatggttaaaagcctagactttggagtcagacagacctggtggaattttgattctgtcactaggaagcagggagactgtgaaaagtcactctgtttctccagtccttggttttcttatctagaaaccaaaaaatcccatatcaggcattgcacagaaggatgagatggtgtaggtgtgggcccggagcaccgccccagcatgtcataagcactcattacaccacagctgcccttggcatcactctctgtgttatttgtgccatttgcatcatgactgtcctcaccagcatcacctccaccctgcatgctggtgtgttttgtctggtcattttctgtttgtgtcattgagcagaccttagctgacacctgccagaggaccaagcacaaggatacaaaaagcagtgggtagagccctggtctctggaaatcttccagaaccatatggaattaattagagggcagatttggagttctaacagggcaggagcctgttagaagcaaagaggagcgtttccagaaccgctggtgggagaatgaaggctcctgaactgttagtgggagcagccaccctgtcgccttagggcctgagtgtatgctgattggtggtcatgatggcgaccctgcaccctcaagagagaatgtcaaggtattaccaggctgctgtatcttggcatttcagaaagtgggaagagtgtgttacattttagaaatttttcatcagttcatcagaaaggataaagatataactttgacactcaagaaataagcttcacttattcagaaaattggcttctgtgaaacatccctaacctatgttataataaaggccagatgaatgagtcattcttcagttctgaatattcagtgaagcaggaaaaccatcgacagttacagtgatgttgatggattgatcacagaaaagtcttgcctggatcagaggctacaggtgcctccagtgccatgctggcattgacctttcctgggcttggtccttggttcacttggtaaacagcctcttgctgaccatcacccatgtgccagccactgctctgagtatcatgaaccaaggagacaaaatcttgtcctctagctcacgttctagttgaggaaacagacagtaaagtggacagagaggtaacagagtacaccgagtgggtaaatactggggaaccataaatgagtttcagccaaggagtgacatgaccttggttgctctgtccagtgtggattccagggcagtgtataggggaaagggagattggctgtgagatgtttacaagacaggagaaagggggggtggcttgaactgaagtggtggtcgtggtatggtaaggaatggttggattctggacatactttgaaggcggatctggctggatttgctggtatattcatagtcgggagtgacagaagaggaagagtcaaagatagttctagagtctgggcagcaggagctggaaggttggaattactgttagctgaagtggagatgatggtggttatttgattgtattgtcttagatggcaggttttagccagaagagtgctgggctaggaagcagaattgttttcctctcttgggagaagagatgtagcagcagggttttggacttgttaaatacgaggtgcctgttaggtatccagatggaggtttcaagcagttgggggtttatgcaggtctggagttcggtggggggccagtccaagctggagatacaatttgggattcaacaccatgtagttaatatttagaactaaagagtctagctgtatagtcccagctacttggaaggctgaggtgggaagaccgcttgagcccaggagttcaagaccagcctgggcaacatagaaagactctctttaaaaaatgaaaattaaaaaagataaataagaaataaaagtacaagtctccatgagatcgcttaggaaatgagtgtggataaaaatacaataggttctagaactgatccttggggcatatcaagttgtaagagctggagtgatgaagaggattcagcacaagagataagaatgtccagaaggccggagatccaccaggggagcacagagcaaagtgagcaaccagctggatggaggagaggcaggccatgttagaggctgctgctagaggcagagtccgacggggactgagaagggaccactggattgaatagagtggcagccactggagaccttgaagagaagctgtggtggagtagtggaggcaacagcccattggacttaacagttattaccaaggagccggcctgccaatatcagcaaatagataagaatcacttgcactcatatagtcagtgagtgggaagtgggtagagttggaggacttggtcagtgggcagagtcctgtctggatgtgtgttaatgcatttaacatcccatgcatgcatgcattcatggagagtgtatttaagctcagctggagagcagttcaccttcattcctaaggagtggagttttattctagggggagttaaccaagtcattatttacacactgtaattagaggcttttttctccacccttaacattgttaaaggtgggtgaggtgtgagagtaaatggcaccctttggaggaagagcaggggtcctcaggctgagtcttgggacgtagatgtacgccttgctccccctctgtgtaaggagacacacatgtcttgctgggtaaagttctggcctgtgtaagggccttagatgtctctgatccctgctcactcattgtgcacattggaaaactgagtcttggggtaggcagccagcccagggaatcaacagcagaaataggactgaaggccagggtgctgagcattgctcacgtctactatgacttggtagaactcttaagcatcatcattattggcagaatgatgtggaaactgtgcccagaaacaaagccgccatactcccaggcacctagcatcagggcggactctcctctgacatgcctgaaatggcatctctttgggcttcagatccactggtaagttacttggttgcattgtcttaggctgcaagctttagtgacaacagtaccagaacaggagccaaaaagttttcagactaagctcatcactaaaaattgtgtgaccttggccatgcctttccttcacctgtgtgcactgagttctttctgtgggccaggcattgtgctagggctggggatatagacatgaataaaacagacccgggccccgttctgtgccttggtttccccatctggccacggagctcttgtcaatgccaagcatgatgaggtgggcatgagctctgtgaagaactgtcaggtgagacccagagagagagagagagacatttgtttgtttctgaaacctccccgggcagagtctgcaggcacattggcctggccagacacagtagcaggattgagcaggaacaaagcagaagaaaaccaaaggtagtggaagatagtaatttacaaacttcactgctttggagctgtttcttcaaatttcatgttacaccatgtattggttgcctatggctgcttttgctcctgttgcttcactacaatagcagtttatacactccttggggtcagaagtctgaaatgaaggtgttggaagagtgagattccctctgaaagccccaggggaaatctgatctttgtcactgcctgcttctggtggccatcggcattcctcgacttgtggccacatcattccagctctacctctcggggcgcattgccttctctcctctgtaacttctcttctgtctgtcttaaatctccctttgtcttatgaggacacttactgcatttaggggctactcagataatccaaggatgagcctaatctcaagatccttcacttaattacatctgcaaagaccctttttccaaataaggtcatatgcacagaatcaggagattaggatgtggacatatcttttagggggctaccgctcaccccaccacagagagaaagaggcctaaatctgtatacatcaggcaaaaagcaaagctgtgtgtattgaagatggggagtcttagagccttgctcaacactaccatccccattccagcctcatgggtgcatctaagagccattgctatggaacccctagaccttcaaggaacatactttgagaatcattgccttagagaaaggccagctgtcttagggaacttcttgggcagggatccccttggtctggcttctctcctggtcagcttgcacaattagtaaccggtgaccacggatagcaggtacttactgaaaaatatccttttaatgtttgactttggattttatgttgaagtgtgactcgggttaaatataaaattcatagcatatcttgagcaactattttgtagttatctatatataaatctattttacagcgacacaaatagaatagattatggagtgtcagcatgtagatagattccgagtgctttttcactaatatacctaatgattcgtgctgagaatatccaagggctccactgtacatttaaatggatataattaaaataatgagctctattttaaaaaatgatatatgaaaaaaaaattttaaagaagttagaaggagctgcgccactaactcaaagtgatataagtacttatgtgattccattgttattaggacacctaattaaatgcaaagcatttgagaaaagcaacatttgggtttgtaaatctaaagcctagaagtcgggggcgaggggaagagaaggaagttgcccatgcctttgtcgcggcaaggactcgggggcatcacgtttaagggagtggatggttatgtgctgttgtgcccgtgggtgatagagggtggctcactggtccccatcttctgtgaactcagtcaggaatctggctggtcacgcagctgcagctgtatttgccagtgtgaactctgatttgtttggggtgggagatgtgggtacaagaactagggagaggctgccttttcatgggaaaaagacattcccctgtgcctgactctcagctccaggtgttaagggcactccaggtgacctgagactctggtggttcagtggaaagaacaaaggatggggagtctggagatgcgagttctggttttgactctgctacacgtcctgtgcctttggatagggcctctcctgtgatgcattcatgcctggccctgttgcaaatgggtgaccatccattctagaaacccatctcaaggatatattctgctgttccagtgggccccggggagtcttaggaggcatatgtcccagtgcctgcttactagaaggcaggtatccttttggtcattcagcaaataccatatttatggagcacctaatataggcctactggatgctgggtataagaggcgcacaacactcccgagggccccacctactcttaggacaagtgcagtttggtgagccagtgtacaaagcattttcaggtaacagggctgcaaaggaaataaaacaaggcaatgaactagaagctacactggaatttcgggaaggggacgagcgagtcaagatgagttcattaggacacaatgggaggatggctgtcagagtcacctgtgcaaggaagacgtggcattcagagagggagtctgactctgcctcaagcaagccaggaaggcttcccagaggtgaggatgtcatcatgaaccaatgtcatcatcatggcagctgccattcatggaaatgcactctgtgcccacccctgcagctagcaagagtcatggtccttctttaacagacaaggaaacagaggctcagagaagggagtctcttgcccagggctgcagggtgtaggggtgggcagatgagagttccacccagcctgcctggctcctacagctcctcccttcccctaccaggatgccatgatggtggtgaggacttgagagcaggaagggacactgaatcttttcaggtggcatggtcaggtgctcttgaggcctcgggctgagtttcagaacactggctgtgaagaaagccgaggtaagggagttctgggccgggggccccatctgtttcctctccttccatctctttgcctactgagcctcagggccctgaccattagcacccatgaggtcttagctaggaaatgggaatgtcagctgctttctttaccccccggcttgaatgtgaatacacatcgttcactatcagcttcatcagcatgaccacctctgcagcactagacaaagtccttactccctcaccgcctgtatcccattactgaacagtggtagagctggcattcaaaccctggttggtctaactccacagcccatgcgctaaacacctatgccacataaacttgcatcttctgcacatgcccctcccctgcccgccataaaaaagacaaaggtagataacaatgaaacatctccactgggagcttactgttctaggtcctacgtagacattactttgttttgcctcacagcactgtggggtaggtaccgtgtttgtccccattgtttggatgtgaagactgaggcttggaggagtcaagtcacttatgtaggaacctgcaactggcagttttgagatttgaccctaggatgatccaacttccaagtctggtgcttggcccatttcactccagccaggccatcagccagtctgctccagtgcttctcttgacggggagctcaccacctccaggggatccccttttcttgttggccagcagtaggaatcacctccctctctaaagccacagctgtcctcttgtgacgtgctggacctgccagttctagttatgtcttaggcctcacagaacttgagacttctttgccttgtggtgtcctgcagctaggcgggcccgtgctcccctctggggggccagggggactcttgctcatgatattatcccccacaaaggtggcagcagcccggaaagccagggaacctactgtcctcctgctcacccacgagcatcttggttttggctctgttctggatgctgaaggtcaaaggtgggtgatgtggggcagcctcggctgtgggtgaggaggcttccctctgcgagtttgtctcccagtccaggctgcctgcatcaggtccccgtcccacctcgtaccacccacatgactttgggtacgttatttcacctctcagtgccacagttcctagactgtaaagtggagctaataccaagatttcgttcctagagtcattgctaaggatgaaaggaattagtatgttagaacactgccgggcacataggaggctctgtttaagtgtttcttaagtaaattaaggaaatgaattctgaggcgattgaatcatgcagttttacactttcttaccgtggagaagggcaaaagctcagacagtgtctggtggccctgatgggacagacacatgaggaggaggcgcccctgggtgccaaagaagctctaacagtgtgtcattattaacaatggtcgtggtgaccatgtcttgagagcagttccaggccaggcgctgtgctgagtactttccatgtgttcgttgattaaaatctgcatgacaaccctgttacctccattttgcagacggcgaaaccaaggctcagaggttaggtggctggcttgaggcccacagcgaggaagtggttggcgcgatagcccttgctcctgactggttttcccagcatgcccttgcactcgtgttccgtccatctgagtcctggcctcctgtatgagtcatcttgggctgctgttaacagaatgctgtgggatgccatgcctaatgccataggcttaattaaacaacagaaatgtattttctcacagttctggaggctggaggttgtgattaggttgccagcacggttgggttctggtgagggctgcctcctggctgtagagggtcgccctgtcactgtgtcctcacgtgggggagagagcaatctctttcccttcttacaaagccaccaatcccctcatgaaggcccctccagtgtgacctcatttaaccacacttaacctcccaaagaccctttcttcagatccagtcacactgggggttagggcttcaccatctgaattgggggcacatagttcagtccatagcacctccccatggccttcctctgtcctctcctcattagctgggggctcccctctctatctttgctcagtttcccaacctttctccaccttggatgaaagctgaagctgggaaggacagcagatgtgattaaacccatgctcctgtgataaacagggctgttgaaacccaaagaagagaaaagtcttgcccaaggccacacagcaagcccattgtagatggaggactggagcctgggtccctgagtcccagtccagtggccctgctgtgctgcagttggaatgctggcattctctgttttgagtctgggccttgaaattcacagaccatgctctcctctggcacagtggagaggctagcatggccagggcagtgtctctgggcctggaacatgactcgatttcccagtatgtgcaagcctcagcttccccacctcacagacaacagtcatggggatgcttcccttgtcagaaggatgtggggcccttaggatgataacatggacagctgtgttgaaaggaggatgcttcaggagtggatggcagggacctggcttcctgccttggcctgtccccaattttatgtctggcctgagcaagtcacagctctgctttagtccttagtgtccccctcatgagggacgttgagtgacccacgccctgccctcttcagaactgacatcattacctcgaggatgttttccgatgtttaaagagccccctccatgccacagtgttggctccatgacatctcaacctagtgagtctttttgaattggagtttcccgtttgtaaagcaggagcggggaagagcctggacaagatcccaagccttcttgcctaggaacgaagggaacagcactggatatcgcgtacatcaaagcacgaaacccttaccgcccaaagcgtagtttgaggcccagcagccctggccccacctgagagagcttgttagaaatgcagaatctctgagtgaggcatggtggcatggtgcctggagtcccaaccactcgggaggccgaggtgggagggtcgcttgagcccaggagtttgtttgtgttctgcctgcgcaacatagtgagacccatctctaaaaaggaaaagaaatgcagaatctcaggccctaccccagaacagctgagccagaatctgcattttttttcaagatcccccccagctgatctgtatgcacactgaggtctaagtactgatttcagccagctggaggtgcccttttaggtcacttgtaactccagttatgataagtgcaaacaaataagtggcaagtgaggcaactgggcacatctagacctcttgagacctcagcttccccaactgtaaaatgggtggagttggaggctttcttgctcaatggttttcaaactgtgttccttgaagcctcagggttccctggaagagcctcaggggtagccgtgggggttgtgtgggaggctaagggggccgggggccctagaattcactatgcacacagcctggcatgtccctgtggtgccatgggctggtgggctcctgtgttgatctggaggaagaaggtattgaacggagtttcttctttcccagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttggtgagtgcccagcgtctgtggtcagggtggagaccagggtgggaacatggagtcagagtcctggggaaaagcggcctggcgcctctgcccccttcctggctgagagaacctttgctggcttccctctgcattcagggagagatctcagcttcttagacttgcctttgcttgtgcagtttccggctggagagcgcttctgtttctgctgggcagcagaaccctatccatccatcaataccctgtttaagtcaaatgcctggaaccttccgggggcccagtgaatccctttgtctgtctcagggctcccatacccctggggggtctcccacagcccttactgctcggtgtcctaaatgcctctctgctggagatcccagtgccggtgctgctcagagcagtaccccatcaggattggatcagtgacagatggcacttcccctgcctcttctggcctgggccaggcccagaggagctctgtggaaactcacatcttagcaacaatttctctccctccggtctccagcatgcaccagggatacccctcaggggccccctgcactgctgccaggttcacagactcaaatgcccatgaggcccaacaaatatgtttatttagcataaatagagatgagccaacaggacaggtggtggggaccatgtccagttagagaaggcacgccgcgtgtgtggagggcggctgctgctcagctgctgcactgacggttgctgggtggggatacggctcagcgttgccacatctctggacaaatcacacgccagaaatgaacattttgatgggaattcttttggctttaaatgttgcaaccaattgaccttttgaaatctgccaaacaaaacatgtctgtgggtcagagtccctgtgggcacaagtttgcaacccctggtctgtgacataaagtcctcattcctggcgtggaggccttgcctggtctggctccagatttctgcttccctccactccctactccatgtttccaaggctcagtgtgttcttagaagtgctgctgctgtccaagcctctgctgccttcctggtccagctctggctcacctcctactgacttccaagcacctccatcttcctggcgcacatcctgtatgcggcaccatggcctcgtttctgcaagtttagactcaagtcctggtgccttttcttcccagttgttgagaatcatccttaaactccctttgccagctgttccctgctggttgtggccatctcagccccacctgggtcatggcagcatcctgctaacagccatgcttttgcagcttgcctgccccctgccctggctgccaggaggccttggccaaaacagaacaccgaccatgttgctcccctgcttataccctgggactccctactgtctctagagtcgaggccagagcattaagagcctccataacctgaaccttctagccccatttcttgcttctggtcttcccagacctttcattccagtgtagtctgctcttcctgtactttgtgtatgctgttgcctctcccaggaatgccttcccccatttccacttgcccaaatccaacctatccttcgaggccaactccagtgccacctcctcccagaagacttccttgatctcttctggtgagagtgggctgtttctaccctgctcctcagttggtgcactttctactttctttttagattagaggggccctgtctgtgcctgcctcttccatgaaagtggaaacccctagagattggggctccaggacctgcctgatttatgtctccatgttccctgcttccactctgtaataccaaacaaagtattggtttctgggagtggtaatgttgacactggtgctgcagctgtcaaggtggggccaggttatgctgcagtaacaaaagatcctgaaaggtacaagatatcttagtagctcaaaaccacagcagtttatttcttgttcacactacacgtccattgtgggtcaagagggacctctgctcccctctggtcccagactaaaagctgtcatgtagaatgctgccagccaagtgacagagggaaagcacgctgtggagagacttacgctggcaattaactgctgcagccagagagagaggtgttaattccgctcacagtcattggttggaactagtcacacggccccacccaacctcaaagaggctgggaaatgccgtcctcccatgtgacagaataggggtgaaccaggaatgtttggggaggcgcaggagtgacttaggccagtgtggaatgagagagtgagtcttttcaggggcctgcgctgacgtttctccatcagtattcactccctgaggccagggactgtgttaatcactggtggatttgttagttaatggagaagacctgcacttgctctctttggtatctgtgtgtgttaagactcattagacccagtagctgtttctgcccttcaccaggagatgcccaggaaaggatggttgaatctgaatcctgggatagagccagcagtctggattcagtggggaaagctctgggcagctaggccagggaaatgctgggaatcttccttaggccagctgcctgcacagtgagagccccaggacccgtgagcctcatgccagccaccgatgctgattccagctgagctgctgctcagcagcagggtccttggcctcactgtaccttagtgtcctcctgtgttacatgaggcatggcccctgtcccggccacctcatgggcgtggccatccaaggcggcagtggaaggaaacagtgttgcctgaggagaatgagctgggatccttggactgggagtgaatccaggctccatgacttaactggtgtgctacctcaggccctgtctgtctcagttcttacaattatgaaatcatcaggctatctgagtattcaatgagataatgtatgtgaagtgctcaacattgtgcttagtaaacaagtagctagtattctcagtactactaatattaacagtataaaatgcctcttcaagaggaagggatagtcattgtttctgctttttcccatctaagaagtaagctattgtgatatattgaaacgatgggatggggaataaagtcggtgcaggataaggtattagaagacagggattccaagtgggcttcagttttctcccctgggaactggactgggaaacctgtctggaccttggtgttccttctagtactgcttccctccaattcagggactttgaggatcttgtaatctgctttgggcagacccctgtgaaaaagatgtagaagccccagtgacaagggacgtgtggagctgccatggtgtagccctacggaagcagggccagagtgctccctgctgtcacggcagctcatcttgcatgctggaagtcaggcttttctgcctagggatgggggttttcttccaagggtcaggctcagaggaagctggcttggcctcatcaccaggaaagaaaggcatttaaaaacaaaatcagtgttagagttgaaccttttggactcctctcatctcaagatggcaagtagattttgtgggttaagtccaagcagttgctactggctgtaaggagttctctgttgaggattctaaagggtggcatgattgattgttggtgtctgccctggatgtagaagtgggcagtggagctatgcatgctgtcaatttggtacccatgacctccttattttatagaggggcagacaaggcctgaggaaaggatgagagttgcccagggtcacccaggaagttggtgacattttctttcgtgttatgaagggcctaccacaacacctacctcctacctgcttctgaaagtgtatgaaggagggaaagctctcccagggacctggctggggtggggtgctggttagagcttgcttttaagtgagcccctgctgcagtgtgcattcgttgtcctggtcaccgggcatgggggagttaacgtgttcctggggcacttggcggggagtgctgggtgctgtggtgcccagggcctcctgagtacttcgctaacccagcctcgctccgggctcagagacgggctctgttgctgagtagaagagtgttcctgttcagtcacccagtgctgcgccatgagggagcctccccgagtccacactggccctttaatagccatcagacaaacaatgttcccagtgacacaaacatcatccaaggcacttcccgtgggggagcccgggtcatggacacacagatggcatttggcagcttctcctgctggagtcaggaggggcatcagtgcccaggaggctggctgccaagttcgcaatggttgctgctgcttccctgctgcccagagaattccctgtgctgagaagggtgtctctcactccgagaaagaaagtcactgccattggagctggtgcagggtttgggggcaagaccaagagcttccttttatagtaagaagagcagagatgatagatactaaacttaataactttgctggataaaagcagaaatgaaagaaaggaagttaacagacgcctgcacccatctgacaggctgcaggaacagctctgtacagcagccccaagaaggaagggcagaccacacttgaggtttcaggggctcctctaggaggaggagcaaacacaaggcactaccattgctcctgccgtgccaagggcctcctgaggacttcgctcacccagcctcgctccgggttcatggcagtcccatgttcatggcagacactgcgaattgattactgtacattgtccaatgatgcacctcagaatccttctcaacacagtatgccaagaggtctctgccagtcagctagaattgaaaaattagaagtggaaacctacttgccattcttcttgatgaagataaggcaagttgggtttacaacagtgagagcatccagcccttagactatttcctggctctgagagataaggatgcccgcatcccattatggtggtccaggtgtactgttaagcagtgggtactctttcctatgctgtgaaaccactggtccttaatcctgaggtgtttactaatgagggagtccagggagagcagtaggggcccagagacccgagacttaactgagtttcctcagtagcagtgcaggagaccgtggagggaatgagtgacccagacttgacccctcttcagatgagggacagggaccaactgggttattccccgatagtggagacctgaagagggggataatggaatctaaatattcacaacttacagcattttgcaaggtgcgcatggagcagacacattccagggtgtcctagccaatacggagaagtctccaggaggggatttcaactcagtaaaaggaaggacttcgtgtgatcatgggaactgtttggtaactggacataagcctgtgagggagtgagttccccgtcctgacataggtgatcagggagggtcactggacaaagtgcaggagcgggagtcaaggatgagatagatgggagactggattctgcaaggatgtttctaggcagcaagctttcaggaccgaggtacagaggtgttctcacacacatagggcagcccagagagccaggaaaagaggaggaaggagctccaaccaggaggcagcagccaggctatggcgctggaaggagcagcagaagagcttgacagtcattcagacacagccacgtgggtttcagcctgtgacagacccaggcagcgtaggtgccaggtcctgcttcatcgtgccagctgatagttcgtttcctgtttcaataggttgttggcagggcctcacacaagagcctgccagaaccaacactcagctctttgctgcagccactcggaaaggaggagttctggccaccctcccaggcgcgtcctgtctctgctactgacgcttcctcttggggtctgaagggttagagggtccctgttagaaagggcccttgggctgtaagtcaagagcccagggtttaccctactgtggggacttgaataagccccttaacttctctaagccaccgtgtcttgaatggtcagtaggtagaataaaagtctgcccctctttccagtagaattgttgggggcagagtgacgtaataggtatggaagtgtttttaacgggacaaaaaacgtaaaaccagtaccactgctattagctggaacctcaggacattgatgcctctggggttacctctagagtgacaggaacctaaaaggccaaggttttcaaacatttgtttttgctcaatacctcctaaaagaattttgaaaactgtatattctttttcacatgtttgagttgccatctaacatttttatccaaagtttaaatcattgcaaaggatataatttccaggatattgtgtaaaaaaaaaaaaaaggtggcattttggaaataaaactgtgaaccaattttcaaaatgtatccaagggaatccaaacactaccactatttgatatccaccatcatcacttcaaaaacatatgaacaagcctatctttaacagtcagaaattttacatctttcctttttctccttgagctcatatttccagtccactgcccccacagggttttatcctaatgtaaaatatattttttatgcttgaaagtcttttattgatcactgtttcacactcatcaccataacaagatgtacataaattgaaattgaaatttctaaaaaaaaaaaaaatttcctgggatcataaagctctacattctccaacattttttttttccagattgagttgttattagcatacaattcatcaaaaacaaatttaggtaaatagtaaatgtaaaagtaaaaaattattgaaaatgcatctcttaatgaaatggatagggcttcatttctttctcaattggctcatgtatctctgaattaatatttcttattgctagaaggagacaagattcgacattaatttaattcctatcttttggtttttgtaggtctaagtgcttagaaagctcagtcacatatgtaagtagctggcagtggatagagttttgttttagcagtgtcactcaattctttgaattccttccaagttgtatgccagaaatcacacaggggtctatcatcagatgatatttttaatggtctcttcgctgacaactccattatatcctcctctaattttgttgagagcagagagttggaagtcacccgattcaaaaaaggagttgttcctggtcattagatccactcactttctgagcccgacaccagtattgtagggtcacctctttgcttggagccccagggttttcatctcttggggcaggcaccgtggtaggattaggggtgggtgaaaggatcgtcttttgtttgtaacgtggcacaagggtgaaggtgagagtgggaagaaccagcgagtggggcctcccacctgccagattctctggcacattgattttaggaaagaacacatttagaagctgatgattctcttaaggctgtgtggacctacttaccccttgggcagccaccacacacccccaggagatttgtgcttcactcagaagaccctgctccagaggacatttggtttgaggccaagccccagagcctcaggaaacccacttgtccatgacttccctgttcagatcccctgtcattcggcaagccctggacccagctcctgttgcatgtttgaacagagagggctggacacactcctgaacatttgttctctgaacagtggctcctgagacgctctgagctaaatatgggactgtccattgtaaggaaccagccttctgtccctacccttgcgtttttcttctctcattcaccagctttggatttctatcttgtcacattttgtgtattgtgaaaggtgcccgagcttctctagacctggctgggtgcaaagggttgctaccccacattctttctcagaagcctgcatcctctcctaggcatcttcccagcgtccccctctgtgacttcaggaactagaccccctgtcctcgcctggtctgtctgatgctctgggagggagctaagccaggtgtttagggaaagtgctcagtgggagctgtgaactcggattagttgggatggcgactgttgcatcacttgtgatagcaggaatgggaagaggaaaagtccgctcctgcctcctgtgtgctggcaagccctgccagccatccctgggagcagtcccagggctctcaatagggcactctggggagtcctgtggcagcaccagacatagtggggggctctgctgccctgtagcatttaaggaaagtgccatgactgaaaggaacacacagcttgcctgacatccagcaggtgacctggggtggtggcagtagcatggctctggatccccaaggcctactttgagcccagttccttgccagccactagccaagctgatgctcatccttgcgacggatgttgagttgccagcctcatgaggacttctgggaagatggtggacggaaatgagacctggtaaaggttctctctctctctttcttttttttttcttcttcttcctcttctttcttcttcttcttttttcttctttctttcttttttttgagatagggtcttactctgttgcccaggctggagtgcagtggcataatcacagctcactgcagcctcgacctccagggctcaagtgttcctctcacctcagcctcccaagtagctgggactacaggtgtgctccaccatgcccagctaatttttgtgttttctgtagagatgggggtcttgctgtgttgcccaggctggtcttgaactcatgaactcaagtgatctgcctgccttggcctcccaaaatgctgagattcaccgcgcacagcccacaagcaccatttcttcctggtgctttccaagaagctagttgtgtggcttgggagcaaatcagatctgaccgacctctggtgctattcgttgcccctctggtcctcactttcctcatctgaaaaatggggataataatcacctttacctgctggaattgtgaggatgaactgagctggtgtgagaaacccctgagccaggaccccgagcccactaactggctgcatgaactgggcgaaatgctgcacacagctgccctagcctctgcttcctcacccatgcagtggggcagaggtcagtctgcatggaaacattgcagatgaagtgagcccagacaggtggtgatggtgatagccatggttcatagaggaaaaaagtggctgggatgaacagaagagggagcgtgctgggcagggagccaggcgtcggggctgaggactgcctgagctgagtccccaagaaggccctccttgcaccactgcatcagtctgggtctgtggtggccacaggccagggggatgcatggacactgcacccgtggggcacatgtccttggagggtgattttgctggagggtttttgggtagaaattgtgtgttctaaccatatgttgaatcagaatatagagaaaacacaaaactgaattcagggagctgttgacccatggctgctgtattctgccatgtgccagcctccctggggaacatgtggatgccccttggccagcacaaggtttttaacgaagaggtaggcagtgtgatcttgtccacgcttctcaaagtgcagccaacttcgccccttccctaaccttccaggcattctccaactttaagggctctttctgatttcttacgtaattcagatggaaaagcgcccgaaggcagcccccacggtggatctgtgcgaagccggtattcagggacctggatttttgaccaagcattgagatatgcatctggtacgtgatggccaaggggtagtgcctgatccggggccagtatgggtgggggcacagctggacacagccatcagttacagacctgagtaagcaggcccctgttagcatctcagggtcaagaggggccaccttcttcatcccctgtcctggctacatgtgagcaaatctgactgggaccctggaagtactggactactggagggacgatagagcatgtggaaatctggacgcctagaatgtccagagcattttggcagcacttcctatgggccgcaactctgaaacaggccaaggggacaaaagggttccaagccaaatgtgtttgggagaccctgggttaaacagtagctgacctctctccctgcaggacttcgcagggcctgcggctgcccctgtgcagtggcctccccaggacaggccacgccacgaggtctccctcatgcactcttggccatggtcctctttttgctggggtgcattcaggaagttgggttccaaagaataaacttcggaaaatgctgctagtaacagcagctgacctgtatcgtgtgcctgctgtggaccaggccctgtgctaaggagccaccacgttatccctcacaacccgttcccctgaggggtgtacagtgttacagggaggaaacctgaggtgtgggtggttccatgacttgtccagggctccctctgctgggatgtggtgagccagggtttgcacccaggtttgctggcatcactgcactgagggctgcccctctagtgaactctccccatgccccacctctcacctccctggccccatcacaaaggggaacctgaagcccagagtcgggctgagcgaggcgcaggtgggggccctgggctttaggctgtgcgaggggcaggcggggccctgggttttaggctgatcgaggggcaggcggggccctgggttttaggctgagctaggggcaggcggggccctgggttttaggctgagcgaggggcaggtggggccctgggctttaggctgagcgaggcgcaggcggggccctgggttttacgctgcatgaggggcaggctcagggtccctcctaccagcacacagtgctcagtccagagactccgtgtgccagacaggctgcctcactctgcactgggggtcaggagccagccgaggagaggctgaggagccatcatgccccccatgactccttctgtggggtgacacctgcaggcaaggctgcatgtgcccacagctctcccacagcttggggtgaactccatactgcctgccaatcaggccttgacttggctgtaaacagtatctactccactgacttgggccccccactgcagttgggccagggtcctgcctctgtgcccccaggccctgcacttgctgccctaacgccatcatcgtgcgttgtccctgtgccagctggcctgtctgcttcctattagatggaggacagggagcacaccttgctcattgctggggcctcagtgcccggcacattgcaggcactcgtaaattcttcactggttgaaggggaattggcagaaactgctgaagagtgggtggaggcagcaggaagagagttggaggcattattactcagtgacagatgagtacaacagcaagacaccatggatttatggagccctcgctgtgtgccaatcacagggctaaatacaaagaaatatgcaatctcatctttgtcctccacgtgattgtatttttccctgtgtgacaagggtaatacacatacaaaccactaaataacagactcctaaatcccacgctggtgttaggatgacagcggcccttggagtgacccacagtagtaccagtggcaccggctcctgttcctcagtacctgtggtgtgccagccgactcacatgatgaacctcgttgatacagacctcagtcatgaattgtaggaatcagagtccggttttgcaggtggggaaacagaggctcggacaagtgaaaggttgtgtccgagatcaaaaaaaggatgtgtccgagatcaaacagataagacaaacttgtccagcccacggcccgtgaccgcatgtggaccaggatggctttgaatgcggcccaacacaaagtcataaattttcttaaaacattgtaagtctttttgtgattttttttttagctcattagccatcgttagtgtattttatgtgtggcccaagacaattcttcttccagtgtgacccaggaaaaccaaaaggttggacccccctgagctaagggatagcagagctgaactaggcttcagactccatatccagtgctcttccagcttcacttcatgcctcaggtacacactcaggaaacgggcctctgcttccaggcaagacaaagggagtaggagttaatgatcttcacctgcacggaggggctggtcttgtgctgggaacactcttcatgcaaactcagtcttcacaccaacacacttgagtcatccgcatttttcccaggaggaaattgaggcccagccagtaaatgacagagttaagactcttatcccaggtctgcctctcccatccccagatgctgggcaccagaattccctggggaccttggaataggcaggtctccaccccagccactctagatcgctaagcctggagtgggccggggcctctgcatttgtccacgctccctggctattctgttaggaagagcaaggcctgggcccaggtggcatcaggccttcatgagggctgatttagatggggagcaggcagggtttctgcccctggggtccctgccaggctggatctgaggggctcttcttggcttcctaccatgggcctttgctctgacctctacatgggcaggctcatcttttaacctctctgcagtgctcactaggagcttggccatttcagtctccctgctcctgggagaagggcctggcaaggggctgggggggccaggcatttacaccatgtcggtctctgtgtgtctgagggaacaagacaactcctcagcaggtgtggggggcggtcctctccttgctgagcctgtctagagtagggctgggcacttcctacagggagtatatggccacccctacgaggtaggtgcatgtggtcccattctgcagatcagcagactgaggcttcatgcatctaaggaaattaccaaggtcatgctgctggtaagtgacagaacagggacagggacccaggtgtgtctgattcagtctgtctgtcttaatctctgtcccattccggcaaggaaaaggggttgctagaaattattgtaatgcgttgaagtaatgatttccttatgtggatgcaatttattcctttcagagcacttttaacattcatttcctttttcccctcaaggtgtagggctgagaattagctgaagaagttaccttctccatcttacagatttggaaactgaggcccagagatgggggggtgccttgcccaaggtcacccacagagtggagggcaaacctggatctagacccaggcctcgtgacttctagctcggtgctgcctccttgccagggaccatctctgcccctgggacagagagttagccacacttgtaggcatcgcctgtgggtcctgggaccttgtggtcacagaggttgggtgaccagtcctttcctcttctgttttccagggtcttacgaatgcggaatctgtggcaagaagtacaagtattacaactgcttccagacccacgtgcgggcgcaccgaggtgagaggagtgtccctggggcagagcccaggggccgcacctcccactgtctgcctgtttcccacttgggcccctcgtgggtgaccccagaggccctgacagctccagcctttcccattctcctcctactttcatcagtaggacagggtgccaggcaggagaagggaggcctcctgatgcgggacagctcaggtgtgggagggggactctgcaggacacaccagacctgcgcccaagggcaccccctgctccccactggcctcacgcctcccaggacatctcatcactgctcagtgtcagtggcccccacagggcacttgctgaggtcagtgtgtgtgttcctcatgacaagcttgggagttgcagacaggagggatggcgtctgttcctcccggagcctggcagacagggaggagaggctggcatcaggggcccggtgcgggactgtgagctcttcccctgtggcttccatgttctcttttgcacttggcactggccctgtcattggcccggtagccccacccccatccctctctctctctctttgcagacaccgaagccacctcaggggagggagcctcccaaagcagtgagtactttttcctcctcgtgggctgctgaggggcgagggcttggggtgggatgaagaggagctgcttgtcccctcccccagaactgctccaggtggcctctgagagacacagtgctggggtccaagcttgggggccagaccatccttacaaaaccgcaatgcggtacctcagagcagcccttcccaaagcgtgctccatggcaggctcattctgggaaggttagtgggtgttctgtccatgacgacttctctggccaagtaactttgggagaccttgagtttcactaaggggagcaggtttcttgtggacatttccagcccttcattgacagacacagctgtgcatctcccatgggtgccctggatatgcgggtccttgtgttcttttgactctgactcatgactctggggctccgtagttgacttttgggaaatgctgctttggagagttttctcctgagcccccacagccaggggcactaattgcttattggtgatttgccctgaggtgccatatcccagcacctggggcggcacagggccttgacatctgcgacagcactgctgctcacaggccctgcttgccatccctccagttctaggccccaagcgcctggtaagtgagcagccaagctggtgtagactaggatggaatctccccacccaataatctgaagcttcagaagtcacagttccacgtgtaggtatgtcgccaacagaaacgggtgtatatctgctgcaagatgcaaactagaatgtccttagcacaccattcctaacaaactagaagcccccaaatgcccagagctcattgaatggagaagtaagtctagtgacacaaaagactactgtaaagtagtgagaacgaacaatttatagctacacacagcaacatggatgactcacaaacaatggtgagcaaaagaggccaggcgtaaacagagttcagcctctaagattctgcatagagaaagggcaaaagcagctaaaactaattattgccggtagaagtcagaagagcggttcccctggggaaggggcttcagggttctgtttcttgagctgggtgctggttacctgggtggtttcagtttgtggaagttgaacaagctgtgcacttaggatttgtacactgttctacaccaggggttagcaacatttttctgcagagggccagatggtaagtattttagactttatagcccagacgtctccgtcgcaagtattcagccctgcccttgtagtgggaacatgccaggaacagagataatatgtaaatgaattccttaccaaaacagatggtgggcaggatttggcccacagactgttgcttgccaatccccgttctatgggtttgttacaccacaccatcacaaaaaaagattcttaacataataaataaacattaccaccccctgcccaacaaaaccccaaaccagagcagtttgaagagatggcgatggctgaaaaaggattgtaactggcctgggtcccagtagcatttcttctaagacactttctcatccactccgtttggattcttatgccaaaggagaggccggcatgttccagagagaaatctgaggcccaggtcagctagacacctgccacaggaccccagctgggaggaggtgggagctgggccctccccctccagccccgcctttcctgccccagccccagcctcagcctggtccttggctcccatctccttcaatagttccattcttttccggctcccatggactggctgcggtcagccacacatttaaagaacttccctatttatctttccttcctcagctattctgggcccctggcctctccagcagcccctcaatgatctgttgtgttccgtctggcttccgttgtccgcgggcttgctggttgctgacggctctgtagcgggggtatttttagtccttccgtcacttttcccttcctccctgtggagtttcctccctgcggccattgcgcgctattttattctcagtcctgcagccctgccctgacccagactggcagcacctgcttagaacgcctggcctccacttacagaagcctggccatggagtcatggagccaaaagggcccaactgagaagactgagtccagcccacccattttgcagatgaggacagggagtcatacaggttgtgagtagtggaggcgggcctagaaatgaaatgaggtctcacacattctattaacagttctaggacttttcatttatttattaggaaaatagtacagtcatacatagaagcagacagacatattcactcatccatctgtccactaaggaataaaagattagcccctcatgctactgtcacattgatatttgtgacagtattaggttacatttggcaagtatttattggatgtcccttgtgttcctttattctttattataactataggaaatgaagaacctctcattcccattttacagatgaggaaaccgaggtgcagaggttaggcagcatgtctgaggtctgccgcacttatacctggtagagttgggtttgattaggcagcatgaatccagagcctgcctccctgaacggattcacagtggcatctaagagacaccgagctctcgtgtctgaaaatgcagcggttctgaaaacgtgctttcactgacaaaaaaatgattctgctctcctttttggggataaccctcttggcctaatcatttcctgactgacgaagacctgggagcgggctccccatccatgtcaaagagatgtcacggtgtcagagcagggtgggggtattctcagcagcagaaacctgggggctcacgttttattggaggtaacagatgtggccctgaagtgaggggtcaggcccagctggccagggaggctgggtagagacaagcaagtgggcaggtggcggcagatggcgggtagcagtggtcagcttaggagaggaatgtcaaggcagagcccagtctggaaccagaccccaggtggccttgacttctctgtctctgttcctgggcaggtgtcctgcacagaaggcagggttgcaaaagagacactggggaccatggtctggacgggacctgatggggaagttgtctaagttgattgctggctacatgaaaggattaaagcctgggccaggcacagaatcctagaaccaccatcctgggagaggccccaggaatcagctcatctacatccctttcccagctccccaaattatgggggaaaacaaggaagcaggaccagcctctcctgccccacaccttgccacctctttcttggatgattctggtatccagcatcctcagaatgtctccaaggaacctgtggctccttgctcagggaccagtttgtgtctggggctctggcacctgctaaggcattttcagagaatacgaagaggtgaagctggtggtgggagggagaggtggctaatgccatttgtgtccctaagttcagaaggtggggccagaaaccttcccacggaattacctggcagcgtaaccttgtggtagaggattgcatcagatcctgtatttgggttctgagggacaggagggggaccaggagagaggtaccccaacccagtactgatttgcagcttattcagacagagaagggccacatgccctgactcagccttagcttggagttagtgaatgtttgaatcctagctctcccttcccctccccacaccgggcagccttgagcatatcaccaagcctccctgtgcctggggtgatgggattgataggccctccctacatcagcccaaggaacacacacatgaggttcgtgccagtgcaaacgttagagtgtgccattgtggagggggtaatgtcctgtgtccagcctcagcctcagatgttgggtagacccaggggatcatccaaactccaacctcatgttagttacctattgctgtgtaacagatgtccctaaaacttaatgactggaagcaacaagcattgattatccctcagtttctagggtcaagaatttggatatggctttgctgggtcctttggcgctgggtctttccctggctgcaggcatggacttggccagggctgtggtctcatctcaaggctcaactggggaaagaactgcttttaaactcactcatgtggttgctagcaggtttaacaaccctgctagggttctgtccttcccacactcttagactgaaggcctcactggctgttcaccagaggccaccctcagctcctggtcacctgtgtctctcatggggcagctcacaacccagcagccagcaggtgtgacctggacagagaaggtatgcttgagacagaagtcccagtcttttgtaagctaccctcagaagtgatattctgtcacttttactgcattctgttcattagaagtcagttaccaggtctagtccagactcacagggaaggggtgatgtagggcatgagcatcaagaggcaaggagccctgggtgctgtccccaaggctgctcatcaccggccctcccggctgtgcccttggggcaaatcccttctgatcctcagtttcctcatgtgtaaaatgagagactgcttcctccctccgctagccagactgggctagtttcatctttggtttctgagatgatctggccagaaaaaccccaccccacaagactgaagccctggtaaccaggtgtgtgttttcatcccatgcagacaatttcaggtacacatgtgatatctgcgggaagaagtacaaatactacagctgtttccaagagcaccgagacctgcacgcagtggatggtgagtcaggcccctcactccctggagtcatgccaagaggcgcccttccttggagacaccagcccccagccctccccgcctccctcctccctcttacccagaaaaaggccaggcagtagctggaaccatgaggggaatgaccagccctggaggattctgggggcgggaacgtcaccatcatactccacatacacttctatttaggttaacccaagtgaaattgccatttttataggtcaaaatcagtagaatattggaatttcgtatcgagtcattttgtagtttcatattgagcatttgcatgttctgattaaattaaaccggttttaaaaaacgaatgatggccttttagcatcttagattatacaattagaaattagaataatacatttagccaacacatatttgagtctcaaaaatcctagaaagagggtcttagaccttggaagggccttaggggttccccgtctagccccacaccttcagcccatcttgagctgtgacaaccaggcccaccacctgttaccactggcccatctcttttctcacctcgtctttctctctcctcccaatctcttcctcttttctcctgccctggccccttgaacccatgatggcaatcagaaacagatccaggcaaactgtctgcctgtaccatggatgggtgcccatcctagtgaggacgagggattgaggcccaggctgtgtcctggttgggatgtatcctcgtgttgtcctggttttggggggcttccacagtggccacggcagccctcctgggccccaaggcaaacccatggggataggggctgggagcagtggcagaggcagctctgggcagggactaacagggctcctgtttgtttctttccttctgcggctgccgcctcctgcccgggcgcagtgtttagtgtggaaggggcccctgagaaccgggcaggtaagtccttggtgtctgcttgtcacctcccctgtccccggctgggctcctgagacctgggggaccagggtgctaagggccgtgtgttctcccacagaccccttcgaccaaggtgtcgtggccacggacgaggtgaaggaggagcccccggagccattccagaaaatcgggccaagtatgcgggattccctctggggccaagggctgggtgggggctggccaagggaggcagggctcagtctcactgctagggcaggggtagcagtgggtggcatcacttaactgcagcaatggtgcccaacctgtcagttgggccagtcagtgttaggactggagctttcgaggagcagcagggcagcacagggtcaaggtcaggacagtgaaggcagccaggctggggctgagtcctggcgctactgcttacaggcttggtgtcctcatggtctgttagccatcctgaacctcagcctccccacctgtggagtgaggatgacatttccccacaggtttgttgggggattaaatgagatcctggatgtgaaccacttgttagcacagtgcctggtacatagtaggtgctcggaaaataacacgtcgtagtcacctgaaggggcctatcagtgaatgagctgtccagggcagccacaggcagactctctgtctctgtcccaggacaccccttgagggcaggagccacacacgtctggcctgtttttgataaacttgtattgagtgttgtgggcacacagctgagaacaggacacatgtggtcctgcccttgggtaattcagatggggcttgggggtggggacagcagatcattgaacagatagttccaacatagcttgcagggagctgtgggaggcctgagggaatgctggaagctttcagatggggacgagggtaggggatgagccccagcatcccatgccaaggctggagagccctgctggtcccgaaaatcgatgatggcttcaggtcttacagagccttgaatgccagcaggcagcatcctcaggagaatgagccagagagtttttactaagtggagaagggacttgatccaatttgcattttaggaagccccattttgctgctgggaggaagatagattgggaggggctgggtggccagcccagggcaggtgccgtgggaccacaagtgagtgagacttgtcctttccagctgttcaggaattgccatacctgctatttatctctctgttttctgtacctcacttactacccagcaagaagagacctttatggtctctgcttccttccaataaggatctaaggcagcttgtaaaaatatacacaaaaacagaacaagcagatgaggatatctgagtgaaggaaaatcagaggagctgaaacactaagttggatacgttcctcagggcagagctcgatcccagctcttggaaggggttgggtgggttccctccccctcccccaaatgctttttcttcctcatcccttgtctgtggtcatgggatgattctttgctttcttcttaactcttctgaaagcattcaggaaactgaagatgagataatgtctataaagtggtcagcacagtgctgtcacatgcatagtaaacactcgataagcaggagcataaaaatcatcttaaagatgaagaatatggccgggcacggtggctcacacctgtaatcccagcactttgggaggccaagatgggcggatcacctgaggtcaggagttcaagaccagcctggccaatatggcgaaaccccgtcactactaaaattagccaggtgtggtgacgcacacctatagccccagctacttgggatgctgaggcaggagaatcacttgaacccgggaggtggaggttgcattgagctgagattgtgccactgcactccagcctgggtgacaagagtgagactctgtctcaaaaaaaaaaaaaaaaaagatgaagaatatgatgaaaccctcagtgctcaaatacgagaagttagacggtacaggggaaacacagatgtgaatcaggcatatttgcagcattcaaagaattcaggctgggcgtggtggctctcgcctgtaatcctagcactttgggaggccgagacgggtggatcacaaggtcaggagattgagaccatcctggccaacatggtgaaaccccatctccactaaaatacaaaaattagccgggcgtggtggcatgtgcctgtagtcccagctacttgggaggctgaggcaggagaatcgcttgaacccaggaggtagagcttgcagtgagccgagattgcaccactgcactccagcctggtgacagagcaagactccatctcaaaaaataattccaaagaattcatagtttggtgactatgacagacattcataggcagatataggacaggaacagaggatctgtgacctccccgttgagtatctatctaggatctggcagtggtcccagtgtactgctgctcttccaaccgtgtcattttccttaggaagatgggctttgaaatcagacaggcttaggtttgaatgctgttgtcaccagcttactagctccctaccccttgtgagtatcccataagttgcggacaagcacatctctgaattttccagtgctgttggagcacacacacacaaaatgtctcaccaagcacctggctcatatccaaggtgtagggagacctgttactgagaaagagtcaagggcaagagttttagagccaaccgaaataggactcccagctcgacacttaatagctgcatgatgtcctaccagttttctaatctgtctaatccatagtttctctacctctaaatgggctgatgacaataaaactcacctttcaggattgtcatggggcttagatgagattatatttgtaaaagaattagcatagtccttacacatgcatgcaaagcattaaataagtggtacctttaattacccaggaagatgcagaacaagatgaagtgtgttctctgtatctgtaactaagtctgacagacagccaacgccaggacctgggaggaattaatcaaattattaggagtgtagaattgcattgagaatatcagactgggtctggctgccagcgtgctcccagctggactgaatggagctgagattgctggtgtggtgtgagaccatcccttgctgccactcaggagctgccttgtgagacaaaaacgttgcttcttcggctcctgctacgtataagcaggccaatgccacagaacgcgaaaaacgattagccagtagaggcacacgtgttctgaagggactgattgcccaagtaaagctctgtagtcagaggaagaagaaacaccctggcaggagtgagtgctgggaagtacacctttcacatcagcatcagctgagcacattagagaattaggtacttaggttggaagaagcccaggcaatgacagagcagagaatcctgctagaaaagagagagttggtccaagaagccttgtgggttaactcgctcttcatctgcatatccaagaattacttccatgataatgggcagagggagaatcaaggaaaactcatttgtgtggtctgttgaaacagagtaagtctggagtcatgtatgggttacttgatttttatgcctgaataaggaagagtcacttgaatagttaaaaaaaaaaaaaagagagaactatgtaaattccacataacaagaaaaagagaatttaagagactcagagaagagaacacctgaaaatgatctaccacaaaatctagaagaccattctgtttgacaacctccatctcatgtaagaaaatatgaccttacacatccacttaggctgccacaacaaaatattacagacggggtggtctgaacaatttatctcttacagttctggaagctggaaagcctgagatcagggtgccagcatggcgggtttctgttgagggctctcctcctggcttgcagatggtcaccatatgtctggacatgatggtgaaagagagagagagcaagctttctggcctctcttctaataagggcactaatcccatggtggggaccctacccttatgacctcatctaaccctgcctacctcccaaaggccccatctccacatgctatcacattaggagttagagtttcaacatatgaatttgaggatggggacacagttcagtccatagcatgacccctgtgaaaagggagccagaagttgtatggtgaaaaagcaacagaataagaaagcaaagagagaggagtgagacgaggaaggatttcagggaagcagaaaacgtaagaacagaattaaaacctacattctatgtagtaaagagccgagtttatctgcaaaattggaattagtgatgtgaaggatgaacttgaacagatgaagataatgagaggaaaatatgataaatggggagaacagggagccggtttcagataattgatgttatagtaccagtggccagaaacagtgctcctaagatctaatagaagaaaaatttgcttagctaaaggaagacctgtatatgcagatttaatatctgcataatcatcatgtatcagatagattcgatataaagagacctgtacctacatagatctcagtgactttttaaaactataggaaaaaaaaaaaacctatataagcattcaggcataaaaaagtaggttacctatacatgaattcaaggtggacttgcctcagacttctctgcaatactaaatcttagaagataatggataagtgttgaagggaaaaagttgtaatctaagaattttatatctagacaaattgtggtttgtgtgtaaagagaaaagcaaggacttaaaaacgtattttttttctgtgtacccatcttcacaaaattatttgaagatatactctgatgaactaagttgtagagtacatgtaaagactcaattgtgagaaattcatagtataagaggaactgtgagtagtaaaacaagataaactagaagttagtttaaaatgttccaaatctgattataaaattgcagaaggcagattattctaaaatattaaaaatgagggttttatttattttttattttttattttttgagacagagtctcactctgtcgcccaggctggagtgcagtggcgcagtctcggctcactgcaagctccgcctcctgggttcacaccattctcctgcctcagcctcccaagtagctgggactacaggcgcccgccaccacgcctggctaatttttttatatttttagtagagacggggtttcaccgtgttagccaggatggtcttgatctcctgaccttgtgatccacctgcctcggcctcccaaagtgctgggattacaggcgtgagccaccacacccagccagggttttatttttttaaaaggaaggaggaattggggagggcttacagtaaagtaggttaagccttcctattcatagtgtggctccagaccagcagagcagcattcctggaagcttattagaaatgtatattcttaggccctactccagacctacaggatgagaatttctccagcaagctatgttgtaacagtctttccagatgattctttgacatgctaaagtttgagaaacactggtttaaactatctttctccatggtgatagacagaaaaatgctatttcccacttgactattaacaattagagaaatatatcttatatactgtctaattgtctaaaacaatagagaaaattggaaaataatggaatatcagagaataatggaaaaatatagagttcatatatcaaacaagtgggaattaaggcagcaatcagaaaaggtggagcatgaacaagacttgtaaaaccaaatcaattatagcaataaaagcaaatggcataatctcctttattagaaggcaaagcttgtgaggttgatttaaaataatccagttattaatggtgtattagagacaaggttaattccttatctttactctgcacttgagcttctctttcctacttccagaactagattaaattccctatcatgggtttttatagcactgcatatgtctccttgagagcacttactgtggatggagttttaaatttgtctgagtgtttctttgattttttgatctccttttgttagactgtaaactccttgaaggcaagaactttgcctgtttttgcttagcattttgtgccagcacttagcacagtacctgtttaatgaatgacagtacgagaaaatatagggacatgtcttcaggtacatgtaaacaaatagatcagggtctgacaaattatcaaattatttatgccagacaaactaataaaacggaataattaaatgttacagcaagctttcccacacatcagaattttctggagggcttgttaaaacatggattgcaggacacaacacctagaatttttttttcagtaggtcttaggtgagtcctaagaatttggatttctaacaggttcccaggtgatactgatgttgctggtccagggaccgcactttgagaagcactgtgttggaaaatagttttatgttactaaatatagttcacagtgaagattttgatcccatgagcttttaggtatcaaacaacattgtttccaaatatacaaaataaatttagaaatacagtgaagtggaaagatttatcacaatatttagtctttgacagagcaagtagacaaacaaggttgtatagaatttaaataatatatttaatacagttgatgtaataactgaatcctaccgagagcaagtaacttaccatttccaatgtttatgaatcagttacaaaaattatttaactactaaaaattctatagcaggagagaaaaaccataaacagactaataaaccaattaagaacaaattaattttaacacatataacaaaatgttgatatccttaatctacaaagagtttagccatttcataaatgtcaatatgcctgtagaaatgctggctgtaaacacaaaaggaaagtcacaaaagaaaaacaatagttaattaaacatgaaaaataatcaatttccttagaaatcaaagaaatggaaagtaaaatcagtgtaatatagttcttctcatcagataggcagaatgtaagaagatgataatacttaatgctggctgtagtatgcataaacagtcattttcatacctttctggttgggatgatggtgctatgattatcaaaggccttaaaaatacataccctttccctctcttgaatttttccacaggaaataatgtgcaaagattatatggaatagcctttattttgtgataatgtgtaaaattaatgggtgaatgtgcaaaaatttctataaaaacatgagtcacagcatttttcttaatagggaaaaaattttgaaacaatttcaatgtcccttggtgtaggggactggctcagcaaattccaaagtccagtgggaaccatgcagccaatagatgcagtagagatcaatatttattgattgggcaagatgtccacaaagtaatgtcggttgaatacaccagattacaaagaggatattgatcaggactggctaattcagggctcacaggagccagacaggtgttatcagtgagagaagcgcaccccagatgagacagaatgaagagtggggaccagggcaccctcccccaagggggtagatgctgctctttgtttgggggttacagatgattgaaatttctctttagtttttattctgtatttgtatttatcagtattttataattttcccccagtgaacaatattacatcagacatttttaagaagaaagaagttaggcagtgccaaaagagaggtaaagataaagtcgggtgggacttgagaggaagaagtgacccctgctgctagtgggtggggggtgcttgggggcagggaaggtcctggagatgaggggaccccgggtgtggccactgcagagggcagggcttgcaaaggggctgacgaagaggttggtgttggaggtcagcacacttcttgagcaccgggtctggggtggagcgatgtgccaggtactgttctaagcacttgccatctaaatttaatcctcacagcaatcctacaaggtggtcctattatgacctccgttttatagataggaaaactgaggcacagagaggttaagagacttgcccgaggttacccagctcgaaatgtctgagctgggatttgaataggggtcttctaactccagagtcagaattgattctagttgatggtcccagaatggggaggagttttttggggggtgggagcacgctgatgcttcttggtggaggccagttgcacattcttacaccttcgtttccttcctggacagaaactggcaattacacctgtgaattctgcggcaaacagtacaagtactacactccctaccaggagcatgtggccttacacgcccccatcagtgagtacctcctcccggtagggatgggggttgggggacccgggacagggtgggccagccgttggccaggcctctggaatttggccaggaaatggtgaaagcaaggtgagctcagttctgggtcagtctttaggtattatgtctgacccagggccacctgtctacagtggccggcatagctgagaagtccccctcttaagccagagcagagtccgagccctcccttagtggactcagagtcctgtgcccacatgattggggtgaggagggtggacatcacttgtccaagtcctgctgtggccctcttctaggtaccgctacatcacaaggtttatgaatctccacccccaaagccagttccgcatgatgcagcttcagtctgaacagatgcatgaaggagcccgggctaggggcgtggttaactggacaggaaagctccctcttggtccttgatggtgggaagctaaggaggtggcaggaaccctgagctgggagtcaagccctggctgttaatcccagctgagtcccaggcctgcttgtgacctggggcaggctgcgtcctgaccctggaccaccatctcccactctgactgggaaaggaaggggctctaagggcccttcccacagtgacatcctcaccttccatcctcctggtgcccgtgagcctaccttactgatttcccagctccttttctggatatttgaggggtctccatcctcagatccccgagtatatgagctagggggcccatcagcctccctctctttcatgtgcaggtgcagaaaccaaagtctgacaggggtggggcttgtgcagtctcagggcagtagggctggatgtttagcagcgtttttggaagtgttgctggttttgtttctcacagcagagctgtggggatccctctccccattctgtggatgggaagactttggtccaaacagagagggagggtttacagaaggtcactgggggctgaagccccttatagtctgggaaggcccaggtccctcctagagccctgctgttgggataccaagggtattggatagggagggagaagtattcagagcctggagggtggtgtaggtagcttccccaggaattcctcccctctgggcagagtggcaggggctgaggggtcttcccgtgggtgagaactccagtcctgaggtcgagcactgggctgagattctcatccctgcttgcccctcactgctctgtgaccttgtgcctgttgctttccttctctgggctcttttcccatctgtgaaagctgtttaaggtcttttcagcccaggatctggattatagacatctctgacatgaggtacctgctatggccccactagaagaatccattccacttcccagcctgggctatataggtcattcagtacccgccatagagccagatcttgtgtggagagagaggatgcaggattccactgggtaggcaccgactgtccagttgacccacttgtggtgctgatgcccaggcagcagggctgtggtcgggcttgaacaccatggcctgtgcccctctggagatccagctttccataagcaggtacagggcagccatgtttgttctccagtgaagcagcaactgccctgctccctggtgcccaggctggatgctacccagaatgcactttcagtgaggtgttagctacaaggccagactataaccttgagttcagcctttggagactatcttcagtgcttcctgggacaagttgagtaaggccatggagttagtaagatggggagcttggctttgaattccggcaggcaggctccaggcccacactcaaccatgaagctatcctacatcccatgtcagatggtaaagcagaaaggggtgtgtctcttccaccctaagtttttccctgacagcctggtgcatctctcctgaagggctgtctacttttctttctgtgttcctcactttcttttgctttctattatgaactctctttctttcttcctgtatctgcttgttgaattaatctctctgttacctactgaagtctggggactcagggatcatctgtgtttaaaatacagcatgagagatttagcctagattcaagagagaattatttatccaaggctgtccaagagatagctcctgcagtggcctctggtgttagagatttgtgtgccaatggacttcttgtggaggcaggggctggacttgagggcttcatcaggtggtatccatggctgggacttgagactctgggtctggtgagtgtccataaggacatagactgactgtggaagaatttcttagaattagtgtcatagaatctatattcttttatgtctgacttcttttgctcagcagaatgtttttaagattcatattttatcatattctcatatgtatcagttgttcattcttttttacttctgagcaatgttctattgtatgaaaataccgtttgttagccatttacctgttaatttgggttgtttccagctttaggctattataaataaagctgctatgaaaatgcttatatgaggattttgtgggcatatgtgttcatttctttggataaataccaaggagtagaatgactgggtcatggggaatagtatgtttaactttttaataagtgacaaaccattttccaaaatgaccatagcatctttcactcctgccagctgtgcctgtgagttccacttgctccatgttcttgccaacattcgatggtattggtctgtttaattcagctattctagtgaggggatagtggagtctcactgtggtgttaatttgtattttcctgataactaatgacgttgaacatctttatatttacttattggccacttacatattttactttggaaattgtctctttaggtcttctgcccatttatttggttgggctgtttgtcttttttattattaagttgtaggagttctttctatattccagtaggcctgggttctttgccagatacatgtactgtggatttttctcctagtctctggcatgccagttgattttcatacagcatcatttgatgaacagatgtctttcattttgatgaagtccagtttatcatttttttctattgttagtgctttttgggttctacctcaaggatatccttgcctacctcaaaatggtaaagataccctgttttattatcttttagaagccttgtaattttagctttttcatttatgtctgtgatatatttcaacttaacttttcaaatgatgtgaggtatgagttgagactcattttattccatacagatacctggttgttacaacatcatgtgttgaaaagattatctttccctattgcattgcactggtacttttgtggaaagttatttgaatgtgtaagtatttttctcttccgttggcctgtttgtttatctttatgcctattccacatgattttacttatagctctctagtaagtctcaaatcagctgctcttagtttttcagcattgttattttttaagactatttggctattctagaaactttattcttccatattcatgttagagtcttctctaatttctaccaaaaaaatgcaacttggagtttgtttgggattctattgaatctgtagatcaatttggggagaatcatcattacaataatattgggtctcccaatccatgaacatggtatatttccccaagtatttagggcttgtttagtttctctcaggagcagtttgtacttttcagagaagtcttgcacatatttcattccatatctccaagtattttatggtttgtgacactaccatgacttttaaatttaattttccaattgtctgttgctattgcctataaaaaaatcaatctttgtgtattgaatttgtgtattgcaaattagctaaatttacttattagttctaatagatttttttagatttttttggattttcttttgcatattgatgtcatccacaaataaagacagctttatttctttccttccaatctgtattctttttattttttttcttcctcactattctggttaggtccctccagtacaatgttgaatagaagaaattagtgaatattttttgccatgttcccaatcatagagttcagttttttattgttaagcattgtgttagctaaagtaggtttttatagatgcccattatcagttgaataagttacctcttatttatagtttattaaaagtttttcttataaattgatgttgcatgtttttttcctccatcttttgaggtgattctgtggattcttatattctcttttgttagtactggtgaattacatagacttaaaaaaaattcaccattcctatactttattaaaacacgttaagaatatcagaaagtcaaactgtaaaatgaactgaagaaagttacaacctggggatgattattctttgccagataaaatgacttccttctttgaagcttctgttttttcttaatagggtatatttaagttgtataacttgattatttcatatgtatacattgtggaataaccccacaatcaagttcttgcttaggcatctaaattacttaacgatccaaggttagtttatagagtaatttgtttttaagaacatgttttcctctcacttctatctaaaattcttcaggattttacttccttttgatatcactcccaaaactgtctcctcaagggcagggaaatacagtcctaggattagcagaatgcctatatttaatcagtggtgtgttaatgaaggtcataattaagaaaatgaatatttctggtgaagtttttaaatattgattgaagtatattgtcatataataaagtgcctgttatttaaagtgtacagtttgataagttttgacctatgcatgcacccatgaaacggtcaccacaatctaattaacatacccatcacccccaacagttttctcatgcccttttgtaatttgcttaccacttccccatcccgaggcaaacactaatctgcttcctattactgtaaattagtttgcgtttcctagaattttacatatatggaatcttacagtatgtaagtatatatttttgaagggagaggtctggcttctttcactctgcataattattttgagattcatctatgcttacatgtatcagtagttcattctcttttaactgatgatgagtagtattccatttccagatatacatgccacaattactttgttcatttatgggtggatatttagagtatttctggctagagttctggagctaatacaaataaagcagttatgaacatttgtgtacaagcctttgtaaggaaaaatgcttttatttctcttgggtaattacctaagaatggaatgactggatcatatggtagatggttgtttaacttttaacaacagccatgttgttttccaaagtagttgtgccattttacattccaaccagcagtacaattttcttttcttgtaatgttctcgtctcgttgggtatcagagtattgcaggcctcatagaattgggaagagtactccctcctcttcaattttctgaagagtttatatagaattggtattattttatgtaagtattctatacaattcaacagttaagcttttgagcctgaagttttctttgtaggaaggattatttagaaatatattccatttccaaatatttgggaattatccagattttttgttgctattgacttctaacttaattccattgtggtcagagaacatattctgtattttccagtcttcaaaattcattgagataagttttatgacctaccttatggtctcttctgctgcggtttcatgtccacttgaccaaaaaaaaaaaaaaaaaaaaggcatctcgtattgtcagttaggccaagttggttgataatgctgttcaaatctctatactctttcccactttcttttttaattagtttgtcttaccaagttctgagagagaagcatcaaaattctcaactctaatggtggatttgtctatttccccttttaggtttgtcagtcttcaatttatgtaattcgaacctttgttattaggtacacacagttagcatcattatgccttgatgaattgaccctttataaagtagtgcaatgccattctatatctctggtaatgcctgttgtcccgaaatttcctttgtctgttactgtaagccatgacagctttcttaggattagtatttgcatagtatatctcttttcatcattttattttaatctacctttatctttgtatttgaagtatgtatatatagttggttcttatgcctttctttatccagtctggtaatccctgccttttaattgaaatgtttaattcatttacatttaatatactatattaatatggttagatttaagtttactatcttgcattttttctatttgtcccatttgttcttgttcatctttttcttattttcgtgccttctttagtattaatcaagtattttttaaaaatgcctcttagctttctagccataactctttttctttagtggtttctctatgatttataatatacatgtttcatatgttacagtccaccacgaatttatatcataacacattacatataatataaaagctttacaatggcatacttcccatttactgccctcctgttctttgtgctatttttatcatacatttatgcctatgtgtgttataaacccaacaattactcttttagctttaaacagtaatttgttaaagtaactgagaaattagaaaatgccttttatatttacttattttccattttgtttgcttttctttccttcgtatacatctgaattccatcaattatcattttctttaattcttgaagaacttcctttaacatttcttatattgtaggtctattggtgaaagattctctaagctgaagatgtttttatttcacatatttttttgaaggattttttttctggatatagaattctaggctgataaatttttttatgtttaaaaatgtcattcctttgtcttctggcttaagttgtttctgatgaaaagtcagagatcattctgattgttattcatctatatttagtgtatattttttctctggatgcttttaagtatttcttgggttaatagtttttagcaatttcattatttgtgtttatcctgtttgagattcattgagcttcttggatcatgagtgtacatttttcatcaaatttggaaaattctcagccagtatttcttcaaatatttttctttcctaatctctcttttctctcttgttgagactttaattacatagatatttgataatcaataatgtttacagataactgaagctctgttcattttttcagccttgttttccttctgtgcttcggtttgaatagattctattgccctgtcttcaagttcactgatcttctcttctgtggtgtctaatctgctttattagaaaaatccattaagtgaactttttatttcagctatcatatttttcatctaagtttcatttggtttctttttataatttttatttctcttcattatttttcatctttccttgtcatttctgtatgtttctgttaattggtttttctcttgattactggtcacattttcctgtgttgcctggaaaataattgtttcttccgtgctgcatcctgggaatgctgtgttgttgacttgattttgtcttcctttgaaaagagttttgttctggcaggtagttaattacttccaaatcaactcaatacttcaaaagctggtttttaagctgtgttaggacaggtctagaatagttcttattctggggttagaacagctcttctaaggcatggcctttctggccgtttcttagctgaatgcctgaagtattgagcaaggtctcgcctctctggctagggggaactccaaaatatctcctactcttgtgtgacttttgaatcttcactcactacacagcccccccacccccatcccccattagctgtttttttgctaggctttgcggagactcatctgcacaaatatagtttggtattcagccagatttcaagggggcccatatgcacatttctggagttctttttgttgcagaattctctcttctttgttaatttgccgtgcaaattctagccacctcaaaagccctgaactcagatcactgtctcctttgttcactgagatgtttgggctccacctctctctgccctggtccagaggggctccccaagcagagagctagagtgaccatggggctcacatcatgttttctctcctgaatcacagttctgcaccacctttgtccagctttatagttgaatatggcaggaagctagtcttgtatcagttactccgtcatggccagaagtgtgagttccccagttctctttctaagatgaagattcacgaggaggggttcccaggttgactcctcttgcatcccatctcccattcatctccacctccagcccttgagcacgtgattccatttgcctccaatgcagtttcatcctcctctacctcgtggaagtttcggggaaaccccctggcctctccactcccttgattgtgtggttgcttttcttgaatccttgcattctctaaatttctttgctccatgcattctctaaatttttttggtccagttaaattttcagctttctggaaaggagaccacagtgctctgttattttttagatatctcttgtgtgtagatactgcatgtgtgtttcctacaggggaagtcagccagtctgtctgagactctttcatgctttctcaggaagagctcaggtaggaattccagcatgacagtgttccctgtgaggtcaacagagggagcacactgttaagtagaatgagtcaggagcctgggacattgatcctggcccagcccaacccaccctgtgacccagaattgatagccatacctctctgagcttgagtagccccatctgccttatacctttgggaccactgggaggataacatgtcagatagcttcatggtaccattatgtgccctcattgggatcccatctttgatgtgctcttcttcagcagttctgactttaaatttcctggccgctcacgcattgatacatggattccacaatgtctcttgagcactgtgtttcagggaacgtgccaaacactctgtgcatggcgggcaaggctggcagagttcctgctctcttggagcatacacgctaatggggagagagccattgttcaaaggtcatactgtgtatcattactgatggtgatcagtccttgaaagggaaggcaagaggggactgacaaataaatggtcccagatggggagttttgggggaggcagactccctaaggaagagatttttaagtacagtgtgtaggaccaacagtcaaaagtttgagggaagaatgttcgaggcagagggaatagcatgcacaaaggctatgagcttgaaagagaaaggatattgtaggatatgagaaggcaaggagctcaatggcctgtgaggaagctggagaggggagcggtcccaagcggggtggtcagagcacacaggtgatgccctcaggcctatgataccatgtgctttatgcatgttcctgagctccctgccacagggaaagagggggctgtgtgcctcagaatgccaggatctttacagcaggaattgtagactctgtaacgggctgatccaacggggctcctagagtcattctgcaaggatggagcctgaagcctcagagggaaagcagcttgatcaggctgttgctcagaaactctgttcctgtgtgggtcactgccatggagagcagaggagtgcacggccttgtgccaaaggcctccttgcacagccggcagacttgagccctgtctcatctcagcactaactttgtgtgttgccatcaacaaacttattatgtctgtggccagaataagcctttgggccttgggtttttttaatctctgaaaaataccagtaatagatacttacatttgaagagcagtttatcattcaggatgcttctgagactttcttggattcccataaagtccccgtgagacttgctatgtggagagggtcatcccagtgttggtggagtcgaggggggaaaacaaaggccgagagaggggaggtatagtctccaagattgtggaggccgagggttacagagctgggcttcagaggtggatttgcctcactccagactcaaggctggttccattacagtgaataaccagctgtggtccccaaactctgcctcacacaggaagccagcagtgatattagaaatggactctgggtgcctattgcaacattgaatgtgtcggttcattctgtgggttaaaaaaaaaaattggaaattatgagacaagcaatcacctggtgggactcaggggcctctgaggccctcggctcagaaagagagacagagagcaggagagtaggtatacaagtgtcctttgccacccaagacttctcagttcctgattcaggaagggagagtcccaagagtggcagctcaggtcacaagggacacaagtgttttccgcagactgaggccttgggatttgtttctggggctggggcggacagatgagggcttgtttaagtggggcatgactaaagaactccctgctcccagcacgtggccaccactgtaggcgaggagtgggtgaccctccacgggggagaatgggcagccccagtcctcacagctcaccccatgcaccagtgtggtaaatgaaggaccatagagtggctttttctttttgccactcagttcctctgtgaccttggacaaggccctgcatcctgcttctttgggctgagcttcgccttctgtgccaggaatgagcagaggtggcgggccagggggccctttcatttaggctctgcatacagtgcccaggacggacgctgtcttaggagcagggagataatggggcctgcctccacctgcctgggccaggggagcaacagccaggtccttcgctaggcaggtcagggctgtggccaggcactgagtcaagacagtaccctctggtgttactaattctcgggggttctgtgagcctctggtcggtaccaaagggcccctgcttcctcttgctgcctagcccccttcctgccctcagggagagttgtggattttgcatgatctctgagtctcattcatgagaatgaggccaggttgaagtgtggaagtgtggccaggttcaggggctggccaccactgctaagggttcaggggagggtgaaggaggccaactgatgctctcccaagaccaccagaggtggaaactgctggagagccagcccccggttctcagtgactccagcttctacggacttttcaggtgagggaggcagggggcctgggtaatggtgatgcagggttccccagacagcatccaggaactgctacacttatttcaattaaagcgtcaggtgtcccatgagagcaacagttcccagtcagtgcccacaaggcaccacagagccccttgccctaaaaccttggagggactatcaggcccctctgcctcacccccagccccggcatgtccctgcctgtctacttcctattgtaacttccaagccagccttcctttaaaggaaaaggagcttagaaaccaacattctagaagatgcacttgggcctgggttaaccaattcagatgccctaagagccagtcagtccagagactgggctggtcaagggttatgggtgacctacacagtgggctggttggtggcctccagataactaagcgtgagctgacagaaggttccagactcctggactttctctggctctgagttaagtgagaatccttgttctctgtggcacaagaagaggttggacagagacagtcccaaccctggaatgtggggctggtggcccgagaggccactcactctgccggctgggagggccctcggggactgagagcgtgaccctctcaggtactgcccccgggtgggagccaccggatgatccagacacgggctctgagtgttcacatccagaggtctccccatctccacgcttcgtggcagcgaagacccagacgaaccagtcggggaaaaaagctccggcctccgtggtccgatgtgccaccctcttacaccgcacccctccagccacccaaacccagacgttccgcactccaaattcgggatctccggcgagcaaggcaaccgcaggtaccaatggcctatgtgacccccacactttctcccccactgcccttctcaccacctgccacagctgtgcctggggttgttgttgccttgcaagagcaagagtggcagtcccgtagtgatctgggacaaatctgagtcccagctctgcctctggctggctctgtgaccatgacaagccacctcacatttctgagccaagtcttctcaccttaaatcagagggttgtacaaggaggtttgcaaacttttttttttaagtagtagaatattttttcccaaatcatggcctgaggggcctgttttgacattcttcacaaggtttaaaaaattttttagttaattgccagcttctgaacatcaaattttatgtaaaacttttgatttctacctgacattgaaaagtcaaacctggcagtcctggacccactttcctacaggacaacgattggctgcctccttgagtagagtgtgtgctctccacttttccacatcctcaccacgccttactgcctccccaacacaatggccatgtggcaggtgtcatttctcattgtgatcacactgttgtctgtcttacatccaacccagttcatctgtttctgttgcctgcctggaccctgttggcatgagtttgcatctcccacctttcagaaaacttaatttaaaaaaaaaagtcatttcaacaaggatctgctctgaacaaagcaggataagccggatggttgacctagatctctggtctcttgccctccccctctgtagcactacccgtgaaactcctccatgagatacaggcccagcaggaaatcagtggatgccaccatttcctcagttcacactgcaaaggactctggctccagaggggtaaacagacaataaaaagttccgagaagttatttcctccagaaaaactggccagacacactgtgtgctgaggaccagcagtcaggaattcttagattcacgtttggatggaaccagccctgggccacctgccgggacttgtgggttgtagggcagagtgatgatgtggtgcctctgggaccgcgggcccttcagttgtcctcaggagaccaaagccatttcttaaataaatagatgatcaaggtgagaactcaggtaaaggatccacttggttcattcggtgactgacaacccagccgagtgattaagccgtgctttcctttactcctcagttcaggaggctaattttgggcaagggcgtgattcttcgaagatatgtttattgtgcttagatctcccaaaaggagagtagtcagtcagccttgaaggtttgaaggtcatggtttttcaggtaccgtgttgagaaaagccagtagccgttgtgtttttcaacagtagcataaattagttagaagcaaattggtcatcacggtctcattggtgatagatatcggctccactaaatcatggaatcgtggctttcaaatcttgctttctctcttgcactttgtggctgggagtttttatgcctgcggtttctgcagagggcggcccacagggtgtggtacgtggccggtctccagcttcagtgtctctgagtaggcattcagcaagctatgggacaggcctcaggctgccttcatgtgccttggaagacttgtgggtaggggtcacctctggattcaccagctgagcaggtcagagggcatccggttgggagcaggagcctgcatgggagataagatagtatgtggttgaggaagaaactgtcagtcacctcctggtcctggaataagtggcccttcatgtgtgtatgggcacgtccctgtatgggatttcacctctggtgctgcatgttgatttttcagccagaggtacttgtggcaaggaaagctattcaaaatgtgcattatcagctgagcagtgtaagagtttgcagcctcaattgtggtaagtttaccagcatgctggtcagaagtcctccatagatgagtaccagtcacccaacgtacacaaggatgaagatggagtaggcagtcacttctccacacaaggcctttttcaaaaggaagcacctccccctaaagtgaagtctgattctgccgtcttggagggttaggagtacatccaaccccagtaacttgacaatctcactctttcctctgttttttcacctgtgaaatgggaatgacagtgcagccctcacagggcttttgggagaattagagggaacttggatgtaaagtatctggtccagtgcctggtacataggaggtgctcagcgaatgagagccccccacccccacccctttccctagaccgagaacagaggggccttctgtgccaatttgtagatgctccctgggactctcagcccaggcatttcacaggcacattttgaagggagggttgtccttgtaatgttagctgcagcctctgcaggaaggagcctgtgtcaggagacgttgttacagtgggatgacaggggtcggggggaggtgggaattgggcagggtctgcaggcactgcctctggcttcctttcccattgtccccatgaccatccgcaaccctggcacccacaaactaagcacttgctcttccggagcagggtggaccaggtgagagtggcatttcccaaagtgcattctcaagatcaccaattttgtgagatatttcagaatctaatgttttaaaaatggggttctgtgggaacccctcttatgtttggggaaggccaggttaagtaaatctaaatgggtctgtttgcgggcagactttgcggagcctttgatatctttgggcaaattgtttctccttaagaaatgcactgggtcagctgcacatcccaaattgactggttccctgaggtctttatctctgggatcgtccggcatccccctcatgcctagagcaccttggaaaagctgggctgtcttccagctcggatcatctgtttcaataccttctgcaggtgggggtgggggataaaaattcatggttttccacctggttggaccctatctctgcattgcagggtttccagagagcacttggaagagggtgggcccctcaggtagatggcagcctgtaagcagagacaccccagtagtcactcagggggaacccatcccttccgctgggggaacaactgaccagactttgcctgggtttggcctctgggggtgtggggctacccctgctctccctgtcacgccatctgttgcaggataccctccctgtcaccagggaccacctagctgatggagctggaatcaccagaaaacatgctgtcatcatctatgcacttcggtggggcccgtggcagcagaatctgacagggagtggtgggcggtagatccaatgatttgctgtcacggttgtggctctccaggagccaaagatgggagactcaggcccatttgccatctgctctcctgctggatttcatctttgtgtttttgggcatgtcactcccccggcccccgtgcctgggcctcctgggccctgccaggagggtctcttggggccctgccaagggactaggccactcagagggtcctggggagatctggcttgaggtcctggagccctcacgagagctagttggcccagcagagtccttggccttcacccagcctacccctcccttgagacctagtgctgaccaatcaccattgttttctttctctctcctgtcccccacccagcagaaagcgctttcagtcggagagtagaaggcaaagcacaaaaccactttgaagagacgaacagcagttcgcagaactccagcggtgagtgtgccccttgacagccatcctgtgcggtagctgccagcttcgcccgctcccccctggcagccgcggcagcatcctgtgggctggggtctttgtggtgcattatggatcttgttgggaggaggctgggagcagggaattagagggagaccacagaggcaggaggggccttttcttccagggacattcctctgagccttgggcatcagtggacaatgcctcctctctgtctcccccatggagagagcaacacccctccccatagcctgcggcatcaactcagctgaccccagatgattgggcctgagagagccactgctatgtttttagggtagatgtctcagccagtttctttacaggagaagcaaaggaagtgcagttgagagagctctaagaggccgggcgccgtggctcacacctgtaatcccagcactttgggaggccaaggtgggtgggtcacttgaggtcaggagttcgagaccaacctggccaacatggtgaaatcccatctctactaaaaatacagtagctgtagtcccagttactcaggaggctgaggcaggagaatcacttgaacccaggaggcagaggttggaatgagccaagattgcaccactgcactccagcctgggtgacagagcgagactctgtctcaaaaagagagagagagagagagagagagagagagagctgtgagagccagaggctccaagttctggtctcattttggccctggagccactggaacgaagattcccttccagcccctacctgctcaagtgggtttaaactgaggctctaggtggtctctggcgccccctgacgcctgcctcttccaggaccgcggcagagccctagaatgtccagagcagcagccaaggggcctctcccaccagacccggggtcagcctggggggtgcctggctggtcaccagcagcctctgtccgagcagggcacagcaagctgttctgtaccctgagaggcagggcaggaggggagaggaattctcacattgtggttacattaggggaaggcacccactcactttcttgcatggttgaaatttaattcactacatattaggtgtcagcctgtgccaggcactgggctgggcactactgcctgggtgtggacaggtgacgaacacatcacaactgtcggggaccctctgagacagccaggagcgcagacttgagtgtggaggcatctgcctagtaacaggagctccacttcgggctgttactcacatatgaaccccagctccaccacttactagctggtgacttaggctagtctctgaattcctcctctgctgtaaagtggcttgatgaacacacacagccccgtggtggttgtgaacattcagtgagtccctggcacagattacatactcaggtgttagggttttttggtggtgatagttggtcatttttattttttaagtaaaccaagtgatttgatgactgctttgcggaagggaatgaggttttgaacaacgtaatccacccaacctctccaagaggtgggcctgaaagggatggagtgacttgcccaaggccacacaggaataagtagtagcgccgggctggaaccgaggtctccagatgtgccctgtgctcccagccaagccatgctgcacccccatgcgtcccctgcccccagagctaatattcacaatcgggaacgatagcgcaagcactgctgctgctgctgctgctgttggcagccaccattgattgagcgcttactgtgtgcctggcatgtgttcagagctttatatgtcttatctgtcttcctcctttccacagccccatgggggtcaatgttattgttatccccactttttggagtgggaaactgaggctcaggagaggtggattgctgccctaggtcccccagattataagtggtggagccaggattccccatctagaccatctggccccgctgtgctgcctgctgcgtttgaggcttgccaacctctggcagtgccaggaagtgagggagagatgccagccagcaggagccctccaaagcacagccgctcttggtggctgctctggtgtttggtaccaaacatccccaccctggtgccagaacctagaagtagctgccagctccctgtcctgaagtgagctgccatgcaaggatgtcttctcaccagtactcatgtgtcctcactctttcagagtgtagggtgtcccggagggatggcagtgacttgtcttgccctgcctggtggccccagcacccacagtaaaccttgatcctctgaaaggcatggcctctgtgtcaagcctccctgcaaccccaccccagattgtgagccttcctctcggatgctccccactcctctgaaagccccatctggctcactggttattaagaataaaaattatgactatcagcacagaacagcagaactagaagagatggctaaactgtttctcttttgcagaaactgcaagtcccctgatttccaaccctttccctctcctacagagtaagtgatggtcccgttggggggctggagagggcaaggcagggcagggaaggaactcagccagccacgtgctcctggagcctccaggctgtgtgagatgggccttgggctgccctcccgggcagacccggcagctggtggaggcaggccgaggtccagccctgggcgggtggagcagtttggacggggtggggcagagccctgaccagcagcagccttggctctgctgccccagccctggcaggagctcaggccttcccattcacggtcgtcgggcagcctcaggacacctcttccgagccccatcgcagccgtctttttcttcttttccttgctcttcttcccacccctctttctttttcctcttccttctgtccttctccctcttccttctctcctcctccctcttctctgccaggcactgacgtgagtgctaagagtagagagctgagtgatccaggcccctgcaccccttgtgcctgttcctacgcgtgccctccctcactcctccctccctctcctccctttccgcatcagatccccacttcctcctgcttctctgtggctttttccacttcttacccttttccttcttgttttccttatgtctgttaccttggtttttattcattcatacattcattcatttgttcacttggcaaatagtgacctcatgtggttccagagagagagctggggctgtgacaccctgagactcagtctctgccccaagagggccgttggtctgttgatgttgatgttgtcctccctacccccatctcaagtgcgccgaacagtggctggcacgcagtaagcactcaataaatagctgctcaattgagctaatggtctctctctgcatggcttcctctctccatcattccttcacccagcttctccctcatgggtctagtgacgggggaggcaggcaggctgggcccggagccctgagcacagagacccggtgtgtgtttgggttcccacttgcaaagctgcctgcagcccagcagaaggtgtctgcgtcggttccacccctcacgtggctgccgcatttctccctccagaaccctacacctgcggcgcctgtgggatccagttccagttctacaacaacctgttggagcacatgcagtcccatgcaggtaagtaggatacggcttctctccccctctccttcctcagttcctgcaaattgaagagatggttagggcctgacctgaggcccctggagaaggccgctctttcctggaaaatggtcacaggacatggaacctgcttgcagggagccccagtcagtcagttattaacacaggctggtctgtgctctgcaggtgggggcggtggggaggcagcacaggctctgtgggaacacggagaggtgggacagagttgaagagacttcctggaggtggtggcctcttggctggtcctaaaggccaagtaggagctagcctggaagcgaaatgtgcaggtggaaatggaacatggtttgagatcaaggtgagcagagacagaaggtggggatggagagacatgcagcccaaggcaagctgggctaaggcccacctcagagcagagtctcattcactaacaccctatgtcccagaatgcagttgcgcccaaacctgaggacacatcagaattaccaggagggcttgcttgagcacagatttctaggctccattgtgaatttctgattctgtaggtctgcagaggtggggactaggatttgcatttctggtaagtcttaagacagtgctgatgctactggttcagggaccgccctttgagaaccactgctctagagctacaggtgcagtcatctgctctctaggcagcctttttattacatttcaccacggcataacacaagtctcagggagacagtatgtgctggaataagtaaataattccaaattctcagtggttaaacatacagaccatttacttctcacccacattatagcccaatgcacatgatctagttgggtggcttccacatggtgattcagggatcaaggctcttttttctattggctccgtcctcctctagatcttcagcatcctctctctttgtggatggggagagagactatggggcaagcacacttctttaccatttcagaccacaagtgacacctgtaaatgctcaaattccagtgtggagaattagccacatgaccagcctgaacccatgggtggaagcgtgtccagagccactgtcccgggacagttggccactctgcaaagggaaacgtgagtctggggaggcagttagctgtccctccacccctttccccagaggaattctctagaggcattagaaataatgggtgagacgtgcctgacataatggtgctcagtaattggtagctgctgttatttcacctgttattgttattgtacaaatctttcacatcatctcccaggtctggcctgactggcatagagtattacaggactagaatctcttttaggctaagtactgttctgttagcgtagtctctatcattcattcatccatccagcatatattaattgggtatctgctgtatattaggcatgaaatcagatgatctttttggggagcctattatttatttctaatgaacttaaaatcaggacagagctctggagtggcagccaaggcacttgcctcggagacctgctctaactggtgtgtctgggtgctgtgtgacctcctgcaggaagctgtgtctccatctctaaagcaagggcctgaaaatccccttccccacaccacgcttcccgccccctgctttcctttgctgtcagctgtgcctcaccagggaaggccttgaatgccagctcaaggtgtttagaccccatggggaagcaggatcctcgggctagggacagcagttggcaggctgcttgggaaccactgcctgaacatatcgcttggtcctgagactcccacagcacagccttctgcactcctcctctgaatcctcggcactctgcctgcgccctgccagcttctggaagctgagctgtgattagggaagagcctgggtgccagtgctttcccatccctggaggccattaaaatgcaaatcaggtctgagctttgaggtggccccacctctcccaagcatcttgacttgttttcggagtggagccgtgggctgctttgttctggttcagcgcagccagagaatgcctggccggccatccagcgcaaagccaggctgaatcccagccacactgaatcgggattaaaggcttggctccatagagagaaattaagcatcatgagctgcgcagttcacagcgccgacgataaggaggatcagccttgaataacaccaatctcattatggagctgctgaatggcacagggtaattcccgctaataaacttcctttctgtgctgtaggaaaacctggcgtgccttggtgacgttggagaagcatgctttggcagtaataataccaaagatagctacaattttgtgagtgctttctatgcgtcacttgtggcactgagagctttacgcaggttatttcatcagatcttcctgattaggtagttgacgttttcatccccattatgcagatgatgaaaccgaggctcagagaacataatcactggcccaaagttgcacagctcctaaaaaaagtatccaatagcatttgagcttttacgtggcgccaggccttgttctaagacttttacatatattcacttatttaattctcggaacaaccctcagagttaagtgcccataacagttccacttcatagctaacgaaacggaggcacaaactggttaagtaacttgtccaaggctatgcagtcactgtggcaggctatagataggattccagttctcgcagtgaactccagagcccatgctctcaacatccaccctgtgcagcctcaggtagaccctgatggaaggttagcagagatggaagccctctcagaggtcatctctttcagcctccgcgttaaagtacagccaggaggaccgcagctaagagggattgggagactttccagacagcaagcaagctggcagctcatgggtttaggattttggaggtgaccacacctggtttctttctttctttcttgtttgtttttttttttttttttttcctttgagacagagtctcgatctgtcgcccaggctggagtgcagtggcacaatctcagctgtatacctgcaacttccaccttctgggctcaagcgattcttgtgcctcagcctccctagtagctgggattacaggcatacaccaccatgctcagctaagttttgtacttttagtagagacagggtttcaccacgttggccaggctggccttgaactcctggcctcaagtgatccgcccacctcagccccgcaaagtgctgggattacaggcgtgagccaccatgcctagcaccacacctggtttctaacccctttgagccactttacctccctggacctcagtttttctgtctgtgaagtgggtttattggtattctcagcagggctgggttgagggttccagagatgacggatgtagagtatcaagggccatggcacattctaagacccaacaacagcagatgcctctttttccatccctgtcagaaatacctgctttctcctgcctgcagtggtctctctctgggaagcaacctttattccagcttcgcatccagccctttacaaatgtacatgtgggggaggggggaggacacacaggatagccacaccgaggaaaccttattttcatctcaagctataaatcaagcctttcacagagcttttaactcatttgtattgggagtggtacctgtggcatatggagaagaaaaagtcttaaatcaaccaatattatacattgttatttaatacaagttgaagaatctcaattctaagtcctatggaagggcagagaataagaatcattcctgcagcttaccctgccctagcactttggatggaagagagaaaactgagacccagagagttgaagtagccaattcagtgtcacaccatcgcagaactgggttcatatccagggttttcacatctctgtactgtagtagagaaagtaagaaaggctacttgttttctttcttttttttttttttattgtactttaagttctagggtacacgtgcacaacatgcaggtttgttacatatgtatacatgtgccaggttggtgtgctgcacccattaactcgtcatttacattaggtatatctcctaatgctatcctccccccaccccacaaccggccccggtgtgtgatgttccccttcctgtgtccaagtgttctcattgttcaattcccacctatgagtgagaacatgcggtgtttggttttttgtctttgtgatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatgggatggctgggtcaaatggtgtttctagttctagatccttgaggaatcgccacactgtcttccacaatggttgaactagtttacagtcccaccaacagtgtaaaagtgttcctatttctccacatcctctccagcacctgttgtttcctgactttttaataattgccattctaactggtgtgagatggtatctcattgtggttttgatttgcatttctctgatggccagtgatgatgagcattttttcatgtgtctgttggttgcataaatgtcttcttttgagaagtgtctgttcatatccttcgccccctttttgatggggttgttttttttcttgtaagtttgtttgagttctttgtagattctggatattagcccttcgtcagatgagtagattgcaaaaattttctcccattctgtaggttgcctattcactctgatggtagtttcttttgctgtgcagaagctctttagtttaattagatgccatttgtcaattttggcttttgttgccattgcttttggtgttttagacatgaagtccttgcccatgcctatgtcctgaatggtattgcctaggtttccttctagggtttttatagttttaggtctaacatttaagtctttaacccatcttgaattaatttttgtataaggtgtaaggaagggatccagtttcagctttctacatatggctagccagttttcccagcaccatttattaaatagggaatcctttccccatttcttgtttttgtcaggtttgtcaaagatcggatggttgtagatgtgtggtattatttctgagggctctgttctgttccattggtctatatctctgttttggtgccagtaccatgctgttttggttactgtagccttgtagtatagtttgaagtcaggtagtgtgaggcctccagctttgttcttttgccttaggattgtcttggcaatgcgggctcttttttggttctatataaactttaaagtagttttttccaattctgtgaagaaagtcatcggtagcttgatggggatggcattgaatctataaattactttgggcagtatggccattttcacaatattgattcttcctatccatgagcatggaatgttcttccatttgtttgtatcctcttttatttccttgagcagtgatttgtagttctccttgaagaggtccttcacatcccttgtaagttggattcctagaaataccaaggctatttgttttcattggaaattgtgtttcccctttgtgaatgtaaagtctgtctatgaaaataaatgcattctctgcattgggaaaatgcagagaggttagaaagtaaagaatcgaccataatttcactattcaaagctaatcgctgttaccaacttaataggtttctttacagtttattttaaaatatgacttacagagatataatttactagacaaataaaatttaccaatttgaagagtacagtttgattggtttggacaaatgtgtgctgttgtttaactaccatcacaataaaaatacataacagtggctgggcttggtggctcatgcctgtaatcccaacactttgggaagctaaggagggaggattgcttgaggccaggaatttgagaccagtccctggacagggacaacatagcatgaccctgtgtctaaaaaaataaaattaaaattaaaaaaatttagagcaggtgcagtggttcacacctgtaatcccaacactttgggaagctgaggcaggaggattgtttgaggccaggagtttgagaccagccctggtcaccacagcaatactctgtctctacaaaaaaattaaaaataagccatgcatggtagcacgcccctgtagtcccagctacttaggaggctcaggtggaggatcacttgagcctgggaggttgaggctgcagtgagctatgatggtgccactgcactccagcctgggcgacagagcaagaccctatctctaaaatataaaaataatattaccatcaacccagaaagttccttcatgcccctttgcagtcattccctttctcctaccctagccactggcaggtaacacctgctttctttcattgtagttttgcctttagtggattttattatatatggagttctacggtatttagcctcttgtgtctaacttctttcacttaacatacttttgaggtttgtccatgttctgtgttatcaataattcctttattttgctgagttgtatttcattatctagatatatcacaatttgtttatccattcaccaactgatggtcatttagatctccagttcggggctattatgaataacgctgctatgaacattcatgtacaagtcatgtatatgtgtagacacatgtttttaactcttttgggtatatacctggaagtggagattctgagctgtaaggtaattctgtttaatcctgtgaggaattgccagattgtttcctaaagtggctgcatcatttttacatttctaccaacagtgtatgaggattctaatttctccatatccctgtctacaccttttatcatcttccttcttggtaatagccatcctagtgcatgtgaaatggcatttcattgtggttttgatttacatttttctgacagctaataatgttgagcatctgttcatgtgctcattgaccacattggcaaaggatctgaatagacatttctccaaagaaagatatacctagtaatgggattgctggatcaagtggtagatctacttttaggtctttaaggaacctccacgctgttttccatagtggttgtgctagttcacattcccaccagcagtgtaaaagtattccctttccaccacatccatgccaacatctattattttttgatttttaaattatggccattcttgcaggagtaaggtggtatggcactgtggctttgatttgcatttccctgatcattagtgatgttgagcattttttcatatgtttgttggtcatttgtatatcttcttttgagatttgtctattcatgtccttaggccactttttgatgggattgtttattttgttcttgctgatttgtttgagttcttcatagattctggatattagtcctttgtcagatgcatagtttgcaaagattttatcccactctatgggttatctgtttactctgctgattatttcttttgctgtgctgaagcttttgtgtttaagtcccatctatctctttgtttttggtgcatttgctttggtgttcttggtcatgagttctttgcctaagctaatgtctagaagtgtttttctgatgttatcttctagaatttttatggtttcaggccttagatttaagtctttgatccatcttgagttgattttttgtgtaaggtgagagatgaggatccagttttattcttccacatgtggctagccaattatcccgcaccatttgttgaatagggtgtcctttccccactttatgtttttgtttgctttgttgaagatcatttggctgtatttgggtttatttctggattctctagtctgttctattggtctatgtgcctatttttatgccagtactatgctattttggtgaatatagccttgtagtatagttcgaagtccggtaatgtgttgcccccagatttgttcttttttcttagctttgctttggctatgcaagctcttttttggtaccatataaattttaggattgttttttctagttctgtgaagaataatgatgttgttttgatgggaatcgcattgaatttgtagatgctgttggcagtatggtcattttcacaatattgattctacccatccatgagcacgggatgtgtttccatttgtttgtgtcatctatgatttctttcagcagcgttttgcagttttccctgtagaggtctttcacctccttaattaagcatattcctaagttgttttttttgtttgtttttttgtttttgtttttttggtggggcagttttttggcaacttttgtaaaaggggttgaattcttgatttagttctcagcttggtcactgttgatgtatagcagtgctactgatttgtgtacattgattttgtatcctgaaactttactgaattcattaatcagttctaggagctttttggacaagtctttagggttttctaggtatataatcatatcatcagtgaacagcctttgcccatttttaattggttttttttggatccttttatgattgagttgtgagagttctttatatactctagatacaagatccctatagatagattatttgcaaatatctttcccattctgtcggttgtctttttactttcttgatgtccttcaaagtatgaaagtttttaattttgaagtccattcatctatttttttctgtgcttttggtgtcatatccaggcagtggtgtcaggaaaccactgcctaacccaagttcacaaagacttaatcagttcatatgtttccttataaaactctaagaattttatacttttagctcttacgtttaggtctgtattccattttgagtttatttttatatgtgtgtgaggcgggagtccaatttcattcttttacatgtgggtatctagttgtcccagcaccatttgttgaaaagactattattttcccccattgaattgtcctgataaccttgtcaaaactcagttgaccataaatgtaggtgcttatttctatatttccagttgtattcctttgatctatatgtccgtcctgtgccagtattacactgtcttaattactatagctttgtagtagtttggaaatcaggaagtatattcctccaacgttgtcctttttctaaattgttttggctattctgtatctcttgcatttccatatgaatttcaggatcagcttgtcagtttttgcagaaaaacaacaacaatatggattttgataaggattgtgtttaatctagatgagttgggacattccatgttcatggactgaaagacttaatattttaacagtaagtcttccagtccatgaacatggaatatcttttcatttacttaggtcttatttgagttctttcaacagtgtttttagttttcagtgtttaattcttacactttaaaatttaatggtaagtaattattttcaaagctattataaatggaattgttttcttaacttttggaatgtttatcactagtatggaaaaatgccattttgttttatatattgatcttgtatcctgcaccctcgctgaatttattacttctaattgttttgtatgtatgtggattccataagattttctatatacacaatcatgtcatctgcagttagagatcattttacttcttccattccaatctggatgtttttctttttttacctaatcgtctagctagaacttctaatacagtcatgcaccacatgatgtacatgatggactgcatatatgacagtggtcccataaaactataatatcctatctttactataccttttttatgttcagatacacaaatatttaccattgtggtacagttgcctgaagtattcagtacagtaacgcactgtacaggtttgtagcctagaagcagtaggctataccgtatagcctaggtgtataataggatataccatctaggtttgtgtaagtacactttatgatgtttgcacaatgacaaaatctcctaacaacacatttctcagaatatatgtccaacatgactctacatgttgaatagaagaaatgagagtgagagtgaacattcttaccttgttcctgatcttagggagaaagctttcagtgtttcatcattaagcatgatgttcgctgtgggggttctggtagatgctctttattaggttggaaaacttcccttcgattcctagtttattgagtgtttttatcatgaaaaaggtgttagattttgtcaaatgctttttccgcatctattgagatgaccatgtgatttttgtcttttactctattagcgtggtgtattacatttatttgtgtatgtttaatcaactatattcctggagtaaatcccacttggtcatggtatggaatcctttatctatgttgctggattattacatcacaggatcacaattaggcagccaggttcatagcagaacagtaatattgaaaacagcagagccagaaacctaggacttgggagtgtggttaagcaagctgtgatatatcgtatatgatagaagtgcatgtggccatgggtagtgacaagaatgtgactcagaccatttcctatttagaaatgatcccataaacatgtcaaggagtaaccatgcatccaggagaataggcatataccaattacttataactggataccactgcatatgtgcaattaacaaaaaactagagaagtatgtggaggacacatccaggaactgggaacctgggattatgtccagccctgctgctgttttctctgtgatcttgggcaaatcttttcttatatccgagcttcagtttccatgtcttacagtgaggggtttgataatttggtactttgtgtcacacatggctttggttttgttttgttcatttcataaaatttctagtaaatatacttaaaaaatgcaaactttgcgaaagtgagagagtatgaggagtttttggccacttggggggtgtagctggtactccctcccttccctccatatcagctagaactctgtggttgtgtgcagggagtaggtgtggggttcccagccaggcttgggatccagtgcttcccatttccagagagtttgctccataccacacactgtgctcagctcttcctggattagctcttgttagtcttaccagcaatagtgtaatgtccatatgattaccttagtttttctaaatgatgaaaatgaggctttgcaagcatagatagttgtctaaggaggagccaggattttaacccaggcctgagtcccaatggccacattctgctgttacccaccacactctagttctcatctcgttcctcaacaggcctcttacccttccaggtaacacactgtcccctttgtgcccacagctgacaatgaaaacaacattgcctccaaccagtcccgatcgccacctgctgttgtagaagagaagtggaaacctcaggcccagaggaacagtgccaataacagtaggtctccccaagcagggctggacctgagggtccccttatgctccagttgttcctctctgccccccattcccaccatttgtgcttcctgtgatgttgtaagatgatgcatgatagtttccaaagcacttttacacctaagaccttatttgcaggagttcttaactcaggggatgggcagaaggaggcccagggagaggaggtgactttttttgtggtcagaaagcaccaatttgtggcagaatcagaactagaacccacctctccacaatttctgctggttgctctttcctgacatgatgatcccatgtatcttatttcctgaagattcccatattagaggagattcctgtattgaggaagaaattagactagttggcttcaaagatctaggggaatgacatagaccgcaattatgttgcatacataccactacattctattcccatgctcatggcaggccttactaatcaatcatagaactttatccctgtgagaccatcatatattaaaggcagccagcaccacccatgtgtgtgcaagaggaaatatatttgccattcccaatactagatgtttagagtgttaggctactgccactccaagcagccttgaatgccagaattaatcccatctgtctttgtgtcctctgccagccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattagaaaaaaaccacacaacactgtcacaaagaaaaggaatttaagttctaaacactgtggacctcattataaatgccccctggaaacttaagtgctttttttatatgtgtgtgtgtgcgtgtatgtacacagccacacgtgtgtgcacgtgtctgaacacgtgctgtggttgtgggggtgtgggggggtctctgtgctcatctccatggccagagaaactttgcacacacgcacacacacacacacacacacacacacacacacgaccctggtgcgtgtacatacgcctgtgcttggacgggtgtgcattgaactgggcgtgtcaggaaagctgagcgattgggaaagagggagatgtttcacctccttttctcagtaagggggctttagaagactccgctttcaggtgtgcagattggcagaaagctgatgttgtgaaatgttcaggcagctgagatctgaagtgacttgacgctctctgtccttcaccccggtcctccttttccctctttgaccctcttccagccctcctaccctcctgatcccattgtgcacccccccacacactcggctgctctgctgtggactctccacactgcatcagatggacggtttctgcactggactttgtttcttgttcaccttcagggcattgagctgctgcctttgagataccccttgggtgtcccggggcagccgccttagaaacacacctatctatctccccaaatcaggaaaggagacttaaagagtataaagctgacattttgctttttaatataagagaggagaaaaagacatttttcagagaagtatagatactgtctccactccctaataatttctctccctaacattttagcaatttttaccttgtttgggggttcattttgtttcttcagatttgatttagactctgctaggaggcactgaatgtctataacttatgttttggagttttgtttttttacttgccccttttgttcctcaagtcacactgtaaactagctcatctctgtggtgtactcagtatcctacagtctttcttggccttccctgtacagttcagttttcacatattcgaacggccaagaccaggttcttggctgtgctatttggagaccaggcgttggggaggattcacgggttccacagctgcggggtttggtggccgtaggggaagcagtggtttgggagttctgaatgtaagcgccagagctgccctcctggtccgctgtgcgtggtacccagtgtgcatcacactactcaccccctcccggaccctggcagtccacagcgactccgaagtcagcccatagtcacatccaccacacctcagacctgccacagcctctcctcacttcccaggaccctgaggcttccaggagctctgctgcccacagccctcggggtcctcactcacacctccgacttccaggacggcagtgagcatggtgccttgtggccccaacagttgatgttccgagggtgggatggtgtttggccatgttcgactcgatgctgtgaaagatgtcttcaggcttttctctcctgttcccccagctgtgagcaaattaggttctacacacacagttcggatgccaagggtgacaccccattcccttcacaagaggcggttctgtcacaaatcagcactccacccccaccacacctctcagtgaatgaagtgctggtggtctcactcccctggtgacccttagccgtgggatggggtggttacactaaggcttcaagctgagaatggccatcatggcgggaggctgtttgcaaaggcaccttctgtcatcctggggttggctaagtcaactccaccccttcccaataataaagcatcactcaactgtgagatacctcgactacaaaaagcactgtaccacagccctctccccctgggtccatgacaggagcagggagtaaagttgattgcaaacctcatgaaggcttaggatcatggacctggaacatagtgtttgggggccaagcctgcacactttgcctcatgagaactcacccagctctccccttgaaacttggacacactgaaatggatcaaagtgggccatttccacatttgctccagcaaactgtggtctcaggaactaccatgccatttcctctcctggagaagttctaggtattacctccacaacatttccaactgggggactgagcccacttatcagagaagagccgccatccacactggagcaggaacagggagaaatccagacaggaacctcatgtcacttcctagggaatatgggaagaaacatcagcagactttatgatgtcagttgggcctttggaggcattctggaaggtggcctcagcatcactgatgattgacagatgctacagcaaaaggtccctctagcgttgcttgactgctggggaagggacagtgaccggcactttgacccacacaaggataggagctgcctactttgtgtggtaggtgagagcagagcctgggagcccatcctccctctacttggagcaaagttgtgctggtgatgccccattattgggccagttgattagaaaataggcatttcactttcttggaaagccatcggactaagcccagatgtgcatttagagcactcagcattcttctctttgaagcatgggatgtctgtcctccaggaagagatttgatcttaggttgttacctccctttcacttcttttccacctcaattcaatacttaggggttggcttgcctctgcaggtttgatgtgaatgccactgggtactcagaaagctgtcctctggggctgccttgtccagttagataacaagatagcagatgattgtttcttgcaacctctggttccctccggaaactggtgtcaccaacaggaaaggctgtaccaaggtgccctcttctcagacaggctgttctcagagtgcaaatcctgctgcaactaacagcttaataaaacccaaagatctcacaggtccagccactggcccctttatctccaacaatatccacctcaccaaattctagttcagccaaaggattgagacaggctcttccagttcatctcctggtgtccagcctgaccttcacatctggaaggattttgtcgtctgcctcccagttctgggtccactgtaggtctttccatcacaagcctttgggggatctgggaccaggaatttgggccgtttctaccatattctcagcagcctaaggtggtggcctgctgatgtggagactactcaccttgagccatgtggtccccaggacagaaatggcctttgttttgacatacatggacccaaaaggggaggtgaagaaaacacacctccacctggcaagtttttctccctcatctgaggtcagttgcttcaccaacaaagcccaagccaagaactgcagcgttgagggttgtccctcggagtggagtagcccaaggaatctcaggtccaccaagagcattggtaccatctgggccacgggtggatgcctttgttctggcacagttctccacttcccgattcctggctcagccagccaggcctccctctaatggcatttagtaaccaggaaacaaaacacatgccacctgagcaaaactgcctgcacttcatctctggaggttcgctgcacagaggccacctgccgcatcaccagtgaggaagctttgccaccatcctgcttggcagcttcacacttgacatctgaggattggtttttggctggaaaaagggtaccagggtttcctggcaaggacaggagagcagtgcagtgacacagatgagaagctgtgagtctccaggattcaaggaagccaccaggtgtgcaggctgggaagagacatctctttcagtttgaccctttatctcctgcacttttaaagaaacaccagagaaaaaatctacaaggcgtgtttccactgaagctgaacctctgcctttaggagtcccctatatttgagcaaggccacctgcttcccctggacttgagctggactccttgaagagtgggcttctggagagatgttaggaatatagcacatgctctctgggggccacagggtcattgggaaggtttgaaatgaagatgggatgtggctggaacagcctgtgagatggctccattggggacactcccctcatcttgtcatcacgatggatatgctggaagaggaggtgtcccagtgagccgcccgaagttcatagctttgccctcgccttggcaacagcggcaatgcctctatctctgggatgcatcttaaggagggctcctaacaaggccgatgatttagacagaacaagagactaagtaaggtccggctatcccgtggagccagtagtaggtgggagctcctgtccccgccagccctgctccagcccccgtgtccagctgggccagtggaagaactgggaaggaggaagcccctccctttcactgtggctaatgtttgctaggccagttatggtgaaccaatgatacagtgttttccctcttaacgttcccctcctggttttgccttttcagggttttctgggggattttgttgtagtagttgcttttcttcctctctcatttgggtttgaggattgtggtcgggggagccctggctttcaccaaaggagcccagtggtttctgtggaagaggcgcccactcccactttaatgagggtgaagattgtcaggtcactgtttgacatattcatgccccgtcccttccccccccacccccccgcccacccaccacgggtgtcgctttaaagagtcaattcttgtacagagaaggatttgctaggtttgcatttgggtgttagcatcacgacccacgagggccctgcccaaccgtgcgtcccatggggcaccttgactcttcaaaccaaaattccttaaaggggcacagcccagccttgtccgcaacctcaggggcctgggattcctgtggcgcttcctgaattccaggttggcacagatgatgaggtctgagaccagccggaaggaggggctcctgccataacccaggtgccagccggtctccgcctaggaccttccctcccgcccagccagggtgggcggcatcctacgcggtgaaacgagctcatggactgacccggggctgggcctcgccagccaggagagagcgagggccgcacggcagggctggcccaggcagctcgtccagggccattcagatcccaagcatcaggaaatcattttgtacaaccacccgaagcagagatattttttaagaagcgtaaattattttcagttgttttctgatcctgcctttttcttttccccacaacttcacgccagtgagtcgttcacatcaggtaaatcttgagaaagccttggtgccctcctccccaccccccactcagtaaccacgtgcgtgcacccccgcatcctttctcagtagttaagacgttctaggcaataccatagacacatctgactgtgtctctctctttgagtgcaagaaactcaagtcatcttaaaaaaaaaaaaatacaaaaaaaatttacaaaaaaacaaacacaaaaaaaatatcttttttaggccagagttttctacaggtattaatgaatatttttcttaatccttataagttttatgtgtttaatatttcttaataccggtagcattaatttatacttttgtagcaacacaatatttttataaacagccggtgcttggctcaagtcttcacgaggggtttaggcagggccatcttggggaccctgtgtaccatgtactgtatttaaaaaaaaaaaaagttacctattgtcacacttgctgtgttaattaacaaaagatgttgtgtgcggtctcctgtatcggtgtggatccaacagctctccagggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttaggaaga

SEQ ID NO: 1903 - DNA, 18346 bp, Homo sapiens
tttcaggagtttacaatttagtttttatttggacccaggttgcttggcgctgcctgccacaggaccccgggacagacactggccatcctctgacttgcagaccggccagttgtcagttggagaagcgcagcagctcctcatcacctgtggacacagagagactcagggaggggtccgtaggcagggacactcagggaagggaaagcagctgtcgcctggggccagaaacctctgcttgctgaatcatttatctccaaagggtattccatgaaatgatcagatttttttttcctcttctggtttaccgcaggtgccattttccagtgggaaaatcaaggcacagacatcttcaatggttgctcttccctggaatgctattactgttaccattgtatcgttgtcgttattattaggagcagttgctgttagctgagtactaactccgcgtcaggtactgggaaggctgggaggcaggtgctttgtcccattttacaagagaatactgacactcagattggcacttgctcaacgttgcaggtgcaaaattagaacccagctctgccccactcctcagtcagccctgcataccctctgccagtgcctggctaataactccccaaggcccaattccagctggggtaaggccccaggctcagccccatttcagagagtagatgggctgcttaccaggtacagagtccagaactcagctctccagacccctactcctcccagggctctcccacctcgactccaacagcccctcggcccagcctggcaccctgcagggctgcctaccatcaccagggacaccgcagtactctctgcactccttctctgagtagaacttgttcccgttgccctggcagcccccgtaggggaagaggacgcacttccccttgacagcatcaaatgcccagagctggatgaaggctcggcaggggccccggactatggggagattgcaggccgctgtggagtggagagaggcatggaacttgagaaacccttgtgactgctgatcagacatacatgagactgctgagccagagggccctgctcatctagaacacctcatccctcgttgacagatggggaaactggggcccacaggaagaaaatgatttgcccgaggtcctccacatccaaaggtggaattcctaagatttcaggaaaccgcctggagttctaccactggaatgccctctgttagctaccttttcaattcgcaggtggtttactggagggacagggtcttgagggtgcagagcgcacaggggtggggacccgcactcacccacagttcggcaggtctgcagacactccttttctgtgacgaagttgttaccgttgcccatgcagccgccgtactggaaagtctcacaggccatggatgtaccattatagaaatacctgctggtcattcccatgcagggaccggccgagtagcccagctggcaggaatctagggaggggcagaccagcagcactgaccaagtgttgactgtgtacccattatcaggctgggcacttgatatgcgccatctcatttaattttcactaaaaggattatcaattctttttagataagcaaactgactctcagagaggtgaagtaacttggccggggtcacatagagctaagattcaaaaccctgtctccaaaaccaatgcccattccactccatgtcatggggagttaccagtgaaccacaggcccactgtccccctgtattggtcttgcctgccccaaaactctgtaatagtagttgatgacatatgtaccagcacccacactggccagcctgaccttttcaccaagtcccacccaccctgcctttgctcccactgttccttgctccctggaatgccaccctccataaaactttacctggatgcctggacacagtgtgaattcccctttatccatgaagtcctcctgatcccctcacccctccaacgtctcagctccccctgccctttagctgacccttccttttgggcccatcacctactcccttggatgccttccccactagaccagaagttccaaaatgacacaagtggtctgtgtgaccctagtgcccagcacagggcctggggcggagcagggttcagtgtttgtttgctgatcgagttggagaggaagttgttatgtcatggacactgtcaactacacaaagcattcacatgtccctccccgacttcctcctacaagagccctgatgtttagccccacaggctattatcccataatatggatgaggaaaccaaggctaggaggccacacagtcatacagacagggcaagaaccagcttctcatcatggagttgacagttctcaagcccaggacgatgcctcatgctcttctctctgcccccacaacccctggcagagtgcagagtacttgatttgccttttctcagtccagcccttgagtctctaacagataaagagactgcactgataagagtagccagggtgagccaactgtgggcccttcctttctggagtatggcagagggggtgaaaaggcaggtgttcattaccttctttcttggtgacttcagttaccagttgcccaccccctgatccttcctcttcttggggtagcacagccctccggactctctgcgggggagagaaagagaagaagcagttgcagactccttgccgctattgctttcctgtacccctggaatatataaatgaacaacttgctttgggaatcagggtaggtaggaacacagctcttagactggttaaaggagactgttttcccaaaagtgtcaacctgaattcctgaacaggcatcagaggacagatttctggtctgaaatgaaatttaaaaccatgaggtatgacaatagccccatatccaactcccagttgaagtgcctaaaggaatatagtaatgaaaaggtacctcccagagttggaaaccaggggagagcagcaccctcacactaaagatgtgaaggcattgttgcacaacagagcacaggtgcaactggtttacaggaagggctgaccagatcatcattagctgcttgcagaaaaaaaaaaaaatccagagagaaagaagggaccctgaaactgatcctaactccttgctgtggtggtggggactgcagagcagggcaggctgccaaagctgccaagagggcctctgggtgtagagtccttgaggcaggatcccagggcaattatagaagagatgagcagccctgcccacaggtgagacctggaacttgagaaggtagctgtagtaatctcaaaatttcccatctccttttcaggggcaacaaaacactgtgaaaactgtcagggactttcactgtcttccagaccagtcttaagctggtggcatataggctttccttgatgaggatagagaaatggagaaaaatcgtgggacaagttaaatactgcagctgccagaattgggttgggatgaagaaatacccttactaaatgggagatattctggatcttctggaattcaggttgatggcagtaagaaacagaagaacacttaaaccttccctgaaattcaagatgacatgcatccaaaaaaacaacaaaaaaaagatgacatacatccatataacaggagccaacagtgatggaaatgaatatgtgaaagtagaaaattgttgaacattaaaatgatgttgaatttaaccacaccatagagatgataaagtgcagtttccatgctacaggaaataaatccacataataggatttccaggagagaaaatcaatacagaaataatagaagaaaactttttgagttaaagaaagatttgagttgcccaattatagggaaaaagggaatcaggcaaaattagggaagagctccttcttggacattcctagggacaaagaataaagagcctggtggccctcagagtaagtgacagcatttaacgacagaagtcccagagcaatatctgaaggttttaagagggaaaaggttgtaacccagggatccttcactcatccaagccactggccgtatgatataaccacagaaagacattctcagccttgcaaggattcagacatttgccacccatgtatctttcctgaaaaaattatttgtagaaatagtcccaccaattaagaagggaatctaaatgccagaaattaaagatgtaatgtcaaagaaataatgataaggtataaagccaataaaatatagagttttacaataaataattgctaacatggttatgtgatttactgggaatatttagaaacaattttttttaaaaaaaataaaggtagaaaatgtaaacaatttcagatcatatccacaaaaacaggtatggggaaaaatctgaaaggatgaacatggtgagaaacgggaaatagaagtgtgctgtatttcactcttttgcaaggggagtcattagctttggttttattcttgacattgataaagaaatacagatttagttgacatctggattaaaagagcagattgaaactctcctctagagttctccccccaatacctaacatttagcaaaaaaaaaaatgagtttaaaagcatagccccagcccccaaattgtcatcagtgtcactcaaggaaaggatcccaacttaaagccaaaaactttaaaactggcaaccaaggaaaaaaacacaagacattttggaaccgaatagaatggctcagctgtgccctgcaacctccaggcctggtatgtcatcagatttattattcttcctaatacttctaaatccagaaggagaaaactgaggggcaccccatccctttcctttcctgacagaggagtagtgaacatgccttttggagagaaaggagtaaaaagcaaaaatggagttcacagaatgggaggaatggtagtaaaagttccagggctatacaattgagtgctccaggacatgttgtcgtaggatggattatatcacaccagcccacctagggataatgagccccatccagaacattcagcagtccttccaaacagaagcagaggaaggatgttatggattgaactgtgacccccaaaattcatatactggggtcctaaccccccagaacctcagaatgtgaccttatttggaaatcagattgttcagatgcaattaattaagatgaggttattagggtggaccctaatccaatatgagtggtgtccttataaacgggtgattcgcacacatagagaactccctgtgaagataaaggtgggaattgggatgatgtttttaacaagccaaggaacaccagagactgccagcaaaccaccagaggccatgggagagacacggcacagattctttctcgaagcccacagaaggaaccaaccctaccaacaacttgatcttggacttctggcttccagaactgtgagacagcaaatctgtgttgtttaaatccccagcttgtggttctctgttacggcagcccccggaaacacacagacagtattcagacccgcatgtgcacctcggggcagttcattaccccacccccacccccaccctcaccattcccttggactttacaaaagttgatgaacataaaacacccagatcttacactaaagtaggatggggctagggggaggtgggattgggctcaaatttgatgggaagaggaccaaggagtaaatgacacctcccattgtaccagaacaaacagaaagtctggataaagctgacgaagaagaagcaagatgaagataaatggtacagaaactacccaaacccacctcagaagtgaataaaaaaataaataacctgaataagagaaagagcccagctgtggtggacaccttaataaactacctggatttccctcagcaatggatgtactttctcagtcgctggcagtgctactgtcagacagcccccaggggtcagccccttttggggactgtggcagctaaaggagccatcttacccaaggtcatgcgcacctcccagactgatcaacacaggggtattagggctcagcccctttgcagcatcttgggacgtctctgaaatgtcagaggtccctgtagtgttggctgaggcattgtaactgcatcacagctggactgcttcctctgccctatcctgccttcatgtcttctcccctacaggtgttggtcctggggaacccaacctgtgataccagaagaaaacagaactcaagaaacagaaggaaattcctcaatgccttcaagctatagaattacttaatcagaacatgcatttatgtgcacgtgtgtgtgtgtgtgtgtgtgtgtgtgtgtgtgtgtagagatggggtcttgctatgttgcccaggctggtcttgaactcctggcctcaagcagtcttactgcctcagccccgcagaatgctgggattatacgcatgagcaaaaacaacagaataagatgaaaagagaaaatccaagcctacagaaacaaattgagaaccaaaacaacataattcagaaccagcaaataaattagaaatagaaatagcaaggaacagaatgaaatgacggtctgcacaaaggaatgactgctaaaaatgcaatgaatgtcataggagagagactagtgataatcccagtgaatgcagatggaaacgacaaagagatgaaagcgactgggaagaaactaatagatgtggaaggcaaagatgctcctggatgagagaacaagtgttcccgaggtagcaaaacccaacaaaaggaaggaagataaactcaatgatatcaagagagatttccctcaaacacagaagaaatgtaatctgtatatgaaaagagaacattgaattccaggatgtgttgttattattattattattattttgagacagagtcttgccctgtcacccaggctggagtgcaatggcgcgatcacggctcactgcaacctctgcctcccgggttcaagtgattctactgcctcagccttccaagtagctgggactacaggcctcagccaccacacccagctaatttttgcatttttagtagagatggggtttcaccatgttggccaggatggtctcgatctcctgacctcttgatctgcccgcctcacctcccaaagtgctgggattacaggtgtgagccactatgcctggctcaggatgtatattttaaatagagacaaggtctcactgttgcccaggctagagtgcagtggcacaatcatagctcactgtaacctagaactcctgggctcaagcaatacttcctcctcagcctcccgatttgctgggactacaagtgccacccactgagctggctaatttaaaacaaacaaacaaacaaacacactttttgtagagatggaatctcactatgtggcccagactggtctcaaactcctggcctcacgtgatccttctgcctcaccttcccaaagtgctgagattacaggaatgagccactgcacccaacccccaataaatttttaaatagaattttcaacatcaagacaggttttgttaagatgttgattttaatgataaagttttcccaggcatctgaacagaagaaataaattgcctacaaagagaagaaatatcacacgggtctcgggctttttcatagcaataatcggcgcttgagaacaatggagtaacatatacaaagttctaagggaaggaacacgcgacccaagactgttgcacccaagcaaaatggcatcaaatatgaaggaaactgactgaccttctcaaacatgggagaattcatggactgaaacacccatgaaccctcctcaaaaacaccacctggcaaagaaatggcactaattaagagaataatagaaataaataactcgggaacggagaagctgtggttatattcactacaggtaagaacagaatccactaaagtatagaactacttctaaaagatgggattatggagacagagaagacgggaatggtatcgatctagacaatttaaaagacaaaagaaattttcgaagagttgccacagagtttcactctcaaagggagtgctcctgtctgtctttcaagtcacggagataataaatatactctttaaaaatatacagtgatggcagcctcttaaatgtcttttcacaaccttgactttagaagaatctttaggacataaatcctctcatgactaaatattcatttgaagatcaagaagtccacttcagtttctttaaacaaaaaaaaaatcaaaagtccaggcacagtgactcacgcctgtaatcccagcactttgggagaccaaagcgggtagatcttctgaggtcaggagttcaagaccagcctggccaacatggcaaaactctgtctctactgaaaaaaaaaatacaaaaattagccaagcgtggtagtgggcacctgtaatcccagctactcaggaggctgaggcaagagaatcacttgaacccgggaggcggaggttgaagtgagccaagatcatgcagctgcactccagcctgggtgacagagtgggactctgtctcaattaaaaaaaaaaaaattcaagtaaaaccacaattaatgcttttaaaaattagaaatagcacttgtaatataatcccatttaataacagtatatctaaatttgatcatccatttgtccttttttctataagtccttttatccatatgtgtggcaagattccagaaactgtgtgactgctgatagttttgaggtggtgagattaaaaaaaaaaaaaaaaaaaaaaaacctttacttacctttatacttttctgtgttcctctaattctttataatgaccatttattagttttgtaagatcaatggtcattttcttttaaaatataggagcaaatatctaatgtgttaactgttaattctacataggaacaaggacattttgtcttttgtggggggtttatagtttcgcaattttcaagaatatttttccaaataaatatcacatatatttatatatatacacatatatatatacacacacagatatatacccatgtacatacatacatacattagtagaataggatatataattttccaaataatcagagacaagagaatgaagaaagtgtaactgatgtggcaaaatgcaagaaaataaaagagaagcataggaaagccccaaaatcagaaggcaacataggaaaagagaaggcttgagaagctgcttgttctcaggtttgctgatttttagggaaatcaattgatttcttttcatgctgaatatcattatttcattattgaggattgttatttcattattgagtgttttacttcttttagatgcttttaggcactgtgctaagaacttttctatatgtcattaaattctgccacaagcccagaaggtaattgtgattatcctgttttgaagatgagacaagtgaggtccagatggattggcaactagtccaggtggcagaatcaagatggagccccagtgagtctgacttcaacactcatggccatcgctgccttctctcaccccctccccatgactctgcctccccccgcagcaggatcaagtgtgcagcgtgcctggggcagagtggggtgggatggggtgggatggggtcgggggatgaggcactcaccgggattaagatgggctctggttcctgctccccagggacacattcacctaggtcacagagcaggagagaggagtgaataacaggaccaggcccaggggccatcctagacccggatttgtatctttggtgagcatcgtgctgggaacttgtcgtgccttagtccacttcatgaatggtcctgcctgtgtggcttgctcaaggccattcactggaaaagcaagagactggtggctgcaccatcattaccatctatccactccaccccaccccactagcatcattttatcagcatcatggaaagaatagcaatagctaacactgactgagcatttatgagcacagtgctattgtacttaatggttttattgcattgccttttacagcaacttctaaggaaggtgttattatgcccaatttacagaggagggaaatgaggctctgagaagttgactagccagaggccacacagctcagttcgaacccaggtgctcttgatggcagcagtgggccatccggagtggccgcggccatcacactggctgcagtggggaggcacgagcactggtggtagcagtgactgcggaagtggcagtggtggagctgggacccctgtggctcccacccctgaggcaggcaactgtgccacccccatccttatgcagccaggtagaccccactcccaggcccagagcctctgttgctccacactctggctccaccttgccatcctcgcccaccatcactgcggagaggtcatggggaggaggctgacagcccccggagcccacctctgggagcccctggagcctgccaccctggcggccgtcacgatggggctgggctgagtcacctgccagcaggggagcaatacagttgggcagagagggcccctgaggcagagctgggcccagggcagtgctgcacttgcacacagagcatggggctgggcctggggcgtggagctggggcgtagccttgggaccctggggtgggaaatgggagtggcgtccgcttcagggacccagccagtggcatggccaccaggcccaccccactaagggcaccaggttcctgtgccttgggaggaggctgtgtgtgaagccaccaggggccatgtccccagggtccaccccacattggggtgactgtcaagcctgatactctggatggctgggcctggggcctgcaatccattcctggaagcaccccttgggcagggctgcgagccaggcaaggggagcctcaggccacccctgagtgctggggccatggagggagcttgccacgatgtcaccccagccccagacaccagcctgggcccagcaagggcccacagcccctgcctcaggctgcaaaggggtgtggctggggctgcacaccccattgagctggtgggagctgggcacaagtgggagccctgccccttctgaattggtgggataggagctccccaggtgcagcagcagccgccctgctgtggctgtggacccaggcatttctgcactctcagggcccaggaaggtcccctgcccaccacagactctaggatgcctgctcccactgcctggcttctctctgctgttggtgcctgctttattttggagcaagatcagggctgagccagggtgctgttgcagcctggacaggtatgcacatgctcagggcagtgctgacgtgccagctcccagctgcctcagccccctccagactttgggtgccaacaagcgtggaagggaggccgagtgggggctgatggcagcctgacactggcctgcaggcgccccttggcatgaacagcctgggtgccatgaatagcagcaggaggctgacaggctcctgagtggaaggaggctggtccccagtgaagccccactttcaagctggggagggcctgaagcctggggcctgggccaccagtcctgtgaaccagatggggaagttggggtgcttttccctgggcctacccatggccgcccatgggccagtcagtacaaacttgcgtacagagcacccataaaaaccccagactcagccagattcgaacagaggacagagagacaaggggagacaatgggatgacttgcctgcagagaggagacacacactctagggcctcctctctgctgagagctgcagcctcagcagatgacctgcctgcagaaaggagcttcccattccagggtctcctctctgctaggagctgaacactcatcagaacaccctggctgcagaaaggagctgcccactgcaggtcccctccaagctgttctattgctcagtaaagctccccttcatctcgctcaccctacatttgtctgtgtacctcattctttctggtcacaggacaagaacttgggacccacaaaatggcaaggctaactgtaacacaaacagggctgaaacatgccctttgctcaccacattgcaggtgaagagaaggagagaaaagctgcagccctttggggagcccagacctgggagctccaccagccaggactgtaactccctctttggggccctgcagttcttggcatctccgagcttccaagcaccactccattccctggcgccagctgggaaatctgcttgtggtgcacctggtccagccatacccttacagagtgctggcaccatgccagcacctggagctgcccaccccatggcagcagccagtatgtttgactgcagtggctggaccccaccctcactcacacatcccttgccgcttcatgcctgagttgcagtctcccttggaggtgtgggatccaggccagtagcatgagccaagcacggtctaccaggccaagtgggtggaacaagcccagcaggcccaagcaaaactcaggcaaaggcaccactggccacagaggtttccagccagaaaagcaatgccccaaagatcccgtaacactctgattcctgagcccactttcttaatcccaaaactcttttgcctcctaagaggtatctgtggattctggctacaacctccctgagacacatggcagtagaatgaacactgaatgggttctagtctaagctctgctaggaataagctgtgagacttggagcaaatccactggcttcctgattcactatggaggggaggctgtggcgcctttttatctcagagggttatagtaaggacccaggggctgggatggtctctggcgcccacaagggacgaagaggggacaggaatttgaggcggaggggtgctatgtacctcggtcagccatggtgaagatggagtcctcagggatgcccacaccctgggcaaccactctgaagtcctgcaggagagtttccctcagctgcggcgcccgccctgcaaggaggaagcagaggagacgcctagaaccaccaggtgcttggagtggaagggcctgaaatgattttgcccagtgattttcacttagggaaaatttgaaaactattgatgcagtttaatctatttgatacactgaaggaaagacaggctcccaagaggaagaggggtctctcccaggttcccacccaggtctcctgagtccccacaaaggactcttccccttttttttttttttgagacggagtctcactctgtcgcctaggctggagtgcagtggcgtgatctcagctcactgcaagctctgcctcccgggttcccgccattctcctgcctcagcctcctgagtagctgggacttcaggcacctgccaccacgcccagctaatgttttgtattttcagtagagacggggtttcaccatgttagccaggatggtctcaatagccaggatggtctcaatccctgttttttttttttttttttttttgagacagggtcttgctctgttgcccaggctgaaatgcagtggcacaatcatggctcattgtagcctcatactcctgggctcaagtgaccctcctgcctaagcttcctgagtagctgggactgcaagcacacatgcactatgcccagctaattctttaattttttgtagagatgctgtctcagtatattgcccaaggtggtctcaaactcctggcctcaagcaatcctcttgccttggcctctcaaagtgttgggattacaggtgtgagccacagcccccagtccccactggttcttttaagggcctggaggctctgtaattctctgggcctggaattttagagatcaaaaagagagaatttcacctcctccagggagactcagtgattgtacctttctccaaattggagttttgtcagaaggaaaaagcaaaactccctgtgcttacccactccactgtccataaatcaatgtcctcccacccttaactccaatgggcacatctagtaatgagcctttaccgtagagcttggcagtaatggtgggtccatgatggcggctgaatttcttggtcaggaaaatggcatactcatcatagttggtgtggaccacataggactccatggttatgttccattctgcatgggaggtgcaggcagaccaaagggatcagtggtcagtagactcttctagctggaggtccgtcacctgtttactcacacatcatctcctcatccatccatctatccacccatgccttccatatctccatttatcaattcatccatattcaatctctccctatccacccatctatctcctccatgtactcacattaattcatccaccatcactcaatccatctatcctctccatacatcaattctcccttccttccttctttcccctatcactccatcaatttacctattaggtaactgactctttgactcatttatccttacatatattcagtcaccaatcatttgttcattcatccatctatctagccaaacattcatatattcagccgtaacacaattgtttggcacatagagcatattcaataaacattttctgaactaacaaataaattaatgtccaaatccctctctcacttagcatcatgcacactgtacgtggtagatgcttagtaaatttttatcagctgatagcaggtgcctaagaagacatgaagactggcgaaatcagcaccatcaccctactctgggcatgggcactgggtgggggcagggaaggagagagggaaggggaggaggagaggaggagaaggaggaggaggaagaggaggagttgtttgggggaaggctagatgacatctcagctaaatgggaggaaaggttacagaggcagagggagctgaggacatcaaggtattttcaagcaaaggagagaatgcatgtgtctctttccactccacttactggatttgtgatagagaaacttcccatcagtatctgttttctcataagctccagacgtctcctcacagacacctttcctagaaatgaacaaatcaaaaggaaggtcactcctggtagagatcatggtcctgacactcaaccctcctgcagggctctttccaaatgccttggttttggggtttttttgtttgtgtgtttttgtttgctttttaattcggaaatgaacatttccaaatgtcttgtttaatcctcacactagccctgagagacccccattttccatatgatggagggacaaagaagaagagacaaatccatgccatcctcctggcaaagccagcactaatgccgccttccttaatcaaatctacacattatactgaggcaggaggagctggagtgatgaattcctacagtcatccatgtattgttctgtgtctctcttgccccagttttctcatttataaaatggggatcatgatagtttctacctcacatggttagtgtgagggtcaactgacacatatgtaaagaacttggaggaagcactatatacgaattagctattattgttacaatgagcactatttatccaatggatatttattgggcagcacctatgtggcaagccctgtgctacatggcagggatacatgagagagcaagacagaccccattccctggggttcctggagcttgcaattgcgtgggtcaggcaggcaggtgagaggcagatgcaatcagtgtgagaagtaccacatgggggtaagtgtgaggtcctcttcgggcacaaagaagggcatgtaacctgaacctgggtgtctgggagggcttcctggaggaggtgacatgaaacctgagttctgaagaatccacaggaactaattagcccagggaaatgaggagaggtgctcccagtaaaagggacatcaggtgcaaggacctggaggcgtgagagttccagaactgaaagcaggttcacgtgagtaggactcagagtacatagcagagtgtgtggcaggagttctgggtgctgggagggtcctggaaagccacatcaagagtttgaatcttactcccagggcattggggagtcatggaagggtctcgagcagatgtgagttttcaaaaggtctttctggttactgggtgaagaggggatggggtggaagggtggaggtcagaggtgaggaaagagtagagaggttgtggcagacaaccaggaaagaaagggaggtggcttggaccaggatggtggcagtggagaggggagaagtgaacaggttgggggggatttaggaggagaatgggcaggacttgatgatgggtgacaggggagagaggagcccagttcccaggttgggtccctggggggctgaagtacccacactgggctaaggaatgcccaagggggaggagcagtttgcagaacaggcacagtgctgggacactgccctcgaggaatagataggacacctgaaaagggccgtcctggtggaggagcgtagagggatctggggttcagcgggaaggtcctgactggaagcagagatctgcaacttcccaggatggacggggctgggaaggttgtgggtctctgggtctctctcagctttccagccccaccctagtgctcaccgccaacgagtgctggtcatgctgatctccgcctctgtagcgccctctcccagcaccagcgtgctcactgtcatcctgtccatgatcttcttcagccaggggcaggtggaaccgatggccaggttgtaccacttcccatagatctaggaggcaggtgagctctgggggtctgcatcagtctcagacctcaaagcagacctggctgacatctgctccccaccctccacctcctcctcttcctcctccttctcctcaaaatgacttatccttttaagggataatgtcttacaactaatcagaggccacacaccttcaagggaggccagatccctaagagtggcgtttcaggcatcacagcgaacccaggaagcaggtgtgcggctggggtcccaacctgccctgcagaagggctaactctctcaagatgtgggatctgtccatagctccatcaaccactgctccccaagagctggagtcctgtcttttactcctccaatgatggggtgctccccaccttgcaaggcagcccacagccccatgttaggaattatttcaaaagtataatgaacatgatggggtcattcaggataggcctgcttcctcttcctcctgaaagtgcacgggacagctgaaggagccctcaggctcctacggaacaggccaatgtgccccacaccctttgcgtcccagactgccacagggacctgctcctcattgcccctctgccacgacctttccttgtccctaaaagtaaacaaaacccacatgacaccacagctagaaggttctgagacccttcatacagacatggagacagccccaggtgggcaagggtattctcaaagccaccccgggatttagggcagagtgggggctggaaggcagctctggcactccacactcacaggagagtgtcctgccccagtccaggtctctccttgtgcccaagcctctgaatgtctcccaaccctaatctctgtcctgcttcacctcttcccataagccccacatgcccaacccaaaagctgctggccacatgcccacgctgtgccaccccaggtgtctgtccacagtcaggccaggatgtgggcaggggacacaggaagagctaagggaaagatgccacagagagaggggagtcattagagaaggaagggctgggaggtctgggcaaagctaggtgtctgcacgggggctgcagggcagtggcaggcaggacaaagccttctctggagcaggttcccattaacacaagggttccccttggagcccacgaggacagtgcagaaggtgaggatgtttgactcatagaatgtcagccaagagacccacggaatggcaggggatagagctgtaccttcaaaggatcccataatcccagatgatctgagtggaagcctgagaccccgagacaggccgcacttgcccagcagggcccatctgcctggactccccatcaccacatccaccctaccacagagagcggcagccttacccgagagatattgaagttttcctgcacttggatgttgtcgggcggcgttggcacagggccagcgctcaccgccaggcaggcgctcagcagcaagagcagggccccgaggctcctcatggctatgggctcctctgccttggtatatcccacaggctcggtctagcaacagaagggccaccgcctccctgcaacagggcagctgtgaactgaggctggggaaggggcctgtggcttgtagttgacctcagtgtttgccctgctcagctggggccaattacagccccaaggacagctccaatcgatccctgtagcctggctggggtcagcagtaccaagaggccgggatggctgcttcagaagaggcattggccaagcacaat

SEQ ID NO: 1904 - DNA, 7421 bp, Homo sapiens
cttggagctgatgcctctctttattcatgtatttcatcccctgctgcctggtttctcctgaatccccttgttcccctaaatagcacccccagtccccgcccctagcccagctgcaggtggagtagcagctgctgtctccattcagcagatgggcagactgaagcccaagagtgtggagcccagtctgaggtcacacagcagtctcctgggttcccacttggccttcaatggggagggaggacttggcctgggctccgtgcgccctcactgcagggtggctggctgcggccacgtcgcagggagctgccaatctggtctctgagggcctccagtctctgggccaggtttggaaccccggccccacctaaggagcagtgagactcgaggcctgccctctccagggcccttcctcacccaggtccatctgggtcccaacaccctctggagaagcctcagggggtaggtaccctccacccttccccccaccccacccccatacaccatgggctccaacatacatctgggcacgcagatgctcctaaaaagagaattccaagtttgggaagtagaaagatcttagaagccacctctcaacacccaccccatttcagagataagactgaggcctggagagggtgggttctaccccaagatcacagagaacattaggggcccctccctctctcccttcttcacctctgagccctggtgatgtcttcgggggcctcacaggcaggggaggtgcagaaggtaccacctcctcctccgtcaacatctctgccaggactcgggtctgagtccagtcactgtgactcctgggccagggtgagttgggagatgggaggtgagcctttgagttccccagaccacccctctctgacctcagtgccccaggagagacccacctctctcttgggcacttggcagagccagggctgcatgggggtgcccagggtgggggccgggcagatgggggcctgccacctgaggcctcagggtccaacacctgtaggaaagaccagagtccactctgggtgacctcagtcctgcctctctgtgtcccacctacctggtgctagccatgacaccccaccatgcctaccccacaaggtaccaagaatgtcaggatggcataaaggggtggggtcttggtcgccttctgtgtgcagcagatggttcttctaccgtcctctcctgagactagaagcctcctgagagcaggaaccacgtctggtctatttctgactcctcagagcccagaagagaggctggtataaagcaaggagcttggggagttactgaaggagtaagtgaatgtatgattcagtaaatccataagtgagtagatatgtgagtgaatgaataagtgaatgacagaatgaattcctggccctgacagggcagggtgaggaggggggagggtgaggcaaacagctatttcaaaccagggcagagggagccctaggccagccattcactccccatgatctagcctgcagccctggaatccctggggctctggattgatgactcctggatcaaggtctccagttctcccagccttccctcactcccaccatggcctttcctacctggggcaggtggtgctcccctggcaggcaggcccagtgggccaggggcactcgacacagtgggcagatgtggcagcaggggcaggagtagaggggtggcagtgcctgcaaaaaggtgcgtcagaggctccatgacatccctacttgtcacccctccaggctgggccgtgagactcacatggcaagggggagctggggccatcaagcagggacacggtggggtcaggccaggaccctgctggtgatggtagcaggcagagaggagacgcctagaaagaacagcagggtctatgcctgcagcctccaaccctaccaccaagctggctttcaaatccccttcccagctaatactcctggatcccgtaccaggtaccgggccccattctcaaagttttacatgttaacttattctctctgatttttaaaacaagcctataagtaggcacgacgatgaaccccatcttacagaagaggaaacccaggcagtgagaagttaaatgacttgccccaggtgacacagctagtaggtggcagagctggaaactgaacctagttggtctgaatccagaggccagcctcaagcagttcattaagccatcccttttcccagctgccctctgtccagaggcctggctccaagctggtggctctgcttacctctctagtgcatggacctgctgggccaggatgcgctgctcattctgggccaggtctcggctattctgcagctggctcttttctttcctaggggagatcacaagccaggaaggggtaggaaatggggctggggtggggcatcagtcagctcctcctcattgcagcatagcaccagttcaggaagcaggtggggacataagggagccaggggcagggagaggaggcagtttgccagaagcagcctagcagtgatgggtggggagcagcatccctctggctgtgggctgtgccctacctgagcctctcattctctagcatgaactcctgtagcatcccgtacaggttccgctgggcccaggccacccgggctccactgagccctgaggctgcagggaagcaggaggtggtggatccacaggagccccagaccctatccccatcctactctgcctccaggaagcccatacccttgcagtccatttggtccagctggaactgcaggcgacggttctcctcctggagctgcagcatctctgtctccaaacgctggggctgctttgccacaggagactgtagggaaagaggcccagagccacctttatggttgtataagtcgtgcactgcacaagaacttccgggtgtgggaagtaactggggcctaaaatccagcccatgcttcattcgtcagccttgcatcttggcacaaggctgtatctgcctggaaggggcaccttgtcctaagtgcactgtcctggagggccccactctgagctggactcagctgtgagtccaatcccaaactcagttctgtccaaaccttgggccagataatggttccaaacgagaccccacattaggccccacatcaactcccacttaaccatgatactaactgagctagaccctgaatcatatcccaactcaaactccaaccctagacctgccctaaacctggcatgaccctggctgggaccctgaccccatcctatacaaccatgataccgattccaggattccaaccctaatcccaactttgacccagtccaagacttcaatcaagggactcaggctccaactcctgcctgatcccccagcatctccacgcctgtccctcagcttgtgcctgcctatactcaccttgggggcctgtggtcgggtggtgacccgctgagctcggcttgcatatcgcagggtgctgagagtctcaggaaggcactgggctgagggggacacgcaggccacctggggagtgcactccccctgagcgctcctctctgagggccccttcctcaagacccaaccttccctgccaggccccgcttaagtaccatgagggtgaccccgcgccctcccagtgagtctgccagcaacttggtgagcttgctgtcccggaaagggatgtggctctgcttccgctgtgggtccagcagcagggagatgcagtgacctggggagggagagcaagagttaggaaggttacatcacttgcctagggccatcaggctgggatgctgcagagttgggctctccacccaggcctgtgttgccctaaaaacccatctttccacatgatctcatgactcagtcagattggtctccaccaccagactgggactctttgagggcagagaaggccctgtataccctgaccctcaatgcccagcaaagtgcctggtactcaggcactcagaaggaaacttctaacaaatggattgtacacaaaggagtttcgcgggcatctcacatgcatgccacagaggaatactgagggcacagcccctgaggatctccaggtccaataccctggggtggggttggggagaaagctcaagtcccttccccttactaggcctcagtcttcccaactgcacaagggacatgccaaatgtctctgagggttcatcttctgcagttgagtggttctatttcccaaattagcatggaactttatacacccttagagtttatacattcataagcagtgttttacgaagggagaagtcaacagcagagctggggccagaatggggcctttggttcctggatcgcagctctttaaccctcttctatttactacaactcctctggtatcccccactgtggagagctgtgagccaggcacagaggagagacaggaaatcacaccggtggcccccaggtctcacccagggccagcaggcttcggttgatgctgttagcctcaagcatcagctccccacgggatcccgtggctgctaccttctcactgcctgccaggtccacaaagcacagcttcccaccaacagggggctccccagggtccacagaaggcatctgctgggcctgagggatcagagcttcatggggacttgggagggaccgtccccatcaaagccacaaggttatgggaccaagagtttccattattaacccccatgcacacccaagttggtttatatgtccagatacagacccttgcttggtggccccgggtaagcaccttcccaggctggagcactcacagtttgacggctgatgtaaagggtgagcagggcatggcttcggctggaggcctggttcagggtgtgggctgagttccttcgacggctgagacctggaagggaaaaacatcaggagctggacctggtaggaagaacaggtcatcatcaatgaagaaaaaggagcaaaggaatcctggcggaagggtcagcctcatgcaaaggcagggaggcaacagagtgggtgttgttcagggaacgatgggatgttgggccctgctctagcagagatgggtggatggaggatagagaaaactgagcagaagaatgacagtcagatttgcattttataaacatctctcccactgcttcgtgaaaggaaggggagaaactgaggcaggagatcagctgagaggtgtggcacagtgctggggccagaatccacagtcagcatctccagtgcctgccaaaggaggggtgcccaataaatacttgatttaaaaaaaagaatgaggctgaaagggcctttaggctaggctaagaggtatgaccttgatcctcagggccctggaagggtggagggtctggaggcaaagagagatggggtttgcagcatagaggagaatggatgggcaggggagagccttgaggtgcagagaccaccagggagcaagaatgagtcctggcggaggccgaggccctgggctagagaggagagggtgtgaaaggagtttggaaggcagaattagcaggccttgttggcagtgcggggaggcccttgggccatgcctttgaattgtggtttactggtccttccccacctcccccaggaatcatttctgaagctgcagctgcagtctgggccccaagtccacactcagtgaacaactgaggaatgggcacccctacccgcaaaactccccgctgtcagcacacacccgtttgcaaaagttccatcagggcctccagactcccaaattccaccacccgcagctgctccacatagaagccccgagtcttgttccagcgaacagggaggggccggggagaccccaggctcagcaagtcccgaacctgggaggggagggaggagggtgagggaaggggatctttctgagtccacccatccccagatcttactgacaacagtccccaccgcctcttctgtcctttgatccaggctccctggaaagaagcgctccgtttcctcatgggctgtctttctattcctctcattcccttacctgctcattgtagatctccagataagaggcgcgaagggtgacaggggcacccaggtgctgcacgcggtccaacagccaggcgaaggtcctctgcatgatgccagccaggctggggggtacaggcaccccctccccctaggggcaaaaccagctgagccatcgtcatctccacagtaataactaccctctgtagcgcatgtatgataccgtgcgccgggaaacgtgccaagttcccaaacaatggctcatttaattcatagtcggtactgtcacttccattttacagatgagaaaactgagagctaggaaggggccaaagttgaagcccaaatgctccaaattgggcaagtcccttctctttggtcctcagcgtcctcgtctgcaaacaagcgggtcaggcggcgtcgtcccagccccttccctctgggagtctgcgccgcctgcggctccccagggcttccagcccacccagccccgccccgcgggggcgccgccggcgctcgctcacctggggagggggtccagtcagggtgtaggtcttcccagagcccgtctggccaaaggtgaaaacagtgcaggagaaactgcgggcggcaagggcgtggctggactccggcggctacccggggtgggggctgggggtgcttcggggccccgccaggcccggcgcggagcggaggcgaagcttcactcacccgcgcagcgccagctcccccaggcgccgcacgccgcacgcccggaacacgtcctcctgcgtgcgcgccgcgtctagcaccgcaccgaagcggaacgccacttctggacccccgcctggaggactcacctggcgcgggtggggcggaggagcggggcactctggaggagggcggggcaccctggaggggcggggcaccgtggaggagggcggggcacgcgggaggagggcggggcactctggaggagggcggggcaccctggagaagggtagggcgctcggtgaggcactcggtgggcgagcaccctgggttgggggtggggtgggggacactcactagggccggggcattctggggagggtaggacaccctggaggggcggggcattctggggggggcgggcaccttgggtgggcgggcactcagaaggggcggggcactcgcaggggttggcgcggcgcaccctggcggagggctgggcatcctggaagggaggggcactctggggagggcggggcacctgggagaggaccactccgggggagcgcggggcctagggcaaagttgcctgggggaagggatctggcgtccccgggattttttattggggagatagagagaggggttcctcacctgcagagtccgggtccctgagcagtgcagcacgctctgctgccctcgacgcagctcggccgcgctcatgggacgtaccctggggtccgacagaagggcagatggtacatcctgatgtcttcc

SEQ ID NO: 1905 - DNA, 53367 bp, Homo sapiens
cagagccatagcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtaaggcagcagatctcctttcaaagtacctagtgggtggacattgactccgcactcccacctgcatgctttgattaatgactatcttcagtgccttgttgccctctgccacctcaaccatttatttttttccactttattcatttgtatctgttaagtatcttcttgtctggggctaattccattggaaaagcaggcattatttttctagatgtgaaaacaagttggttgagaaaatagggaaaaaaatcaaatgttggacattctttgagaagagggacagaattgggatatagaggtgatgttgcctggcttccttgatgttgctctggtttatgaataaatgcgctgttcaagagtttctagcactgacccagggacagtaaaaggactgtgtttctggtaagataaacagaaagcttaccctactgtaagggagagggactttttcaaaagacagagaatgaggaagttcctgcaacagtctcgcttgtatatttctttctcctgatactgcatttgtgagatttgatatcgtatgtatgtccagagagccaactttgagcctttcagtaccaacaatccaggaagaggataaaatttctgcttcaaacaggtaagcataggtaggtggagtcattggagctctgtctttaagaagggacccagatgacaactcatccgggtatttaataagaaacaagtattacacaagagaggaattggggatttcccagagaaactgcctaatgcactgggaatatcccaatgaaggtggctttgacacctgtgcatgaggagaggcaaaacctttaccttctgcctggacaaatagctctaactcttcatagcaatccaatgacataggagctgttgtcatcttcatcttacaaaggatgaaaacaagtaccaaacaggtttgaataacttgcttgctagtcacacatcaattacatagcaaagctgggcatccaacctaccacaggctatgtccgaaaccaaagaaaaaccaaaatagagttgaaatctctctgtgttaaggctgcagagattgtatctttttatgttgtattactgtaaaagtttattaataattcctgtctttagattataaaactgaggtctcggaattgaactctactttcatttggcaaatcagataaaacacctggaattttcattaaagaaaactccccttattaggaagccagagctctagaatctctctatccctctagattgaatccccaaacagaagaggtaaaaggcccttctgtgagcatccagcacaggtgtcaccaagtccaaaagctaaagctgaactgtggccctcagtgtcttattgaactattaagttacaatgctttacatgttctgttaactgtattcccagcccactgtaatagaaaaccccaaaggaggagatagaggaatatattcaattctggtcctttagttaaacaaacaatcctagaacccagagtctatggttgagtactgtgggaacacacttagatgacaaagatgaattagatgctgtctctgtgccccaccatgatgtcaacagcaagaagcaactacaggtgaaacccacgggtggaataggactgtgtctttcctccatgtgcaaagaatagacattgaatacaaaactgagtcacaccacttccctgcaaaaaaaaaagggtacattcatggccagatttccctatttcagaaggcgtgaacaattaataaacatgaggatgatttctatagcaatgggcaacctgcagttatctgggaaaactgctctacagtcctggttcttgaccttggctgtgctctggaacatcttgacacccaaaccacagacttgacaaatgatttcagtatctctggggatgggtgttttcttgtcaaactctccaagtaattccaaagtgagaccctaggttgatgatcactgcatagaatatgtatctaccaaatgcattaggtaaatgtggtcttgtttttcattttaagtctgttgggtgtgtacttgaatcttaaaattactaataaatgttgatattttgtttgttggtttaggggcatttcgattagcaactttattgaggttattttacatatcataaaatatacccgtttcaagtgtacaattcaatacttttgactaactttacagagtgatacaaccatcaccataaatcagttttaggacatttctgttctcccaaaaagaaccctcagatgtatggcttatttaagcatactcaacagtgtgctggaaaaacagctgggaagagttggggtgtggagaaagccctgatttcaagaatttgcctaattccctggtataaatactcccactatagacaatttcaagctgccaacaatttaacatcatcgaattgaatatttaataatcaacttgtgccagtacttgctcctgcagcacctcactgatacattttttatagataacaatttgagaactcttgacaatgacttgttgcctctgccagaatactgaacataactcgaacattataatgactttttctttgaacctttaaccactggcgagatagaatctctaccaaaccttctgattaatttagtttccaaagacctccttaaaaacaaaatgatttaatgtaatggatagataaaaggtagctggttttaatgacttaatttttcaattatttttaagaggttatttgagtagttagataaatccttacgtttatgtttttgatagacataaacagataagttagtggttaaattacagaaatagcagaagtctttgttcttgggcctctgtttttttcaggctctggaatatgtaaatcctgtaaattgagccctgaactgcagcaaatccatcacttgcctttccaggacatatacaacttgctcagagtacaggtttattattttctaaaatacctaaatcaagcaacacagtgcttttccatgtctcatttatagagtgtcagcctaaaatcattaattttctttcatctaaaatacattaatgtgtccagaagcaaaggagaaataaaaccatcttaaattgttgctcagcttcgcttacacttctcaggggagggtatgggcttagggggaagagaggtgtggggagggcaagaagtgagggtgtggagaatcaggggagaggaaggaggtggaccatgaacgaggagatgggtcaggctgtttgctgcttgcaaaatgaaaatatggcaaaataaaacaagtaacaaatactggagatatcacctaagtaacaaactggtaaagaatagctagttaaattactgaaaattccagcaattctttggctttaacaaaggttactatactatttctacatatagctatatatatgtataaacacaaaagaaataacaaaatgaaagtgttttagcatactttaaaattaaatattcaaatgatctagtcagttgtaactccaagtgagaaacataataaacgttctcttttttaaatactttctcaaatcgaaagttgtataagaaagtgccagtgtttggctggattggccagtgccaaagaactagattccaagctctgaatatttaaataaattgataactaattagtcacatataagagaagtttagagtagaccatggagcagcaaaccttttttttataaagggccgggtaacgaatgttttaggctttgcaggccttacagtctctacctcaactactcacatctgctgttgtgcaaaaactaccagagaacacagaaacaaatgaccgtgatggtgttcaaacaaaacgttatttatacactgaaatgtgaatttcatataatttttatgaatatttttctatttccctcaagcatttcaaaatgtacagccattcttggctcccagtccatactaaaacaggtgtctgacaggaattaaccctcagctggtggtttgctgacccacggaataaatgataataaacaaaatgagtccgtattataaggcaggcattttgtagacaccagctctggtctttgaaaggcactggtattccagctttacacaggaagagactcaagagcagaaaaatcaggttgcctacagtctctgagtgtctgtgttcaaaacccatgctgacttcacaaaccaggttgtttccctgctgtgatagtcctaatttactgaccacctactatgcatcagcaccataccattcacacgcataatgccatttaggcttcacaataacactttcaatacgatatcaccatactcatttcatagacgcaaaaggtgacttcaataagctaagtatacgatccaggtcacagactttgtaagtagtggagctgagagacacacctaggaacttaccccagagctttccactgcatggtgctgctttgtagagcccactggtcaaaggtatgtattctagtaatggcaattagtaattattggatgcttatcatgtgctaagcactagtttaagccctttgcccatgtgaacttgtttaatttacacattgctgtgaggtgggtattattactaatgttgtccccatttatagatgagaaaagtaaagaacagagttttaatcacatgcttaagtttccattctaacataccttcaaatccaagagttttgctccagagccttcatgcttgactgctgatgtaacctcctggttttcatcaaatttctctcatcttactatactagtacatgttcatagttcttaatatgaactgagagaagcaaagaaagttctgtgattataacaaagtttactataaaagacattattctttctattcctcacataatatacatgcacatgtacacaaagccaggccagcattctagttaatcagaacattattgaattttgtgtagaattcattttcaggactagaaaaatttattcagctaagaaacgtaaagtcaaaatttcagtggaacctgtttacagcggtgtgacactaactacagcaatacagcttgttcctcttctgtgcacagctctgtaatcttggattctaaaaacggaaggtggttcttctgtggttgtataattagtatgtaactagtgtacagttccatctcttcataactcaagtgaatttcctcttcagttgtggtgtttttctgttcctccaaagggtgacttccttctacttacaagtggaaatctgtcccacagactgtccatgttgtggggagtcactttgtttcattcattcactcttctactgggtcatagatctatctgttgtatgatgacgccaggcaaggcagcatagaggagactacaataaagaaggcatggctgtgcagagatggaggattcatatgcatgtagagttagaatgcagtgttgtgtgggctgagggctgtgacagtgtctagataaaacaatctcctatggaaggctatcttctccacagtagaagtggagaagatggccttggagctgatatgatttttgtcagttgaagttagaaaaggtgaaattttctacagagaaaatggcctgaataaaggagtgatggtagcaaaatatgcaaggattcagaattgaaaaagctcacatgaactcagacccacccagtccccaagacccatctggtttgtcagcattctggtggtctggttctggtctctacctctatccatctcatcctatgagaagcttcaacttggcttttctcttgtacttctgttttcatgaccatactcttagatattttgttaaaacctgcattaatttctggctcctaccaactcccgtagaggataaattcctattctgagcccatcgacctctgtgtcctactgcctgatagaggcctgcctctaccaagagcacagtgaacactgctgggccttatcagtgttcgctgctcaccacttgcttctttatggtcatgcttcccctgaccctgcccactagcacctgcccccattatctgttgttagaccttctttgtttaaaaatgtttataactttaaaaagtgtaagagtaatcacttgttttaataacagtatgatgattatgtaaaagaatgtcacttttgagagatgcatgttgaattatttagggttaaagtgtcaggatatctgtaatttactttaaaactgttcatcgaaagagtcaaaattaaacgttgtattaaaaatgtggcaaaaggttaaaaattattctacctgaaatatgggtattatttcaatgcagtaacattgatgctatttttctactttccagtatatctgaatttatttataataaatagttgaaaataatagtaatatatattaattatcaaaaattagagagatgaagagaagcatcaaaatataaagaaaagcactaaaatgtcagccatgtactactacctaaaataacattgttcatcttgattctagtttttaagaaatgtttttctgtacacacacacaaacatatatagagattgaattgtaatcatattatatgtataattttgcttttgctttttggtaggatatttttccatcatctccttcttgatctgtctcaaagtaggctcttgcttccctctgaaagcatggatatttaggttgatctagattctggagggcctaaaatagatttggtcaatgaacaatgtggactcactgaaggttcataggaatgtggaattacatagtcatcatgttttgtttttaggtagattaatctgatagttcagcatgatgggtggcaatggggctagagccaagatagtgggttagtgagggagttttcagattggtgagtaggaaactagagtgctaacccgggaatagtcaggaaggaacaagggtagaatccagcaattccattgagctaagcaaaataagcgactcatgtccaaacaaaactagttctgcttttgtgtatgttttcaaaatggtatcaaagaaattttgaaaaccttaatgtctcacaaatatattataactcattgtttgctttatcagtataaatttctaaattttcctgggtttcatgttactgctcctagagttctgacttatacaagttgattgcatgtttgggttgattcaccagatactcttgaaaccattttgcagatgtcagtcctgaggtactaagaggtttagccacttgctttaggctagagcacagtaaactccttttaatggtgaactccttaggagcaggacagtggtttattcatctttgccttctccatctgagcataccacttgataaagagcagatgtttaaatgttgaattgccccaagttgagtcaaggccaagaccagaactcaagcctcctgacttaagccagtgagctttccactgaaccaacgctgatgatgtacttgcattcatcactttcagactcactcagtccccttatgcccagtggtttttactggtggaataaattgacgttggttagaggtatcgcctaaaccatggaatagagaagagataactaatgaaacaagaatctgcctgtattttttttacagaccccaatgtacttatagctctttcctatagctgaagcttcctgaaagtgaccctctctgtctcctacactagcccacaatggtaggttgtcaatggcaaccacagtttgaagacaattaccctgaaccagcactttgtgagggataagttacaagagtaaccatagtaagcccagagtcaagcttgattttacttgaagatgagccctcttaagagaacctctgattttcattccctgcctagtcattctaggccttttcaaggttttttccaatccaaataaaatgttccctgagcctcagttactggagagcagtggtgcttttttggtcttgcagccattcctgtactgtgaaggcttccctggggaccgaacagaaggatctcagtacagtgagatgcagttttcacccctcccgcaagtagtggctctgtccctcaggtctgtccaaatctgacttccctgggtatgttggtccatctctgagtcaggctctgtggatttttctttatctttaaagacatctttatctttcattgttttctctgcccctgtctcctggatcactctttgggtctgcatgtgcattccctaagtctctgtccccatgtgcttctggctatctgtgtgagctggcgagtctatcttggtctcttgagttttgtgtctctatctttctatccgtctgtctgcagctctttgacttttgtgtctctgagactttgtgccactctgtctctgaatctctgagtctccatgtctgtctgtctctgtgttttcgtcttccagagcttcttgcatcatttctcagacttcttcaagaacaggttcatcctgatctcaaactcctacagaattctctcctccctttcagttttgatttccattagctgagccttgactcccaccaaaaaacttgggacctgcctttaactcacagatcaatgagatatttgcatgctccgcctctgtcatcactcaggtctgttttctaaagcctggggcagctggtctcaccatttagctctgctcttagctcatgtaaacatgggcatttagaaaagcaattttgaaagatacagccctgctggttccatcacagaaacgtctctattggagagactctagagaatctttctttggcctcccctgtatatcacactacacctgtctgagaccatgtaagaacttccaaaatcctttataaggcttcggcttgattccctctatttgaacagggtccattgctattatcaatggaaaaataagcccacacttgtgaacatgtgacttaatgggcttgtgtgggcaacaccatctttcttagatatgtcacaacctgattctaatataaattacagcactggtagctcttgagttacataagacaccctaaacccatgatttctaatggcatagagggccaaacactttacctttcacaaaatcaaagtatctagcaccgaccctatgaacaaatgagcatgaatgaaatcagcagccaaggaatcccatggaatagttcaagtggtaagaacagattaaaccttagagtgtgaacgcctaatagattcatctttgttctatcactgttgtgttcagaaagattgtgaggctaagtataggctcagcaagaaagacacatcaattagctgtgccatgtatgaacttagagaaggggtgtggcacatatgttatgcatttgtcatctttggtctagatagttcagaggggtgtcagtgtcatataaaagtgagaacaactttgaaaatgaaataagagaaaattttctaaagaagaatgcttttgttggctgttcaactccagggcattttggctgttttaacacaatcaggagtttttttcccactttgcgttgaaatatatgtcctctttataactctgatgaaacagaattgaggttctatttcatgtatcttttccaggcagggaaaaatatatcattaaatatgtgaataatctgtagacatgagttactaagacattttgtcatcaagaaatatactatctaaatggatgtgtggcatgtgttttaaagtgcaagattgctttctgtgtccaccagttcttccagaattattttgcaccacttcccaacagggaccctgtgctccagctaggcatttggttgcccatgcacaccaagcccatgtccactccagtgcctttgcttatgtcatttctcctctcagaatgcctctcactgcctaatgaatcctatattcattcttcatactgcagtttatcattctcccgctccatgaagttttccctgatcattccagcccactgtgagctccccttcctatgctataatatttactgtccatatcactaagatagcagctatttggtgattcttctatgttaacctgcagatccttctcttttccattctgttggtactgaaaagtcacttagtactttgctttgcccttctcttcaaatgccaaattctgtgaactcaaactgttcacattattgaagtgaattaaagttttcaggcccaagagtccttcccatacatgctcctcaaactctaaagtgcataacaatcacgtgggacttagcaggttgagggaggggcctgaggttgtgtgtggtccatgttggctgctcattagcaactcttttcacttgacacttcccagtagtaaaaagtttcttattgcacctgattttaaaaccatcactcttggctgggcgcggtctgtaatctcagcactttgggaggctgaggcgggcggatcacgaggtcaggagatcgagaccatcctggctaacaaggtgaaaccccgtctctactaaaaatacaaaaattagccaggtgtggtggtgggcacttgtagtcccagctactcgggaggctgaggcaggagaatggcgtgaacccgggaggcagagcttgcagtgagccgagatcgagccactgcactccagcctgggcaacagagtcagactacgtctcaaaaaaaaaacaacaaaaaaacaaaacaaaaaacaccatcacacttataagtgcagatgaaggaaatgacctaattggaagttttaatcaacagtaagtccagtgtgaatcagctatgtgatgcaattgtgaagaaactaatgcattctcgggctgccttatgtgtgcccagcagccagaataagggagctcctgtgctgctttgttttgcaggtcagagtttaacgttaagacagattttttaagtttgaaaggttttcagatgagatgagttctttgggtgataaggtccctggatgataaaggaactgaaagcctgtcataaaaggaaaagctgaagatgatggaaagagaagaaggtgcattctaaatgctttcaactctttctataagtatcatctatgtaactccaagaagtagctctgaaaccatctgctgaaagccatctacacagcaaaaaatggcaattcattgtagcccaagagttttctaaccatgaatcatgaacatatggattaagcttgcctatacaagtactgagttccccatcattagcaatatgtaggcaaagattggataagagtactatagagtttagaaattattcaaacactgttgttgtgcatttctgacaagatcccaggtgatgctgatgctgttggtccatactttaagtagcaaagctttgcactgtggtttaaacatcaggtacaacccgttagtaggcttaaagtgaatttaatgggtcacatcaatattcattcaaaataaagagaaaacaatatattcaagttaatagcctatagaaagataggtgttacgtcctgtaactttttgttttttgtgcgtctttgtgacatatgtatgtttatatatatacagagtgatataaaatgtattttgtactgtgagtcaattcaaaaaatttaaaagcctctcctttaaagaacagaacaaatgaggtataaagttagattagtaaattaaaacagtaaaacccagtgggataagaaactatgaaggttccactattctggagcaattttccagaagattctagctcaaagaggccccagaatgaaaggaaaggaagctgaaccgaggaccagctttctggatccagcctgtccacattctctgtggctgagtttattttctgtatcttactaagaggcagctatgaaaattctttagtgggtggtgtttcctagttttttactgtatcatggaaaggataatatcactgtttccttcaagttgaattgctggttttcataatcttataaacccagtacaaatattcttttggagcttgattagtcttttctctgttgactttatcagacttgagacataattatggcaatgtgtgggccttggggaaaatggagactattaacattctttctaataggagtttcttgctcttttttgcttcttcagggaaaatgagactagaagaattttttttttaagtttcaaaaaatgaacctattcccaactgcataacagtgtgttcctaccactttgcaaatgtctagcatatccataatacattgtttaatttagcaaatctagttttttttctgtaaaagttaaagaattgcataaaaaatttataaaagaagaaaatttttccaatacatgaaaataagaaggttctctggccaggcgcagtgactcatgcctgcaatcccaacactttgggaggctgaggttggcagatcacctgaggtcaggagtttgagaccagcctggccaatatggtgaaaccctgtctctattaaaaatacaaaaatttgccaggtgtggtggtgcacacctgtagtcccacctactcagaaggctgaggcaggagaattgcttgaacccgggaggtggaggttgcagtgagccgagatcacaccattgcactccagcctgggtgacaagagtgaaactccgtctcaaaaaaaaaaagaaagtttttttcctaggcattcttactagtcaccttgatggatgagaaaactgaggttgctacttgccagggggtcacatagtgaataaggtaaaaattgttggagcagatagactacctgagggaacgaccagagacaaatgcatgacctctcctcaccaacaattataaaaacttcattactaatcacattgagaagctgaaaatagcttttctatactatcaagaagtttttaaagtgttctagatgaaagactgaattatcattccattcccccatagaaaattatattattaaattattacatgaagagacaatcaaataccagacagcaaaaatatagagaaaaaaattataaggtttgattcaacagttaattaatacaaatacgttattttctctgtgttgtgatgtttgtgatatttttgtttttaaaatttgtaatttgcgatttctcattttaaataaatattcctttcttttttgtaattttgcataatttgtcttaaagagacctccagattttataagcttcaagaccattgaaatctgcctcttatccctaataactggaatattcaaatttttaaaaattgaatatagttctggcccggcacagtggctcacgcctgtaatcctagcactttgggaggccaaggccgggagatgacctgaggtcaggagctcaagaccagtctggtcaacatggtgaaacctcatctctactaaaaatacaaaaattatgcaggcatggtggcacatgcctgtagtctcagctactaggaaggctgaggcacgagaattgcgtgaacccaggaggcagaggttgcagtgagccaagatcataccactgtactccagcctgggtgacagagcaagactctatctaggaaaaaaaaaaattgaatatagagcaaattatagaaactgtaaggtccatgcaattagattttatgtaatgagctattggacatgcatattaagccacaggcagctctataaacatcagacaaggaactgtcagtattcagtgccacatatagagcctcaatatcctccaccttcatctctcaccattcccaactgctgtccttcatcactcactttgaattctcacatgactacatgatattctgattctcatacacgccttgcattctctcacttctaggcctttgctgctgctattccctcccatgttatatctccctgaacaactgcggatccaaaccccaccagacttttaataggaaaaagccaaactctctctttctctctctctctctttctctttctctctctctctctcaatcttcacctaagtgcctaggccagtccaagtactcaataagcagtagttgaataaatgaaagaatatggcaaattattaataaggttatctctggaagttggattaagtaagaaattagctattttctttttttctaattaaatttgtagctaactaatatagaaatctatttttttcattagaacaagctaaattagaaaaatctgatcaagctaaagtctcctttgaacaaattctggttccttctacaaagaaaatcatacttatgaatttggtgtatatttttaaaactcttattttatgtttttatatatcttaatatgtaagcatatttttgttgttgatattttataggggaacgtgttaaaaccaagtggtaacatttggtgcctgcaactagttcttctaactttacaatatatgttgggatctatcaactttgatgtgtgtgtgtatacacacctatcttcagtgattctcagtggtggggtgtaattgacatcatgaacaagacaattcttggttcttcaagactgtatcatttgtaggatgttaagcatccctggcaccctctcacaaaataacaatagcaccccgactccctgccctcattatctggcaaccaaaaatatgctcacagcttttcaaacacttttggttaactttttacataatctcatccttttagcactccactttatttatcatctccatgtcgatggacatttaggatggctctagatttcttactcttacaaacaattctgcagtgaacacccttgttcatattttcttctgctcatgtatgggtgtttcactaggtggaaactagaagaggaatcgctggtcatatgtggaggttcagttacaccctatgtgctaaattcccctccaacttagacccttatcaacaatggacagtaatagccattgcccaaattctccaatacttaatactatccaatcctttcattataaccgatctggtggataaagaaaaatatcacattattattgtaatctgcatttctctgattaatagtgagattatttatttgaaacacatctttcctcttctgaaaaacacatactttatcttctttacatgtatatattttaacttttactatatatgctttataatcagaataaaaggtaacacaaccttaaaaaaaaaaaaacaggttatatttcaaggcctatacagatgttggctcattcagggaacctgatttcgatctttctttttagaacatcccttgggtactttattctctcttggatatagtttgcaatatgcttgtcttattctcctgactagattaatggttatttgtcacccagtctgaggcttttccatttttgttccctttgacctgcctagcacaatgccttgcacagatttgaagcaatgactgaaggcagaaaaggttgattatgggaaaactaccaacttaactctatttttaacttttatggacacagtcttgaatcatccttatcaaaggtggacatatttctacaaagaatacaaatgtcattaggatatacattcactcccctgaaagaaatgctcatcagaatgttccaggaaaggaatgcttaactcaattaaaaggggaagtttaggtttttgtggaaaagctatttggggaatgaggatccttattgcaccactgacatcatggaatgtaggtggctgcctggaaagctctatactgggcttgcccaggccctggagtctgtaaactcctgaaaaggcaatattgactcaggcaaagctgccaccaaggaattgcagtctccaagaattttccagactgcagcttagtgtgattcttcttgcattatactcaagtatttcttatgtgtttatggtatatagttattgttttttaaattatcattaaaacattattagtaaaaactgttatcaggctataattagacgtcaaaagaattctataaatgttttaaacgcaaacttccaattctattgaaaagaatccaaaggaatgtccaaatcctttaaatgttttggaattttgcgaatcaaatattgctttacataaacaactgttatcaggctatataattagatgtaagaagaattctataaatgctttaaacacaaacttccaattccattgaaaagaatccaaaggaatgtccaaatcctttaaatgttttggaatttcacaaatgaagtattgctttaaataaacaatctgctggctcgaactgaaacttatgctgaaatgtttattataaagttaattattggcaaaatatatctaagtttttataaccttgtggaaatttcacctatcaaaaagaattagaattttggcttcagttgaacttgaactttattattgtttcacttataattcttccaattgttctttgaaagcattttgtagtgaacagatttgaacttgtctgggaatcagttcaatgaatggagctgctttgggtaaatagctctgtgtttattcttataaaatgtgtttcatgccattgctttcagctagcaaatatatttctaatataggatgaaagcatctctgccccaaagataaaatatgctaagaaacatgcattaggaaatgcagatttagaaaataggtatcttggagacctatgtaaaaacttccttccacaggtgcacttaggtttactctttattactcaggctaaaagtttatgccacagggatgtctcagtggatatcagtgtggttcatgacaacaagatcccttaatgccagaatagggctattcctcaaagcttttttacactatacacacctctttaatagcatttagttcatcacactgacattatttgtataattgcctgtctctctttcatcttcactgacctaaactgtggtccctagcagtcagcaactgcctctgctgtctagctttctgttatctgatctaaataaaaagtaacaaaaattctatttgagcaataagaaagtcatgccacagagggtaaattgaaagttacggctttttggatctcaatggcttcctggtagcaattaacgcatactaagcactgctttagttgccaggctttatggagcacatctcatccatgttaatgtgtgcaggactcacaactggcctatgccgtatgcctattagtcatactattttaaacatgaggaaccaaagctcagattggttaagtaacatgtccaaggccatacagctagtaagaggtaccacctggattgggacccaggcaaagcaacccccggggccacaatcctaatcatcacatttcatgcctctatgacatcgtttaaaagaatgtgaatgacctgttattggagaaaagaaagatggtgcagagcaatatgcctagaaaataaaaataataaataatgctcgtatgtttgtagaatcaggagtggaggtacacatccaatgcctctaagtgtgtagactatctcttaagaggaagcacaggaaaatggttaccaaggtgtcctctaggaaaggaacagggagcctgagggcccagggtgaagaaaacatgttttgctatgtctccttttggacaatttgaatttttttttttttaccatagatatatattaccttttctaaaacacaaatatcattttgaatctccttgagcattccctagctcttcagatacttgtcaggctgaaacagtacttggtggcatttacttcatactataattccttccatccagcttcgtttcactcatgacaatagcctttagtattatagcacagaggtttcgccgtgaaaaggtaccacacttgaaaaagagtgtgagagaccaaaaaaagaaggaaattggtcaaagcctattcttatggtattttgacttggactttaaaaaccaattctgattacaaagcaacactgtattagtttgctagggctgctataacaaagaaccacagcctgggcagctgactataagaaatcgattgcctcacagttctgaaggctcaaagtcggaaatcaaggtgtcaacaggattggttccttccgagggccgtgagggagaatctgttccaggcctcttcctgtggcttggaagtgactgtcatgttcatgcgctgttctccctgtaggcaaatctatctcctgattttccctttttacaagaggacaccagtcatattgaattagggcccaccctaatgacctcattttttttttttttgagatggaattgcactctgttacccaggctggagtgcaatggcatgatcttggctcactgcaacctccgtcccccaggttcaagtgattctcctgcctcagcctcccgagtagctgggattataggtgcctgccaccatgccaggctaatttttgtgtttttaatggagacggggtgtcaccatgttggccgggccggtctcgaacccctgacctcaagtgatccgcctgccttggcctcccaaagtgctgggattacaggtgtgagtcaccacacccagccatgacctcattttaacttggtaaagaccctgtctccaaacaaggtcacattttgaggtactgagaggttagcacttcaacataagaactttcaggacacaattcaacccatgtcacgctactattagtcaactctgtgctctcctttcagccccacccagggatttccttgtcctaatgttggggctgagagctgggtctctgggctacttatcttgaagaatgttgctaggtaatctttgcaaggaaaagccagtgcagggggagtcatgccatggtttggcctgagtgaaagcgctgttccctcctttctaggtggtatcacggcaacctcacacgccatgctgctgaagctcttctcctctcaaatggatgtgacggcagctaccttctgagggacagcaatgagaccaccgggctgtactctctctctgtgaggtaaggtgcttcagggctctacgacttcagcatgggctcctctgtcacttactgactttatcatcactcaaattgccagacagcaaaacttcccaattcctgttggaccaccaggttaaaggattccaaactctaaatgatgagggtgtaaaacaacattcctgctccattcattagcaggaaaaaaattgttagagctggaggagacatgaggaattatttgatggaaacctttcatgggactgttgaagaatctgaaacccaaagcggtggaatgtctggtacctcaaaaatcaacaatagaaacagtgccagaatccaaattcctgacacctggctcagtgtccttttcactattctttgatttctctgtaaatgcagaatgatttatgactgtacggctttcatagtcacaacctcaaggaggcaatatacatgtttaaaatttttcctatagtgggctagcttttcatattgagtctctatttctcccaaatggtaagaaagttaatccagtccccaccaggttcatacagccaaatgcagtcattgtccagatctttcaggtcctccccacctcacacccccttctttctgtctggtgccccagatcagagaggctgaccaagcttctggtagtcaggggaggcggctggttctcagtcgcatctgacactctggcttccactgacatgtagcaagtattcttgggtttttaggcgcttctccatggattaggcaggggatgtaaggactccatgaaatttccctcagccacccacccattaagctcaaactgttattgtgttactgttctgatggcacctccatataccctggagagtcactcttcccttcatagtgcagttcctcaagctaatctggcctcagaggctctctcacttctttcccagtctacacggtcactactggtcactaactcagtagcagcattcacattgtctctttgggctctgggccttgcttctatattcattttctatgctacataacaaattatcaaaaacttagggacttaaagcaacgcaactggattatctcacagtttctggctggattctctgtccaggatcctaccaggctgaaataaaggtgttggagaagcttgtggctctgatctggtatttagtgtcttcttccttcattttctcctttcctcttcatcctttttcatccattcccttgctgccgtagaactgaggtcctccttttccttttagctgtcagccaggggccattctcaactcctagacgccacccacagttctttgccacatggcacccatggctgtttaccacatgggtgtttgctttcttgcatgccagccagaacacatctccctgactttttcttctgtgagcagccagagaaaactctgttttacagggctcatgtgattagttcaggcccactcagataatgtccatatcttaacatcaactgacttgggactttatgacctgctaaatcccttcccagtagcatgtagactagtttttgattgaataattgggataaagtgtgtgtactccaggggctgggatttgggatcatcttagaatgctgcctgccacaactcccattcctggaacagtgaaaatctacaggcctacttgaagtgggtgggtgtgcgaaacaggtagagggtgatggggtaagtaggggtcacagaggaaaaacaagcatattcattaacatttctcatgtcaccctgttatattttatttataaattttctgaataacatagatgaaaaaattattaatccaagatggaattctgtttgagtggcaacaagaattgtgctttctctgctcaacagcaaatgttaaaagttcatctaatggttaagttgtagatgctttattgcacacatcagaggtcctcaacctttttggcaccagggacaattttgccacagaccggagcagcggcagatggttttgggatgattcaagtgcattacatttattgtgtgttttatttttgttattattacactgtaatgtataatgaaataattatacaactcaccatcattcagaatcagtgggagccctgaacttgttttcctgctactagatggtcccatctgggggtgatgggagacagtgacagttcgtcaggcattagattaacatcagaggcacacagcctagatcccttgcatgtgcagttcacaatagggtttgcactcctatgagaatctattgcctctactgatctgataggaggtggagctcattgagaatgcaaacaatggggagcaactataaataaaaatgagcttcgctagctcacccatcactcgttttcttgctacgtggctggcagggggatggatggggacccctggcatgaatcttccaaaaatgaaaagttaattaacttttcacctatgtatgtctcatctgagcaattagatcataagctttttataaatcaatgacatacatatttcatatacataaaaaataaagaataaattattgattttcattgcaagcactagagaatgcttattaaaaaaatgaccagcagaggtgacaaaaaccacagactaattcaggagaatgactatttttgttttatgaacaaatattcacttatttgttcattcttttaatgatgaatatttgaaagcatttattctgcaccagccactttggtacgtgttgtagaacagtggtccccaacctttttggcaccaggggctggttttgtggaaaatgcgggttcaggatgaaactgttccacctcagatcatcaggtattagattctcatgaggagtgtgccacctagatccttcacatgtgcagttcccaatagggttcaggctcctgagactctaatgccatcactgatctgacaggaggcagagctcaggcagtaatgcttgctcacccactgctcacctcctgctgtgcggcctggttcctaacaggtacccagtctgcagccccaggataggggatccctgctgtagaagattgaaataccttattttggggaattacagcctcacagagccaaaaagaccacatacaagtaacatactacaaagtagaggttgacaaataacataaaagaaagcaagataagtgtttaggtggttcagaagggaaaaagcagttaacttaagctggaattatcatgtaatacttgacagaggaggtggtacttgaactgcaccttaatgagtggctgggatttctaccagcagagacaaagagaaagaccgtttcaggaaaaaggaacagtatgaactaagggacagaagtggaaactccttgaagagcagtagatccagttggactagggcagctgttctaaaggtgtggtccccagaccaggtgtgtcacctaagaacatgctaggaatgcacagtctcaggccccaccttggatctaccgaatctcaatctgcaggggtggaggtggaggtggcagcaagctgggttctcacaagcccatcagatgattctgaagcatgctaacatggtagcatgggctgcactgagagtaatagcaggaagtgaggctagaaagatagaatgggatcaaataaagtggagaggcagatatatatatatagatatatatagatatctatagatatatatagattagatatctatagatatatatatagatatatatatattgtttaatactctgcctcatttcaaaaatgaagtggaaaatgacaatgtaggaaatttgatattttattcagtaggcagtggaacatgcacgggaggaaaagggctaggctcacgtaactaatcaagcgacagagctgaattctgattgactcccaaacaagcaagggagaaaagcccaaggcagaggagagtgtggtgagggtgtcatatgtcatttctatcattcctattctctgcccttcttaaactcatgccccttagcagcataatgttcaaggactcttttggtaagtctaggagtagatagggagaacagtctcttgtcttccattagagtgaaaagttgaggctgggcgtggtggctaacgcctgtaatctcaacactttgggaagccgaggcaggaggatcacctgaggtcaggagttcaagacaagcctggccaacatggcaaaacccagtctttactaaatatacaaaaattagccaggcatcgtggcagacacctataatcccagatactcaggaggctgaggccagagaatcacttgaatccaggaggcggaggttgcagtgagcctagatcatgccactgcactccagcctgggggacagagcaagactctgtctcaaaatagtaaataaataaatgaattaattaattaataaaagttgaaaagagcaaactctgccaaaagaaactagtgatgctatttaaaactgtcagtggtttcaatgattgcctaattctcagttcttataaagggttaatagtgatgctaacatctgagatcatatttcccttcaacaagatatttatttgttaaataatattaaatacttctttttcccttttagggccaaagattctgttaaacactttcatgttgaatatactggatattcatttaaatttggctttaatgaattctcatctttgaaggattttgtcaagcattttgcaaatcagcctttgattggaagcgagacaggtaagctatgagcagacacttgacttatgaaataatgtttcgggatggaggagagacaaggcagatttcaatttaagaatgtcattgttgtcatttatatttcagcattatcttgaagagaaaacaatgtattttgtataaagtagatattttctcagaatgtgttacttaatggattgattaaaagcacacaatttctttaaaatgggctcaccattttaaaataacatatacaatacacacaaaaagaacaaaggtaaaaatgactttttgattactcataatttcagatataggcagtttgcatatgagtgagacccacagaagtaaattttgagcattttaaaaactaaaattcccacttaaatgttcacagagatcactgaatattgaaaatattaactaggaagcactctcctaagttataaaattctgtttctattgtcacggttttttaaataagattttaagctagacttaactatggctggaaaagtttgaattttcctgtttgaatggttagagaattaaaccagaaaaaaattcatgtgtaaagaaaaaaaacacaaaaaacagtctatcttggcacttgaattatctaagattgaacatcttgtttatttatattattttaatgaagtaaaatatcatccctgtatttgtgatatagaatcacaacacttttgtcctaaataatgataaatcttagttaatcaaagactaggaaattccaagaacctgcggcacaagaggaactcaagacttaataacacaaccagttaccatgagtttgtacatacgtgttttcttggcaaacttgccagtgggctttctgttaacttcagtgtgatgggaagagatggcatcattggcttctgtcttttctgctatttatgtggtgtgggtagtccctgatgtgactcacacagtgtctagtatacatgaagtgcacagcggaaactagaaaatagttgctctgctttatactgaccacaccaagcccaagaaagaataacccaaactacgaaatgaagttataacctttttttccttctttctcctggtataaattctcccaatcaaccctgaaaattacttcaccatttaacaagcagttgttcccatgaacaaatggccagtggaggtgtatttatttccactgctaccttggccttggcaagcatttcagtttctcaaatccctacacttcagtctcctttcctgcttgcatccaattccacacttgattttgttcagttattggtcactggccatgtagaggagatttttaaagccagggttttgttttgtgtacctctaatttttgtatttcatatccgccaggtcctggcccactgcagggcattttgggtgaataaataaatgaatacatggataactatgagtaagaactctttgtagtcttcaaagccactagagttgtcatttttctactttctctttttcttccaaccaaagacagctcccttcttttaaattcttctcctagactctattttcaacttctttgatcattccctgtgctccttcctgggccttctccaagttagggaaaagatacatattctgcctactggcagatttcaaaacatttaagatcaaagtgaaggcagtgctttctggttgaacctttctggcactgatccaatcatcaggcaagaggatcacctaaggatgcgccaaaataaagatgttttgatattgcatttgggacaatgataagcttccttgtaaatacactgttctgagtaaagaagccttatgattgatgcattagggattgtaaggatttgtcatccagacttctacagtagtttctctaaaactcaaacctgctgtattattatcttgactacaattgccattttatttattacaatataactcaggaacctaatatttttatcctctccactgcctctcctctgttctattcattatccaatgaagaatttgctgctgtttgaattcctgctttcggcccctcgtgctgatggatatgcacttgacttgctggcttccagcccttgagttagagtccaccagctttattcctcttatctgtcccagccagatgaagggaaagccatcagggctaggaacaacaggcaaaacccatgacagatgagtgttcaaatcttgcccctctgggagtaataggccttgggaaacaagataatgtgctcaagtcatgatgacttgtaagcccagaaattcctcaaggttacggagtcagcattgcagactataaagaatggtgaatggaaactgacatgccaccttctaaaaataggccttttcttcttgttcatttaagcatgggctcctagtattggctcccagtgatcagaagatcttcaggctaacgatttcatgttcaccttcagatgaagtacagatatttctttctttttttttttttttttgagacggagtctcgctctgtcgcccaggctggagtgcagtggcgcgatctcggcccactgcaagctccgcctcccgggttcacgccagaagtacagatatttcttatagcttatgtttgattaacatcaccaggaaaagcatttgtccacacaatggacaagcccctcccagggctctcaacttcagattaccagaatgacaaggactagaattggatatttcaggccactgctctcagccagaccccacccaggcccagcctcaccctgcagggtctagagggtaagtttattaaagagtgactttcttataatacatttatctactggcacaagtggtattacctttgagggcaacagaaatgatatccaaatagccaaaactttacacttttgccttgcagttatatataatgccttcagtagagtgaaacccagaatatttgattttgggtcgtaagaacatttttgcactcaaaatagataaaagtgttgacctaaggggattaatgctattttaagatatcttttttttctattccctactctttacacttttaggatttctgtttgctaatctgaaaagcaaggatttcctaagcaacatctaagcctcttgacaactttaagagtattttatgataatttccctttcccttgccataatctctatttcatctctctaatctccattaaagtttctgttcactctaatttctttttatcaatacccataaacactcttaagatacttccaattctcaaaacctaataatttcccaagtacatgatagagatatacaatgtactctcttgctttatttttctcaatggcccttttaccttctgacatctataattcacttatgttttttaaaaaaatacctttttttccacactagtgtgtgaactccatgaagaaagggacttttgtcagctttgcttcctgctatgtcccaggacctgaaaaaataagtactgatcatttccacaatatgtcatgctggatgccccatttccaatgcctgcattgcagttttttgcatggcaacatcaaaactagcaaacttgtgacaattttaactttcaaagtttataaaaacataatttgaaatgatattttgtgttgcatgtatgctcagtgatgattaaattcagaatttgcctttcatttgtgatagtgttgcaggacttttccttagttcagctaaagatcgggtccctctccatcccacggccacaaaaatttaggctcgcagacggtttgaagggtgagtgaagcagggttttattggatgaaaagaaagaaaagagggaaacagggaagctagagcgcttcctgcccagcagtttgaattctatgttcctcacaggaagaggaggggccaggctcctccccactgcaaaggacacgaacttcctaaggcttcacctcagtgggcaggccggttggagtttttctgtctcaatagtaggatatcaaataaaacatattcatgtctgtgcatgaactctaaactaaactcaaatagacttgaaaatttgagaaacttttttattagtataaatatgtttggtccattattaattttgtcgtagcctcttgtaattagctaagtttcatatatatagtcttgaaaatgtagacggcatttatctttatgcttaaatgtctaaatatgattagaacaaaaaattacttttaccattaccttttgtttatgtttcaataattcttaacatgaaattgccatgtataatttattacattgtattgtgactgtaatcacctaacaggcatgaaaaaatataatacaagtcaagttctatgtttgtgcttaccctttataataattggttcccaattttaaagatctcatctggttttttggtaaatgtcaaatctccatttctctttttgttttgatatggggattcccaatcttttgacgacagctaccgctattattattttgttttgtgacaccacccaggtgatatttttaaataatgtggttaaaattaattttaatttgagaattgggtggttcttcagaaaacaactagtgacaacttagaatttttccaaacttccttggatgtttgccaaaaatacaaaatgttctcagtttatagatgagttttattcgaaaaaggaaaaagcagctgaggaagggaattaagccaacatttttagagtgtttgctaggttccaggcattcacctacatcaacttatttcatctcagccacccacaataatgcatacaacggtcctattttcagatgaggaaaggaaaactcagaggttttaagtcacttgcccaagttttcactgctggtaaacatcagggctgagattggaatctgggctaatctggttctaaagcatagatgctttccatgcaccttgctatcttttgaaactggtcccacaataacagtacattgttgccatggtacagtgtggccttaaatggatttggaagaactcagagctgagattggaatctgggctaacctggtcctgaagcatagatgctttccaggcaccttgctatctcttgaaattggtcctacagcgacactgcaatacattgctgccatggcacagcatggcctttaataaatttggaagaatttctgctacaataatgtagtagaatgattgtaggatatggcagggctgtaacacatgtcttagtcctatccctcagtctcttctttatctcttctttaaagtctacaataacatgtttggtacatgaagtaaacctattgttctaaagagtgtgaatcaactttaacttctgcctttgtatttattgttattcccattttatttacatgaattgctatttcagaaattataccagaggaaactttaaaacataaaaaggctgaaaagaaaacatccccctaaatatacaggctcatcttagtcatgtgtcttcagcaaggatatcaaacagcctgtctaagtataacaaagtaaaataaaatttacagcttgagagagaaactgaaagaaagggaaaatgagaggtaagatcaaatgacagcaggaacaaagtatttcaaatgaatattgtacatttacaggaagcagtacaagcatttggtaatgaagcttctcgatgtttttttccccttatttgggcctgtatgcttagttagatttacaggatgttagaattgaaagggagctcagggactattgcatttttcctttataaatgaagaaactgaggcctggttagaaatggggaagcaaaaactcacatctcctttctcaagctgcctcctaaagaatcaatttcttcaaactttgatttatacatgtcaactcttgcccacaatacagcacagtatttcacatgccctagaagtttccatggtgactagattgaggctgagaataattatggtataatgagtaaacacacaaattctaagtttcaactccagcctctgccatttgccggctctgtgtgtctcctcaggtaagttaaataatctctctgagcttcagtttcatcatcttatgaaactgattagatggtagtagctcatactttaatgacttattgtgaagattgaatgaaattaggcacataggacatttggaatgattcttagcatagtataagtattcaataattattattcatatttaataaaatgcttttatggttattaattccatcagattctatgcaaaagctgtacgttctttgataaataataaagaattagtttagggacaattgaatttgcatttatcaaatgtttgtgatgtcctcttcaaactttaatctagttccatagtggactcatataagtggtagaatcaagtgagcactccaaaaatagtgacttgacttggatatttgaacagaattttctcctacactgactaactggtatgtctctcctagttcagtgcacttcaccctatgagactggaaattaaatattaaaaccccttcacatgtaaatgaacaaggcttaaagtccatttgcagagcaggtggcaaagaaggaaggaaaaagatcttgaataaccctattctctcccaccaaccccaagaaatctacttctcattggaaggaggggagagaggaactcattatgccagttgcagagcttattttctgaacctgagggcagtaatgaaacacggatggacatgatctgattttaatttaattcaacaaaatgttttgagtgaaatggccctgtgagccactgataacatagaaagataaatcagatattattcttgccttcaaacaccttacaggctagctggggtacctgatgaataagcactgacctcactgcataaaataaatactctaaacaaaagtttttctttaggagttttgtgtaccctgtgctacactctatttcagataccaaaccaatgcctaagaattgagactgttcttactctctttctgagttcctgctggaatacaagataaagggtccttcaatgcaatttcatattattgcatacagttatatatgtaactcttacacataactgtaagttaccattcagtcaaagtaaatggaaatgcctgccttggtccagctctgatcatctcaaaaacatacctccgctaagcatggctgaaaccaggtttcatgtcaaaggcaggaaacaatagtcacctttacgtagttcagaaactgaagtgaaacttatagccaagtttccaaggcctgtggttactggtcttcctcattcttcttgctctgctacccctgcctcctgttgcctttttctaaatctcccagctgagtcctggagttcatttggtctgaatctcagtaacccagggtccctttcttcccgagctgaggcactaacttggaccttggaggcaaagtattaagagtctgtggtagcgacagtagataagtttgtttgtttgtttgtttgtttgtttgttttgagacagagtctcactctgttgccaggctggagtacagtggcgccatctcggctcactgcaacctctgactccctggttcaagcgattctcctgtctcagcctcccgagtagctgggattacaggcatgcgccaccatgcccggctaatttttgtatttgtagtagagacggggtttcatcatgttggccaggatggtcttgatctcctgacctcatgatccgccccctcggcctccaaaagtgctgggattacaggcatgagccaccgcgcccggctgataagtttcttttgattggaaatgacagaaaccagctctggctagctgggtttttttggtcttgtttttgattttgtttttaagtgagtagggtacaagaacagggaacaggagcagaatttttttttttttttgtgatggggtctcactctgttgcccaggctggagtgcagtggcacgatctcggctcactgcaacctccgcctcccgggttaaagggattctcctgcttcagcctcccaagtagctgggactacagacgcatgccaccacgcctggctaatttttgtattttttttagtaaagacggggtttcaccgtgttagccaggatggtctccatctcctgaccttgtgatccgtatgcctcggcctcccaaagtgctgggattacaggcatgggccaccgcgccctgcccaggagcagaattttttaaaaggatattaacaatataccctcccagaatttaagggcaagttgaacaaccaagagacaacaaggaatctgcttagtaatcatggcaagtctgaggctttcagtcaattgatgtgtctgtcttgattcatctctgatcgtctcagaagtgtacctccgctcagcctttctgaaaccaggtttcatgtcaaaggcaggaaacaatagtctacttcatgtagttcagaaattgagttggtggaccttctctctagagaagcaattaagtggatccccaagaagtgaatccaattagtgtgaccaggtcaggtattcgagggccgggccaggtctggaggtataacatggttatagggaacctatctctgtatactgggaggtacaatctctgcagaaggggaaatcattaagcctcacagccatgccaagaagtctgtatattggctcttccttgggcaagaatagtcatctaaggagaactgtcttttaggacaccagatttttatcagtataagttgccgttttataagtactttgtcatcttcatctcacaatttagtttagcctcatttgtggggttactagttaaaatcaatctacagtcagttttactctcttggttgactcaatgccattttcctttgttttacttttgttgaattaaactttagaggaggttttcaaaatagaatttgggttcctccaacagagatttgaaaagttatgcctgcggttattgtcctttcttgcctcaggcctggagaattgtggacctgggaggctggttcatcccaggttctttcttggttcaagcctgcattactgtagcattcattcattaattcattcactcatctgccttcattatgtcagaaactctatcaagtggtagggatacaaagataaatttgactgataggtgcgctgaagaggctcacagaggttggaaatgcacacgttggaaaggcagtggctgtctaataccaagaggtgacagcactgcaggctcaggcagcagcccagcccagagatccttaccctgcagcgcaactggccccggtggctatttctcctccagggactgatactgtggtaggaggataatgcccccacaggacgtccacatgtctccctggacctgtgaatatattgttacatggcaagagggaattaagtttgcagatggaattaaggcagctgatcaaataactttggggtggggagattatcctagatggtctaagtaagaccactgtaattgacagggtcctcataagtagtagggagccagaagggagagaaccagaaagatggcagcaggagaaggatctgactggctgttactggctttgaagacagaggaaaatggccacaagtcaagacatgagggcacctctgaaagctggaaaatgcaaaggaatgaatcctccctagagcctccactaggaaagcagccttgccagttttagactagtgagacccatttcgaacttctgacttccagaattgtaagatgataaatctgagttgttttaagctgttatgtttgtggcaatttgctacaatagcaataaaaaattaggccaggcacagtggctcacgcctgtaatcccaacactttgggaggccgaggcgggtggatcacctgaggtcacgagttcgagaccagtctggccaacatgacgaaaccccgtctctactgaaaatacgaaaattggcccggtgtggtggtggatgcctgtattcccagctacttgggaggcagaggcaggagaatcgcttgaacctgggaggcagacgttgcagtgagctgagatcgtgacattgcactccagcctgggtgacagagcaagactccgcctcaaaaaaaaaaaattaacacaggtattattatgtgaagtgtgtgcctggtcgtatcaactaagtacatctttctggagtgtcatttaaagcattattttcatattaagtattaaatatatgaagtagaatgaaaattaagcatcaactttgaagataaagtataagagttcaaaatgtatctaatttgggagctgctttgatccctaggcttcagttcccctctcctcttctgtaaggtgaaagtgtttgagaggcaccaatttaactatagttaatcacaagtagtgattactagactaccaccatttttattcctagcagaatgttgcgtctaggtcttttttaagatttcaaaatccatgtccccaaagatgcaatcattcaaattttatttaaggatttaaaaatattctgtcaaagaataataatatctaatatgttatcattctcccacaaacatttatttggtgccttctgaaggaagcataattattctcactagtaaggagcagaagcttgtaatggttgtccaaggccgataagtactgaatggcggtagtgacaattgaaccctgttcctctgcctgtgcatccagtgctctttccaagggtccagagtgactatgaagcacatcactgggagtgtttcttagggttgggagccagcgctgaatttaccatgcatctacaatgtgagcactgtgttcacagagcccctgagcctgcacagcagctactcttgatataggtactgctgctttcattctgactgtaaaactgtagccggccccttctcctcatatgactggatctgttcttatgggaagatcacattgacaaaagagagcacaatgtgcaagaatgggacggttctgataatggcaaaatctgtttttcattgtgatcccaatgctgcaatgccaatgagagacagaaagaggaagggccagaggctttcattcttctctgaggtcgagatcagacaccctcttctggcttttctcaacagcttttcattttacagcagcaccttatctgggcccaagtatcaaaagccacagttctgtttttgcagtcagacattgtatgtattcaagtatcatagacaggttttgttttgtgtagttttttttttttttttttttttttgagacagagtctcactctgtcactcaggctggagtgcagtggtgcgatctcggctcaccgcaacccccgcctcccgggttcaagcaatttccctgcctcagcctcccgagtagctgagactacaggtgcctgccaccacgctcggctaatttatttttgtttttattttgtattttagtagagatggggtttcactatgttggccaggatgctctcgatctcctgacctcatgatccacccacctcagccttccaaagtgctgggattacagatgtgagccactgtgcccggcctgttttgtgtagatttatcattaacattagggtgttttttaaccacagaggagacatttttctttttcattttctcactcttactctaattcaggttctatactctccagatctttcaaatcttttcaaagacgcccttcctgatgacccttgtaaaatatcaccctctcccaaccctaccttttctattctctatccctttaccatgccctattcattttttccataacacttctcacacataaaatattttttaaattttttttctgtctcctctacctagaacataagctcgataagagcatttaaactcctttgtgtgctattgcattcccagtacctagacaagtgcctggcagagtgcaaagctctgtaaatattcgttgaatgaattgctgaattctttacatctcttccatgtctggtacaatcttaggcttgctatagaaaagaccctagtaaaattaaaagcaagaaaccatagcaagaagaaaaaaaatccccttaagttgcctctttttgtagttagtttctagtttctgattgactgattgattgagggaaggatttcaagaaggaaatgtcagaaacatagactcagaactgctctgagcccttggaacaaagttccccagccccccatgcctggaccccctgggctgagccctttttctgcctggaggctcccctctccagatggaaggggaaggaggcaatcacttgtgagcaccagcttgttcaggtcatgttcacttagtaatgcaaagactttgcttggttactttcattaattgggtagtatcagagagtagggagaatgctcacttttttgaaatccactaatttgttacacgtttattcggaaactgattgataggaaataagggcaatggaatggatcttcctctaccctagtgcttttgtttagtcttgttctcatggctttcataaagccttcctggaaaacttccagttactacttaagatctaaatcaaatgtcacctcctttatgaaagctgtcctgaatcctttcatggaaaggttcttcaagcagtctggggatgattatcatgctttgctcacacggctgccattggtctcatcaccctgttcatttaaacgaccatatctgttaccagttctgagcaccaggaggccaaggaacatctccatcatgctttatatctcagtgtccagcttaagtgccttatacctaattggtatttgataactgttgagataatgagcgagggaatacatgaaaaaaacaaaagactttccaatccagccacagttatccagttagcatttggaccttccttctgggaacactgttcgattatatatttttcatcttcattcaggcactctgatggttctaaaacatccctacccaagaaaagtggaagaaccctccatttatgaatctgtccgggttcacacagcaatgcagacaggaagaacagaagatgaccttgtgcccacagcaccttctgtaagtgaccttcaacgtgaccacaagctctctccctgtctaaaatcaatcaagttcaataaaagttaataagagtgtatttgttcacataaaaattctagcttggaatataaaacttggaaaggaatgtgagatttgaagcctatgactcagttcatctggtcctgggtagatcataaaaattacaatgcagccagacatggtggttcatgcctgtaatcccaacattttgggaggccaaggtaagagaattgcttgagcccaggagttggagaccagcctgggcaacataaacatctctacaacaaactttaaaaaatattagctgggcatggtggcatgcacctgtagtcccagctactcaggaggctaaggtggaaggattacttgagtcaaggaggttgaggctgcagtgagctgtgattgtgccactgcactccagtctgggttacagagtgagaccttgtctcaaaacgaacaaatgaaagcaatgcaatagtaataggattttaaatacttcgaaaatggaacttaaatctctgtccttagttaaccaaacaacttcaaagtagaatggaaaagagaagtttgcattcacatagttttctaaactgttttctcctacaattttcttatattaagaaaatatatttttttaaatatttcaactatctatggaagacaaatattctccacctttactataaaaactcagggtattattttttctagctttttttcctttactgactgaagtttacagacagaaaacacttgtgcttctttgcaacgtgagccattgttcaatttcagtgcaattggagcactcattgtttgtccaagagtccatttatgtttgttctgtgaactgtgactctgcagaggttcctctccaacacccttttcccttcattattctgaaggcccttctatttgttgtctcttccttgtttgctgaatactcctggtataagaaacctctatttgggcagatgataaagaagataatacccaaataaatatcaagaactaattctggatagtaatcatgacacttgaaaaataatcacttgaagatattcagctacaaattatattaaaataagtgtaactttctatatctgcagtacttttctctacccttgaccagagagatctttcttaaaaagaaggcttgccacatgacctctgctttacatcctttggtgatgccttttgtgttcatggcccacctggaccctgcttgcctctctgtcttcatctcatgctactcccacactcacactgtgaaacctgtctctctcaacattgtgctctttctcctctccctacatctgaaatgctgccaacaccattgctatctactcatccctcaagactggtatcacggatcattatcttccaggaagcctttcttcacccccactagcttcttttacaatgctcctcttctgtgctccagagcaccctctgtttgcctttattctaaaattaccatgctgtgggctaattaccttcacatctctctgccctccccaccagccagaaacatctaagtacatgaatcattgcttgtccttgcagctttacagcctagcctggctcatggcacatcttacatattcattgcagtgctacatctcctcagaaataaaaatcctgaaaattgactgagaaagttattttggctttgttagaagtgggggagaaggcatcaagaactcagaacttgagaaatttaggagtgcaagacaataaatagtccaaaggcagaaaagaccaaagaacaaatcaagatctactctgcaaccaattcttgttttccagttgtccagtcccttcataatttcctctttacccacccttacccttaatatagatcaccagtcacttcaacatctctttcatttgccctgttagtttaacttcacattctcctctgctacacttcccctaaagatctccactcaaggtcaaacaaaccatgtcctattaagcgtgttctttatcggcaataaaatgcagataatacctaatttgtgagattggtgtgagcagaagatatagtatccttatgcagaaataaacctctttaaagcacattctggaaaccttgttacttaccttcttttctcactccagctatcagatggattcacctcttttaaaatggagtttttaaaatagtggtgagtgattggttgacaatgacttgaactcacactatataatgacaagcttatgaagttgattgtacatcactatggacaaaaaaaatgtaaaggtttcctagaggatctgaaatgtttctcattacttctcattggggaatcattggtgactggaccagtatagctgctggggaaagagttctggtctgatcagaatgctcttgtcccttattgaacacaagttctaagccttcatttgctaccccaaatggctacatgatgctgcacctccatctccagcctgagagccctgagggttttcaaacttctgcattttctttttggggtgtagttcttgctcaaggtctagcagtggaggaagagaattaaaagaacttcttgtttgaagcgaaagtgaaagatgccccactgcccagaaatgcagatgactgtgtataactgtttaacatcttttagtaactgcatttggggaaattgctatttatgtcttataaacaacatagcattgagttcccatgataggattaaatttaattaattcatttattaaacaaactttttttttttaaagtgcttccaatacactcagaactgttttaagcactgggagtttggcagtaattttgacaaaggtcctcctcccctcactgagctcacattctagtgaagatcacagacaataatcaatgcagtaatctgataccagacagtaatacatcatgaaaagaaaaagtaggataaggggagaagagggaagcaagggaggcctctgtgaggaggaaccattagtaagagatttcactgaagggaaggagtgactcatgtcaagatgtggaaagagtgctgcaggcagaggaaacagtacaaaggccctggagtggaaacaaaattgaggtgcttcaaaggctaggaaggtcagaattacgggatgaagtgagctagaggaaaagttgtagaaggtgagattattgaggtaatgaggggtcagatcacataaggcaatggagttttcaaagagcagcacctcccagctgagcatttagaaatatgagtgtttctgttggtgcattgctttgcggcactactatcatgcgtgagtgtcaagagccatgaagagtctgactttactctgcttgcaagctaacaagttagcctgctgcagtttcatgtatgctgatggatgacacaagacttctgggtaagcgttgaaaaatagtttgctattcacaggaagagcaacagccaggatatcagtatttatgctaattccctgtgctgagccgaagttcccaaagggcaatattgaaagggccaggtgatatccacaatgggttgccctacaggagaggaaccctgagccttgggaacccaaatcttttctaatgatcagtagacatgtcttttgttctgaagggaaatatttctttattccaaggctgcttgtataagcatactttaaatatcagtctgcagcaaagaactgttaatgccttgctcataagacatttggaaccttgacaagagacccgtggagattatttcccaacagtgatcaggggctaactattcttcaaagagtggtagagaattatcttgcccaaaatctcagtagtaccttttgtacataacatgagaattctttaccttctgagcttgtttaaaaaaattcttgcagatggattgaatgtgatacacgaaagaaagagtagcagagtcatggcagagaagccctgctatttactgagaaggctaactctgcaggaggggtgggttgaggggatgagaaagaagagctctattttggacatgttaaatgagaaataccaattagttgtcttggtagagattgagattaatatagttcaagttcctgacataataggtcctatctaaaatgttagtttccttagcttcccttttgtggtatttgacgtttttaacaactccctccttctaaaaattctgtttccttagctttggcaacatctttctgtctttattccgtaatctttgacacattttatagttcctcttcttggatactttccttgcacgttgcccttttccagtattttgtttttgaaactcttctcaggtttaacattttgttgcttatcctttcagtcttttacttgaaaaaaaaaagtatatgtatgtatatacacacacacacacacacacacacacacacacacataaaataatgagctcttcattgtagagttgtaatattcttgtttaattaactatatatttaaaatttttttcatgtaattacttagttttctggaacaccattaaacaaattccataatattccattatttgagtatatcaatttattcagttaatccactattatgttttaacatgcttttttatttgaaataatgtcaaagttacagaataattgctagaatagtacacagaacttggttttccccaagtcgtttgatagtaaattgcctacatgatgccccatcaccctgaatatttcagtgtgtatttccaaaaataagggcatttgcctgcgtgaccagatagagccttccaaactagaaaattaacattgaggctgtgccactgtttcatccacagatctcattcaagcttcactagttttctcagtaagttccgtcagagtaaaagatccagtcctcaagcacaagttgcacttatctgtcctgtctctggaagattcttcactttggaacacttcctcagtttttccttaatttcgtgactttgacacatctgaaattaaagaccagttattttgtaaatagtttcccaactttggtttatatgatattgaatcatgattagatacaggttttttcatgttggctacaaataccacaaaagtgatgctttgtttgtgcttctcactgtgtcttctcagatggaacacaattgcaatctgtctcataatggtgtgtttgattacttaagtggtgtctgccaggtttcttcactctaaagtcaccatattccctttgttattaaaaaatgtttggggtgaggttatttgagactataagaatattctgttacttattaaatttttacttgccaattttagcatttactgatgtgtcttggctgttttaatcattactatgattgttaccaaacgatgactctctgattttcttattcctttttacattcattggttgtcattctactgtaaggaaaagctttttattcttcaaaattttcaatcatttttatatcaaatggttataatcatgactatcattatttattttgatccttcaaaatttccctgatttggccagtcggggaaagagccctttcaagtggtgtctgtgttcatatgacctcaaaaaaaattttttttttttggagacagtgtgtcactccgtcactctgtctcccaagctggagtgcagtggtgtgatcacggctcatgaagcctcgacctcctgggttcaggtgactctccctcctcagcctcctgagtagcagggactacaggtgtgtaccaccactcctggctaatatttgtattttcatttttttatttttttttgtagagtcaaggtttcaccattttaaccaggctggtatcgaactcctgggtgcaagcaatgctcatgcttcagcctcccaaagtgctgggattatagttgtgagcctccgtgcctggcctggcctcaaaattcttttaagaactttcttactttctgaatagcaagatgatccagacttatcttgttctttctttgtacccagctctagaaccagctatttctccaagaaactctgctctttttccacagaatagtactctagaaatcgacatctaggtactatgtgcttattgttatcaggatgtcactctcccagcccactcagtgagcagagctgggaaaatatgtatgtatatacatatgtacacatatatacttttacatctgtatttatctgtcgattcattcatcgatccatgagttcacaacaatgcttccaataccacaaagttcattctagtgttttcccttctcccacagtgagaaaatatggatcttatcatcctcagtacacttatgtggtgatcaattgaatataagcaatctcccattgctgtttctactactcaacccttaccccgacactccaaccacccagtcatgcttcaatgctcagttccaggccactgctgctcccaccctcactacagatgtccacctagcccaacttggctctgaaactgtgcagtagctgccacctccaccccttcaggcagaagccctccacaccctgccaggcttcaatgcctcgcacacagctgctgctgccactgtcactgccagtgtccacacagaggctccctgtgccctacttgggctccaccaccctgtactaaggtgcttgaaagccctccacacacacatcaatgcctgccttgcttcacctgaactgtgttggctactgacttcatttaaggctggcaggcaagtaggtagtaggatggcaggaaggacagtcctttgtttttgaacatttagatggtaccccaatgggggctcttataaacagcttttctgttacagttcatagatttttaaagataaatgtgctctataattatttactttcttacatctggagaccctgaataaaattaatagtctcattgctttcccatgcagcctttggcttacctatcaaaaccttagaagaatactacacttatagtacattgtttgggtggaggtaagatgggattattccctagcttgattttagtaaataattctatcaggatcttttatacaacaatttactcctagttattttgcctctacagattttaacctgcaacagcccaaaataattactttttgccattcctataacacctgaattcaactgagtcaattcaatttatttaatgttaaaataaatcacaccaattatgagatatcaaattcaccaatattgattaatattatttaagtgaacatttggttagtttatccttacttttatatcataagattttaaaagaagtgtttgcttatttcctgctttaactctttttattgtggtagagatggttgttcctctttttatttggttgggaaaattcaccttggaaaaaaatattctggaaattaccatagaaagaaccttggtgtcaaccaaatcacttcccaatttttgttaattttgtttcttactaagacatatgatgacatcacatttgaacaaaatattctaccacgaattgaatttcttgtggaatttatgaaatgataaatttcttgatgttaagctacttgtcttatgcaaatttctgttcacacaattctccacccttatatttcgtaggtgttagctaagtgtgtgctattatttttacgtttgaattaatgacaacatgagttaaaagaactggctcattcttatttcagattcattttgggtaaatcaggtgtaaataaatctacgctcctgacagtctgttttttggaacatggatctcaagagagtgtgggggtggggaggaggattatgtgataaaataaatagtaaaaatgctatttctaaggttccctcttaaaaatttacaaagtatattagcataatacagactctgggaagccctgaagtaaaaacatccttttagttttcttaatccagtctcccaaacgtattgacagtagatgtgtgcgtgtttatgtgctaataaccctgtaacaatccaaacagctggatttcacatgacacaccttgacaaacacagacttttataagtgaaatgatgtcgtttattgtttgcaaattgctaactggagttaggagctacagaatgatgccagtagatccagtctgaaaacaatctctcacaacacatggaagcttttcaagtgcctaggtgaaaaatgatagacagtaatttaaagatcaaaagcaaacattcttcatttaaaaataggacatgaaaggaaggacaaacgtcctgttgtgacagttctggtcttcactcagtgcttttctttttcagctgggcaccaaagaaggttacctcaccaaacagggaggcctggtcaaggtaaggaagtgtggttttgctcatgccagccacagaaaaaagagaacacgtcatgtagactcaattctcatcttgatagtttttcttggaagcataattgcctgctcattttaacccatttgtaatattcacctgactcaagagttcatttttatggctcattagtcaaaattctggaaaatgacttgactgttctttgacaaagccctgcataggtgtagcctgcagttaaaagtcaataaaacatagtcctcataatggaatgattgaggatgaagatagcaagtttactctagaacatctttcgttcttcttctaaaacaaggaagaagtcaaaattgtataaaatgtttctttaaggataggccaaaaacatcactgatgctactgaaactatgttataaaatccaaagaaaaacacaatttaagctcttacaagttcagagtatccaaatgttccccatttatgagactgtatctttagaattcctttgtttcatctcaatgtgccaagaagaccttcatggaatgtgtctgctccttctcgttttaagagtcacggtatttaacctctcacagacactgacatgcttggaattagcctaaataatttcattatttgtgtcccttctagatcgaatgctccctgaggacagagagtattcatattcatagcatatttatgtttaaatcctctgttacttcttttaactgggcacattgacacccaggatagagtaggatgctgtttgtatataagaaggtaacagcgggcaatgatggtttttaccactgataccttggagttcttaggcaaggtttagaatatcatgtgagtcagggttcctaaacctcagttttgttgtttgtaagacaagaataataatactggcattgttgtgtgaggattggatataatatataaagcctccaatgatagtatatcgtccatattaggtactcaaagaacaatatttatctttattatagagttaataaaatggaaattgtagtggtttgttataagtcacattgaatatttatgatagactaattctttttgtatttaaaaatatactaatgatatatctgccttcattatgagcttaatgcatgaaattaatttttatagatattttgaaacttttttctcagaaatgacacaaaagaattttttgagcttaatgcatgaaattattttaatttttatagatattttgaaacttttttctcagaaatgacacaaaagaattttttcagggttatagtatttaattttttagatacttttaaaatgaaagtaaatcatctggttcaaatattacattcctgtattcaaaactttgtgtgtctgtgtgtttgtgtgtgtgtgtgtttttctcagacctggaaaacaagatggtttactctgcacaggaatgaactgaaatacttcaaagaccagatggtgagaaacatgataatatatttttcctttaaaaatcaattctctagatgaaagaaacttaggtctttaaaatctctgaaattatttttatatccacctgaaatacctaataaatgattggagatatgaattcttgattcctgaaatgagcagagttattttgcaaagatgagatgtatgtcccagaaattgctttcttggattggctaaaccatagttccccagggcacgtaattccctctgtttaggacaatgtaattattctcttgccacaatttattaactgtctctttgcagcaatttgtccctttattaaaaatacagtttctccatttcccatgcccatttcattaagccaatttaaaattattttttctcacttttcttatataacatttctaagaaagtagaagttttaaaaaatgagagaaaaatatacctctcttccatgtgttaaaatccatcttcatcagtaagttgataaaggtagtaacttaatgcccagttttatgaaaggctcattccaaaaccaaggacttcccttggtagggcttttctattgtcagtcctgttagtgaaaggaaatatgacaattgcacatagtggaaaacttgtgaggggaataagtgagggacagatttgtctgtttttttttttttttttaatggtgacatacgttgctttttattttatttagtcaccagaaccaattcggatcctagacctaacagaatgttcagctgtacaattcgattattcacaagaaagggtaaactgtttttggtaagttgttttataaagaaaacgttttttaatgtcttcttgccagacacttattttggctaaggaatagaaagctgtatatcttaatgtctacaaagatcagatatgaggggcatgcctgcatgtaaggagtgttttcagctgagtgtgacataacacctcatttaaagtagcttaaacaaacaggcaggtcagctcagcttatgttgcgtactggagaagtatgactcacatagaggatgccattcacatcttagacaatttaatttctttgaggctttctccctcattttatttataactttgttgactctaatgataggtgatttgtattgttatgacaatttctggcaaatggcacaaaaatattttgttctaacataatcagtatgttataaaaatgttctaactgggagaagagtcttgagaaaggaatgtcttatttcccactaccttttattttaaagtttttcaagcatacacaagttgaaagacatacgtttacataccctccatagcagttattaatatatcttaccatatttgctttatcctagtctatccactttttttttttcctgaaccaattgaaagtaagttgcagacatcatggcactttattcctaaagactttagtatgtgtctcttaagaataaaatatcacatataggactacagtatcattattacaactgaagaaattaatgttaattctataatatcaactgagaatgggtgtctttttaaaatttgcatagacatgccctgtgagctagcagagctttatttttctcatatatccaaaaatcaggaggcaagcagctatggtgacaaggtcaggtccagggtctctactgttctcctggccttttctcatgctggctacttcaggatttgagtgtctactacacctgtaggtctcatattttcaacaaagtacaaagaaagatgtagggatgatattacccgtgtctgtccctttttatcaggaaaaccaatgtttctccagaaactcccctatgagaccgggtgccatggccatccccagcagctgatcataattggcttaaacaaattaggatttattgcttggggttctgttagcaaaagaaagggataattatctgtattaatagacagttaataatgtctcccatagggagtaccaaacaatgacaatgacagaaaccagttttcgagtatatgcactgtatcactccctccccaccactgtccactcactctccactagacctcacatccaggtattagcttctatgcacagagacttacctcttacctattcaactttaattgctggtatcaacaaaatacactgcttaggctttaagatatagaaacccttctgaaggctttttcacaaaaagaaaaaagatttttggtatttttgcatctcaactgtaagtaaggaagtatgttcagtatgtaatttagggctgaccttattgcttacataattttaactaggtaatcagacacagtcaaatgaaaaattactatacatttaggaaaagtattttgtgccagtaggaaagttcttattccctgcagcagagactgactcttggccagagatgggagaaataactaatttagttttattgtctctttttattgtcccaatagttgaaattgcccacaaccacagaaggcagagttatcctcgttgaagcaagctaacacaaatgagttctttttagcaaacttctctgtcttgcctattctttggatcatagcacaagtttttgagagatcagctgaatgaatacataagtgttagagttaacctaagacatgaaccacaaaaggatctaggggtgtcctgaacatgtttctttcttcttcaaagtcttattcgagtatatacatctgacttggaataataatatgaatctacaacttccttaacatttctgcagtttgctggcaggagtaggtgcatatataccagcacttcaaggtacttacctgcatcctttatcaattcttttttcccttgcaatactctaattagtgttcaactaatatatatatatatatatatatataatatatataatatattatattatatattatattatatatattatatatatatatatatatatagctaatgatctgcaatatcttatgttctttcttttgtcctattagtttggtatttccattcaggacattttatctctgtgcaaagaccggagtagaagctgatgagtggatcaagatattacgctggaaattggtgagaatttttaagccttcagatgtcaagtcttgagaaataacatgttgatgatttcaaacatatttctatcaaaagagtcagactagacccaagaatcaaagagatgtctgggtgtctacttccaggcttgcggaacagtctgttaattcttctgggacatgagaagagatggagacaggattgtaaaaaagaaagaattaagccatatttgggtcttagacatagagccttagcctaataaccacctatcagacttcctataaggtgtgtcagttagttcagttttgtctggagggggacatttagaaccagaaggtctgacagaggaaagctgacatacttctctagttgaaaagccttttaaattgttagagaagaaagtttgccagaggcacttagcttagtttccaatgtaagcatcactttgtgcaggtcaaggacaaaagctgatttattttgtctgctctctgtatatctcccgaggagaagactgagtgagtacttataaaacttcaccaatcttctacttgtttttcatgtgcttgcaagttagtgagttcttagccaagaacttgtccttaaagctgactaaaatttcctataaataccatcttaaaaactttgatgatttctttttttctatttttttttttttttttttttgagacagagtctcgttctgttgcccaggctggagtgcagtggtgtgatcttggctcagtgcaacttctgcctcttgagttcaagtgactttcatgtctcagcctcccgaatagctgggattataggagcttgccaccacgcctggttaatttttgtatttttagtagagaaggggtttcaccattttggccagggtggtctcgaacttctcacctcaagtgatccaccagcctcagcctcccaaagtgctgggatgacaggtgtgaagcaccatgcccggccagatgatttcaaacaaaatatttttcttaattattttttgcaaaattgtctgatatatatgaaaattcctttctagatactgagacttttgctttcagttatgttttcagtttgaaattcaaataagtataccattcatttttaaattcttccaatgtatcagtgagggataatttgtcttgtgaaacctttgctcagatatggattaatttcttattctttctatttttaattatcaaagtaacacaaaatcattatacaagaattatagaaaaatatatcaagtatacacacttttagacttctctctttacacataaatatttaaaaacaaaatttaatcacttgctagaagtaaaaaccacaatgatgtaccactacacacccttcagaacggatacaatgaagactgtcaatatcaagtattagcatgaatgcgaaggaactagaactctcctacattgctagagggaatgaaaatgtgtacggctactttgaaaaattgcttggcagtttcttttaaaactatacatatacctacactataattcagcattttcatgcttaggtatatctaagagaaatgagtgcatgtatccactaaaaaatgttacaataatgttcatagcatctttattgataatatacaaactccaaacaaaacaaatcacttgccagtgttctatatttgctcacttcacttagcaatatattatgaacatttttccatattatcaattttagatctatatcttccttttaactcattgaatagtattgcattttatagattactgtaagtattagaccaattcccaatttgtacatgttttagcaatcactttacaatatgtgtcctaaaaaaaaatacagaaaatttttctggacacatgataattagcttatagttgggggtgagcacatgataattaacttagagttgtatgacatccttactaatcaacatgtcttatttaatatttgttagaagccagggttcattacaatcactcaataatggatacacgtgtgtgtactttattacagtcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaaagaacatttccaaaactaaaatagaaaatgcttgtggcatttattttctctttttaaaaggttcagaaatttggcaggtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaagttatctttatccaacatttctccaaatggactgaaagaaacttttcaaggacagtgtattataacaatccctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagttaaaatgtattgtgttgtttgtaaagtaagaagttactggccaggagcggcggctcatgcctgtaatcccaggactttggtaggccaagacaagcagatcacttgaggtcaggagttcaacatcagcctggccaacatgatgaaaccttgtctttactaaaaatacaaaaattagctgggcatggtggcaggcgcctgtaatcccagctactcaggaggctgaggcaggagaattgcttgaacccgggaggtggaggttgcagtgaaccaagatcgcggcgctgcactctagcctgggtgacagagtcagactccgtcccaaaaaaacaaacaaacaaaacaaaacaaaaaaaaacagaagttacaaatgaatactcacggatatgtatagttttatgtttgttttcttagaaacaaatgtgtttctttgggtgggtaatattgtgttttactatgtttaccttttataaaacataacctgtttatttatattctttggctttgtttattaaaaagcatgattttgctgtgcatgtaccattttgctattaaaatttatttttaatatttgtaacttgaa

SEQ ID NO: 1906 - DNA, 132545 bp, Homo sapiens
tctctaacatcctctttaaaatatttatatggatcaactttattgaaagtgaataaacagagataatgtggcaaaaagaaattttcccaatattaaacccttgatgatacttttaaattcactataaggaaaagaatccaccagtagtaggtagctacttatttttgctgagtgtcctctgcttttctgcatgctccacaatcttttcttccacataaagccccttccgctttcgtactgcgttcatgtacttccgggcttggttctcagagtcagccttctccccaaagtgcaagtattcctcctcagtagttggcacccagaaggggtcactgggaatgatcttgtaaaagaagatgacagaatgtgcaaggttaggcatttttaatttcaaaccttattcactgagctccccaatttatatagtcttagctaatgaaaaaaagttaggcaatgaacagctaagcttgctaggaatggtaataagtatgaagaatcggcagggtgtggtggctcacgcctatagtcctagcactttgggagccaaggcaggtggattgcctgagctcagaagttcgagaccggcctggacaacatggtgaaaccccgtctctactaaaatacaacaacaacaacaacaacaaaaattagctgggtggggcggcatgtgcctgtagtccctgctactagggaggctgaggcagaagaatcacttgaactcgggaggcagaagttgcagtgagctgagatcatgccactgcactccagcctgggcgacagagtgaggctccaacttaaaaagaaaaaaaaaagtatgaagaatcatgggaggtgtgaacaaatggaagtagattcaacaaaacttgtaacatacattattattctttgctcctagcgccagttcataacactaaggaagaaagaaaactattaatttttcataatataatttttaaaagctttcatttttgctaggatatatctgaatgttaatgtctttgccatcaatattttgcctttgtcctcaacctcaacaaagatcaacacatgtaactacactcttattattattacatatatttttttatttaagagacagagttctgctctgttgcccaggctggagggcagtggtgcaatcatactcactgtagcctcaatctcctgggctcaagtgatcctcctcccttgacctcccaagcagctaggattacaggtgcatgccaccatgcccagctaatttttaattttttttctggaggtggtgggtgcatgacattgtgaatgggaaaaatgcagcaaaatgtttatttaaaatgttcaagtttgggggaggctgaggcaggtggatcatctgaggtcaggagtttgagaccagcctgaccaacatggagaaaccctgtctctactaaaaatacaaaaaattagccaggcttgatggcgcatgcctgtaatcccagctacttgggaggctgaggcaggagaatctcttgaacccaggaggtggaggttgtggtgagccaagatcacaccattgcactccagcctgggcaacaagagtgaaactctgtctcaaaagaaaaaaaaaagttcaattttatgttgtatgaatttcacctcagtacattatttttaaaaagagagacttaaagaaatttccctgaatacagaatacggcacagagagatggagattaaaaaaaaagtctcaaaggaaagtcaagagccatcaagtatgtatagggtatatctaacaggagttctaaaaccaaaaaacagagaacaggatgagagtcttcagatggaaaaacctcactgagtctggaccaagataataaaataatccaccccttgtgacagtgttgaaatgctggaaatctgtgggcacctgcatctcctgaggctcgattctgacccactagacactatagaatgggaggtgtgagccacaactgtgcttcttgctcttgaacaaaggttggaaacaaagcagctgcctgtgtcctggtgctgaggcaggtacagagaaaatcagagagaaaagccagatctagagaagaacatgaatcagaccaacgagacgcttcgcatcagcaacagcagttgctgggacacaatgaagtccttcagagtgctaaggagcctcagtgtgagcctacacgtctttatctagttaaataaaccattatcagcgaaccaaaaaaagcctctgttggacagactttaaaacatattacctctcatggacactcaacaaaagaactagaaatatcctttcaaaaaagagtccccggaaggaaaaggcagacagtagaagtgagagcagccagggggcacagaggcattatcagcactagagtaataactctggtgggtgacagcaagtctaaggagcgtctcgaagtgggagcccagttagaggttgggcaacaaggggcagaaaaggagacaaggtccaggaattgggggggggggggggtaggcagagtggcagacaagggcgaatggatggaatttagacgagaaacggcagttaagaaggaggagtggggaggaagctcagtcctgtggacttggtcatctgagggggttcttctgggtcagagggtttgtgctataattttgtgggcacaacagtcccagagactcaattctgattcaccagccactgggcctaggatagaaaggctcattccagatcattcaccagcaaacaatgtcaacacgataccagtagggctgagtcagtatgggctcagggcctgggcaggaggaagggagggaaagtggttgccactcaaaacagcctgactggtcaaaagccacccacccagggtgagggtaggtgtagctatgtagggggagcatgagggagcctgtggtgatggaacaattctgtatcttgattacataaagctacatatgtaatacacttttatagcactaaagacacacaaactcccatgaatatacagagcagaagaaagggagcctgcatctttgatggtgtccctgagccatggtaccagccctacttgcttaaacaattactattctggcattatggttcttgcggctgaaaacactcataatctatcaactgatacagggttgttgtgaagactgaagaagatattatatgaaagtcatatggtaaagcacctggcatatcctagatttgtctggctccaaagcctgccctttgccatgtttgcagactgccatgaagactgagtttatccaaacataaattgcacaatggtactagctaagtcaagtgcatttattataactggtgaaacctgaacaagtgctatgggtgtatcaatgtcaatgtactgtaagagatgttaacattggggaaggaggggtgaatggcacataggacctccttgtacatattttttggtaacttcctatggaaaaaaactattgtaatttttttaacaaattctttttaagacacccggccacaagttataattctcttttgtctggaggtaaaattctcaacattcataagaaacacaaactgttttcagaattggttattctgctttgctggtgggaggacagggtgagaggggtggtgtctgtttcctcatatgcgaggaaacaggcagagagactgcaatgagcgagaagaaccaagtgagtctgtgtggaatcaaacccagagagtgaggagtcgggggttggcacttcactgaatcaggagcaggcactgaggccagagtgaacgtggtgtgagggtcaactgcactggctctggagccaggcagtctcccttcaatgccagttccctacttgcttagctgtgcgatcttgggcagcttatttcgaaccatttatacctgggttcttctatttgtaaggatggaatgttaaaagtcccaatatcatatgactgtatgaagacatcttcactactcctgcatctgtgtggacagcctgaagccacttgcctcaacatacccaacaaactctgagaacaggggagatggagtaacactcgagtgctcgaggctggttttgaatttccttagtggagcaaagacaaggctacccttttatggttgtccagcttgtgctctacagaaaggaccctccaggccacagagaggggcttgatatcaaactgaagaaaaaggtgctttttttttttccctcactgcctcacccagaattcatcggcctagagtgagaatgtatttttgcaattcaacagcctgaaggggatgccattttctaatcataagaaggcacccaagtgcaaactgttaccctaggcattaagggaaaagaaagcctagaaggaaaaagctctgggtgctccatttcaattttctgcccagttttcacgatgattactgctggcaggtggaaaataccatgtccaaaataagcttgtttggtgctattgtaatcacttcacccggtatgaactttagcccacccctcagggtaatctcagtaataagcgatgaatcttgaggttatgctgacatacatgtacaacagcactggttggtaatattttttctttctgtgtctgttattagctccttttcttcctttttcatagaagggtaaaacatagaaagagaaattatgagattgctgacttcaaaggtttcctcatggaaaaatgcctgtaattttattttctctattttttgaagcactttctctcaaaagctcttgattgtaaattatatggtgtggtagaatacaaatgaaaagaagtgccttggagtgagaagccatatctcaacaactgtgttatttctaaacctaactatgggggaaaaaccaagacagccaaaatatatcagatcaatgacatttaattataatgtagtttttaagatttcaaagatttgaagcttttgggaacaggaccacgacaggtggcaaggacatggcagaaggatggtacaaaactggggcaaaacttttcttgagaatatttttctctcaagttatttatttaagagacttatttttaataacgagatgtagctaagccagaaagtaatattttttaaaaaaagtattacatgtataagatcaattttaagattttctttttaaatttctgaaggataaaggagacggacaaccatcaaggctttcaggtaacaaaaactgcctatttggtaaaatcttgctgtttttatactagttgtccctaaatatccgttctctacctttctttggtaatagatatttcaggtaggcatatagccacctagagtccgaaggtgggggcatacttttcctataaagagccagacagtaaatatcttagactttgcaggccatatattatttctatcatagctactttactctgcttaaaagcagccatagaaaatacatacatgattgggtacagctgtattccaacaaattttatttatcaaaacagacaataggccatagatctaaagactacatttcccagcctccttcttaggtggggccttgttagatgtggtcagatgactggttttgggcattggcatgagggtgaagtgatgtgtgcaagattcagtttgtgtccttaaagggaaggagtatatcttattcttcctcatccctattcttattggccggaatgcagatgtgatgcgggaggtagaacggccactttggacaatcagtgggagctaagtgttgagaaaggcagcaagccagaatgggcctgggctcctaccacagtgagtcacatgtcagccctagtctgcctccttagactcaaaagagaaataatctctgccttatttgagccactatattttgggatccctttattagagcagtcttacctgcttcctaactaatatatctgacaactaagaaatgaagggaactttatacatttttctaaaaaaaaaagctttataaaaatcacttttgaggataagactgtcaaatgatgagattttaaaacaaaaaattgaatatacgaattcaaatgaatcattcttccaataatgatgccattacaacagctctgaatgcctatttgggatctgcatttacagacaatcccagtgattacttaacctacatcctctttgttctgatcaaacatactataacccagttttatgcacaagtgttaatcaaggccatcttcatgagatggatgacttctcatctctaagatattcagaagcatgacttgtgaattctgaaggcagtttgcagcaacagtaacgccaatgaagaaagcattcttcgtctcaaggtcattaggttgaagtggactgaatctctctggttctaaatatcatttagctgtattgctctgtaatcacacatctggtcactaaaacctgtggtagaggatgctgtaatgattttttcattagaaccatcagtaatacatttgcactacagacatagttctatttttcaggcactgccttttaaaacccatcccttatatttcttacttggtttgtgttcttatgtaaaagttgaatgccaaaaaccaaaaccaaaactaaaaagctagaattttggataaatgagaaattactacccacaagcacaggaattaaaaaataaatgtttggggggtactgttttctacataatgaaattcagcaatatcgcatcagatataagccagcaaagccatcaaaacaccattaagttttcagagaaatatgcaaaagtcaagaaaagattcatagtaaattactgttaaaacctagagtttgtactgaccaaaaaaacgtaacctaaatcatagcattaaccttggttctgtcaagcattaagaatgtgatttttttttttttttaaaggaaaagcagacacaatggtgtgctctgggctagcaacttcacttgcatcaatttagatgatatgaacttgctgaattaaaatcaaatttgccctgtccaaagtcaatttttctgaagtgccacccttctttacttcactgattcacttgattataaatttcattttaaaaagaaaattctccctcaattattctcattttccattctcttctaaatttaaactcttcttaaagtgttctggaaaaatggacccattaggctaaagaaagtgagaaagataacagcttagcattgaagctaaatcatgagttctgctgaaatagagtttaagaaaaaaaaaccatggattatctgtgtgaagccctgtgcaatgaatgccacaccgctgagagcaagccaaaatgaatgtggtgtagactcagagaacgaaccacaaggaaacaatcttcgcatcagcaagggctggtcagccacaatgtcaggaactaggttagatatttgacctaggggtgaagaaaactcagggagggtccatgatttgtccaaataaatagaagaatatttgaaaccaggactctctgactccaaagtcaatggttcttccattaccttacaagcctccatggtaaaagggaataatgtgaagttatttcaattccctgtaaacaataacaacaaaaactgctttcttaaaacaatctttctacttatatccttgagtttacaatttgattcctgaccttaggctttttcttgaaaagtaaattgttttttgcacatgccctgcagtttgtttttaccagccttttctcatgcggcaccttctgattgagtgtccttcttcttagctggttaatgtctacttttcctttacagatatgttcaggacagctggtctgaccttatctttgccacttgttattcttttttctctaacttaacaatgtgttcacaatctttccttctctcctccctcagcaatgtggatctgttaagttttcctttctgattacagataaggtttgccttttcacctacctttacctacactgacaatgaagggttctgagtagccatttcgttccattctcattccacaacacctgaaagccacagaaaccttgaatctccataatggggactgaagaatatacagtacataataatttaaagctaccccttgcaagaagtgtaactgttcccctctaattactggagatatttttttttcccctagaagaaaatattcttaaaatttcacattcaaaaggtctgtgattttcttttaaaaatctaaaatatatatttggatgaaaaaaggattaaattttcagcatcttaaattttatattgaataaaaaggacaaatgagagagagagagagagagtgtatgtgtgtgtgtgtgtgtgtgtgtgtgtgtttattataaaccacagatgatctcaggctcattcaatctggatgaaaaagccatttgctttctcctgtccatttgactgagttgagccataggaaggccaaatggcatgatctgtgttgtttgctactcttggcctcctctgtagggaatgtatccatagatgagaaggaaggaatgaatgggaacttggatttttacctcccaatggctgaatactagttgtgggctggccaggccacttgtcctcttcctgatttcatcagcaaaaccaaagctttcagcaacaggcagcacagccttgatgatgaacatgtctgtcccttctttcatttcttcttgaagtacccgaccttctctctttgacaagacagcatagactcgacctgtaaaaccataaatcttttaaaatcatggatcaatcatatggcttgagccacaccaagacatgattacccatatactctgtaacaatccataaatgattaaatttgttctcaataatgttgatttacaaaagcaaggaacactttttaagtgtttatttaaaaagcatgagatttatagaaaaattggaaacaaaaaataacaaaaagttaaatcaccccaaactacactgctcatagacaaactccacaaaacagcatgagaagaagatttgtaaaaggacctttcaatgcagtttcacctataagctatctttgggtctgaaatccaatgagatgagtgactgggcttcataaatattaaaatatttgaataattttgagaccttattgacatggcaatgataattaagatggcataggctatttgggcttagtaggcaagcaactggcatttttataccaaaaattaaaaccacacacatatatatttgttcatagttttcttaaactggtaatatttaagtggtatgagtattaagtgttttattcccctgaaaactgataggtttggaatctttaaggtctggtaacaatttctagtgccacagcacaagaattccactagcaaattctcttggatgactctttcaattcatctttaggcacaattctgcctcacactcaggagggaaacatcttcccctctgactggtgttctgtatgagtgtctctgggtatgcaatgtatcctttcaactagtaaggagaacagaccctgcaaagaatagagatacattgaaaatcacagacaatcatgaaggacttgctgtaaccagcagatactctctttaaagccttctctttcacctgctgcctaaaaaataattttagttacataagtgatctattgcatatattatccttaaacatttacaacactgctgctaagcagggctaaagtatcctttgaccaccattgagtcctggacccttctctcctaactgccaaggtgatgagtctggagtgtctgctacccacttacctttatttatttattttttaaactagaaactgacgacacaaagccaaaatgtctgacttccaaacttttctctctgattcagatttccccctagtggcggttattaggaacggaaataggaaacaaatggcagaaaatctattgtgtcacaacgcctcaaggaaaaaacctaaactaaaatctctgatgagccttcaccatgtttaggtttagcttaaaaacaaattaacactccattcgtaatgaaaggcaccccctttcctcttgtctacttccccagctagctactacattctctccttccttgcttcctcacatcttaaacaggtagcttctcatttcttcactatgtgctctttctttaacatctagctctcctggttgcttcaggaaactgcttccttgaaatttcacaataattttcatgttcctaacctaaatgcttttttcccccaattttcattctctgtgatttctctgtggtatttgaagctactgattaatgtctactctgcctactgtctccaatcttagtattattctccttacactcctggccttctgaccatcattctctttatttcagtatctcctgaacttcttcttatgagtattctttgaggcttcatactctttgaacaaactctccactcagcgagacaactaatttataatttgtgtggtttaaattaactaattttatgcttgggactcctaaggccatctctaagccaggcctctccttggatctccaataccactttacaatggatgccagggcatctctgctgtggaagccaacttcctttcaaatttaacatgtctaagaatatattatctacttcaaaaggcaattccattctccccattccaactatttcccccgtcattcataccagaaacctcatagttacagaatcacacaacagtggggtaaaaggaaacttgagggtcaagaagttctactaaagtagctgtttaagctctccttgtatactctaaaactcattttctcccagggtagcccattccatctttggataactgtaacagctgacaattcttgagtcccaaatatgttcccctgaagtttctgaccatcagtcctagtttttatcacatgggacaagtttaatccctctcccacaaattaccctgtaagctactcaaagacagctgtctcatgttcacttttccaggccaatcttgctgtgactagacctgtatttcctgttttatcgtggccactctcctacttgaactactatgatttatttacatccctcttggtatttggtacccggaaatgaaaaacaatacttcaagtatagtctgaaaaggtcccaaaacagcagaatgattattattttcattagtgatcccttttagttatatattatttgtctgagatatatagaaaagaaatcttaccataacacctaacatgtgtgaactagtaatctttactcccctatctcattcgcagaaatgttttaagggccaggagagcggtggctcacgcctataatcccagcactctgggaggccaaggcaggcagatcacttgaggtcaagagttcaagaccagcctggccaatatggtctccacatcgccactaacactacaaaaattagttgggcatggtgctgtgtgcctataatcccagctactccagaggctgaggcaggagaatcgcttggaggagaacttgggaggtggagattgcagtgagctgagatcgtgccactgcactccaacctgggcaatagagtgagactcggtctccaaaaaaaaaaaccaaaaaaaaaaaaacaaaaaagaaacgtttgaaggtagtttatggaagtaaatacaaaacaataaaacaataggggcaaaaaagaatgaggaaagtggggcaaacagaccacgaataaggggccagtggggacaagctgcctgactgctgctgcatgggtcatgccagcaggcttagatcaataattgtaattgaaactgaatatagttaacatgtaattttgatccattcaattttaattccatgaaaactatatgttgatactggggcatagttatggatcaccaagcataggaaaatactattataaaaccttccaaacacacttggttctcatgataggtgtgttcaatgcttggatgcattcaaagaccctaaatgtgccattgtcatcactgagaaattaacacagccatatcaataagaatttctgatcatgtggctcttgactgcaaatactttcataccctttccactggatatctgttccatcatgatcacttgtttgttcagtcacttaaataaagatcagagttggttgagtacagcggctcatcactgtaatactagcactttgggaggcagaggtgggaggaacgcttgagaccagcctaggtaacaaaacaagaccctgtctctaaaaaaatttaaaaattagccaggtgtagtggtgtgcaactgcagtcctagctacttgggggactaaggcaggaggatcatctgagctcaggagttggaggctgcagtggactatgattgtgccactgtactccagcctgggtgactgggcaggaccctgtgggagggagggatggaggcaggaaggaattgacagaaggaggtaccagagtaccctactgtatgaaaggaaccagggaagaggaattcatcaaggaaaaaaccagcaacaaaaagattaatcaattaaaacagtattgatcagtgctcaactgttaatgactacactataaatatctcagcctgtattcaaggcagtaacccaccccttcagcttctctaactgccagattctggagtacacagggcacagcctctccaagccaaggtatatcactcactgtccacaggcaaaaccatttgaggttttgccaactctaagctcacagtttctttaacctagaatactcttagtccaaccctatattcaaatccttttcatcattcaaggcccattcaaaaattacttgttccatgaagtcttctctaatacccaagctcaaaaaagtctctttaccatttgggtgaacattatctgttcttttatggccctatggattctcatatatacattttcttcttccataatattaagattaacctgtacattctacagtcttgaaagctagaagtttggtgattaaaggtatgttgtttttttcagaatttaggaaagggaatagttgtccacagcaatgttttctttaacagtaaacaatcaggaaacaatgcaaatttccaatttcagaataataagtaaactgtatcatatcctattgataagattacacgcagaggttaaaatgaaaattatgaattctaagtagccaaatgaaagcatgcctataaaataaataataaacctaaaaagcaaaatattacattatttctatcataaggttacagttatgcaaaatgtactattatggacaagggttgtaaaagaaaatgggaaataaagttggattccaaggagaaagagcattctttcaccttgtgatttgttattgttggtaacacttatgcactaactttaattaaaaacacacatacaaataaattggtaggtacttattcttatacaccaggtcacactaacctcttccttttgtcacagagctataagactgctgaatcaggccaacgtggttgacaggatacagatgggcttcaatcaaataggagataaagcatgctgcagacacagtggggaacgtaggctggttgctactatatagatagatcagctacaagtttatagataattgatgttaacaggtcaaacccactgtggaaagttgtccttagtgagtctgctagcacctcttactattataatcagtgacttaaaaaagaaggcacaatgatcaaatccaaagttgacatgaagttggctggaaacaaacactgtgacacagtcaagataactgggcaaggaccccagttttttttattttttagatagagggtcttgttatgttcccacagctagatttgaattcctgggctcaagcgatctcctgcctcagccatgcagctgggactataggcatacgctcgcacgcctggctaggacttgaaatgcaaattgtgttaaaccaaccaagtgtccaggatttgagaggtcaagctgttggagaccaacctgggcaacatggtgagactccgtctccacaaacattaaaaagttagcagggaatggtggcatgcctgtgcttcctggaggctgaggtgggaggagcgctttgagcctaggaggttgaggctgtggcagtgagtcatgtttgcgccactgtactccagcctgggtgacagagtgagaccctgtctccaaaacaaaaaaaaaaaaggaaggtcatgctgaacagcagttcctataaaaccaactagaaatgagtttactttaggcttaatagtagtcttcaatgtgctatggtacaaagaaagccaacttaatactaagttgctgaatacaaaattattccatcaatcaaagcccatttcaaagtaccatgactttcaagagacctactgtttcaaattttgctaatcccaatttctcataaagcttccctagaaaaccatgtttgtgcactaaataatattgtattttactttctaattactttatataattaagctttgtcaccttaagttatgtctcaaagcaggaatcacgtttaacacagtattggcacatgcagctcattaaatctttgttgaattgaattacaaaatgctgaggaaatgtaaaaagaaccctaagtatagaataagaaaaggtttaaaggctaggcgggtggctcatgcctgtaatcacagcactttgggaggccaaggagggaggatcatgaggtcaggagatggagaccatcctggccaacagggtgaaaccctgtctctactaaaaatacaaaaattagctgggcgtggtggtgcgcacctgtagtcccagctactctggaagttaaggcaggagaattgcttgaacctgggaagcagaggttgcagtgagccaggatcgtgccactgtactccagctgggcaacagagcaagactccaactcaaaaaagaaaaaaaaaaaaggaaacagcgaggccaggcacggtggctcacgtctgtaataccagcactttgggaggccgaggcgggttgataacttgaggtcgggagtttgaaaccagcctgaccaacatggagaaaccccatctctactaaaaatataaaattagccgggcgtggtggcacatgcctgtaatcccagctactaggaagggtgaggcaggagaatagcttgaaccgggaaggtggaggttgtggtgagctgagattgcaccgttgcactccagcctgggcaacaagagcgaaactctgtctcaaaaaaaaaaaaaaaaaagtaaacagggacacttataaagaatgtttctgatacgttaaagtacatgtgttccaacaatattggcatttattcctatgtgtaaaaataaaagattaaaactatctcatatactccataaatatacctactacatacctataaaaattaaaattattttaaaataaaaatttaataaataaaaggaagaactacaataatcacagctgtaattaaaactcttaacgaggctgggcacggtggctcatgcctgtaatcccagcactttgggaggccgagctgggtggattacctgaggtcaggagttcaagaccagcctggccaacaaggtgaaacccccatctctactaaaaatacaaaaaaatagccgggagtggtggcgggttcctgtaatcccagctacttgggaggctgagccaggagaattgcttgaaccccaggggagcggaggttgcagtgagccaagatcgtgccattgctctccagcctgggcaacgagagcgaaactccatctcaaaaaaccaaaaaaaaaaaaaataccccaaaaaactcttaactagtactgtctaacaaaaagaaatatttttaaaatgtggttattaccaaagattttttaaaaatgaagagcaaaaaaaaaagattaacagattagaaggaaaaaatacaaaaagaattcaatgacaagcaggtaaaacctcagcaataatcaagctcattagagggaaatttcatgagtaaaaaatgataataaaccacatctttagaaaagtggattttaaaagtatagaaagacattttcctgaaattatttccccagataaaatgattttgagattattttcctacaaaatttcccattttgaccatatgcaagtctatccatttataggatttcttgttttaataatctatgtagaaaaaactaacttttaaaaaaagactaaggaaattcattttgctaaataaaaaagacctgaaatcaacttgtgccgattcttggagaatcaaaacaacagtcagcaaagtctgaagtcttctcagaagatctctaaatatccagacaggaagcaaaaggccttaggaacacagaagttcttttcatttctttccaattgaaggtgttgatttagaaagaaaaaggaaaacacaagtgaacagctgactgcattgatagaccctggacactagaaattggttatcaatataaaagagtccctcaaaagcaaagagaaaacaggcttcagaggacattctccagtctaagcaagaggacttcaaatcaattcgagaaaaaaaaaaaaaaaaagccagactgactctaaatgtaacttcttttaaggcagtggatgtggtagttggttggtctcaggggcaaagtattaagaaagttgaccagtgacaatggtagagactgcataccaacccacatacacacagttgccgcacgcagggtaaataaatggggcttcatagaaggcagtgaggcccaatacagtgacatttgtacctgggtgaggaaagtcaaaatgatcctttgctccagagagaggtgacaaagaaccctgagggttaaaatatatatttcttcctggaaagtggcagaactgactgatggccaagtggggagtgccaggataaaaatataaggataggatgacaaatgatattttgaggtattatcctagggtggcctggtcacatgccgtgtccaggtggtgattttctaatagaaatgagaaaatgaacacagaggggtgactcaacaggggtgactcaacactatgctaggaattcagtctgataaacaccaacagctgattctggcttcacgtgttgtgctgaaaattcatcttcccagaaaacaaaggacaaatgccactccaaatgaataatgtagaagagatggcaatctggggagaaaacaggtgctcccattattttgggaggaaatacatgttcccattatcttgagagcacggataggcacagacctatgcgggccctggacttcagaaaggatcattttggccagatgtggtgactcacgcctgtaatcccagcattttgggaggccgaggcgggcggatcacttgaggccaggagtttgagagcagccttgctaaaatagcaaaaccccatctctactaaaaataacaacaacaaaaaaaaaattagctgggcgtggtggtgcacgtgtgtaatcccagctacttgggaggctgagtcaggagaattgtttgaacctgggagaagaaggctgcagtgagctgagattgtgccactgcagtccagctggggcaatagtgaaaaaaaaaaaaaaaaaaggaaagatatcgtttcaaacacatagagggacaggaaaaaaaatacaactaacacacaccataggttctaggataacagaccctaaaataaaattcctttgcagagtaatgagagtctaaaagaaatcaatcatgaatgatctcaatgacagaagaaggaagaaagcccctcctcaacccctattttaagaggacatgcacagtagaaggaagaagaggataccaactcaggtggatcagtagcatgtccaagatgctcaaaatcaaaacaagctgagtgtatgtaccaaagtaaaagagctaaagacagtgcaaagagctttttccaatactggttgaatatctcttctccaaaatgagtgggaccagaagtgttttacattttttatttttttagattttggcatatttgtattatatactgtttgagcatcccaaattaaaaaataaaggctgggcagggtgggattacgcctgtaatcccagcactttgggaggctgaggcggatggatcatgaggtcaggggttcgagaccaacctggccaacatagtgaaatgccgtctctactaaaaatataaaaattagccaggtgtggtggcatgcgcctgtagtcccagctattcggaaggctgaggtgggagaattgcttgaacccaggaggtggaggttgcagtgagctgagaccatgccattgcactccagcctaggtgacagagtgagaatccatctcaaaaaaaaaaaaaaaaaagtttcaaattttagatgatttgggattttggattttcagatttgggatactcaacctatactttcaaaataaggagacatgtcttgtctacaacttatagaaactagtatcatgttacagaggatagcaagaaaataggggttcgcaatacctatgttacctatctttctcttcagtgaggagaatggtgaacaaactatagcaagtggaacaagttgaagtgggagaacactgaagttcacggtagctcagcagttgatgactaagtgcttggccttcttaaatgagttcaagtctccaggaccagaattatatctcaccataataagagaatttgcccttttgagaaattatgaatagtaaggtaggtgccagactataggaaaaaggtaaataatgactaaactttttgaggatataaacactgcgttccataaattgcagactagaaagccatatgctaattttctgtagaattttaaggaaacactatagacatttgtacatgtttatacaagtatgaggtaaatcttgggagacaacatggactttctaatacaaaatactaacctaagctttttttttttctaacatgattggtaagctgataattgggggactgttatagatgtaaaggaccgtaacttcatcgaaacatttgattttctacctgttgagttttatttctcatcagacaaggacacatgaaaaaaatgaataagaaatcaatgtgttaagatggtggtgatgtgacttctttttcttgccattaaaatttttctcctgtttactgttgtaatgctaattatgttatataacttaagaaaaaaattaagtgtatagactcagtactcataagaaaaaaattaagtgtatagactcagtactcatacacaaataaatataggagttcatacaactacatgatttctacagtctagtcaattaccaaaaatttggattctgctttttggggaacagagtgggaaaacataactttgttttgaaaaaaaagaaatagggttgatcttgacttctcatatgaattaatgagaagacgtaattgttaaatttcattaaaagaagaatgttgtatttcatgtaggaggtaacagtgtagacacagacatgttctctactggttggagggtatgtgaggtgctgtgttcaaatatagttgctttaagagggatgctgaccaaataaattatgtccaaaagacagcaactgaaatggtgaaaggatacagaaatcctaacagaaaaacaggtgaaggatttggagtttttctcctggatataaaactagaaaactaatgatttatttcaaatacataaaagagttgttgcatggaagagagatgaatggtggtacagatgattggaaactagcaggtgacagacattttgctcaatatagaaaaaaacaccattaaatcacgaagctggctgtgcactggccatcaatagaagtattcaaatagtggtggtataagcatttgtcggggtaggagaggctggagaaaagctcttaggtcttcttcaaagatttgagggattaagatttgattttaactcttacttccgccttaagaaagttctcaatgaaaatgaaaaatagcatctgagaatagtctagattggtgtttcccaaacaaatctacaaattccatggctgttaataggcatgctatattcaaataaggttgaaaagcactgtatatgacatgctgtatttggagatttgattcacaatgcatactggccttaacccagctatttttcaaatgctgctaatgacgctcagtctcacaaaaaccttaatgtgatggaagcctaaatttcttttgggaaaaaaaacaaacaaacttagatttctgctttcaggaattaatcagcaaaagaaccttcctaaaaagaatgtaattaaccacatattgactcaaagggcctcagggttagaggaaacttaataatttggccgattctctcatccagggctcaatcctcctttatattctcttcactactgaaacagttccatgatcttgagagaataagagaactactgtgtgccaggtgctgttctgggcactgtatttaaaaaaattgtgttattttaatcttcacaatctgtatgaattattatcccctttctttacctatgtaaagaaactaagtctcagtgaactaataccagtgaaaagtccaaagagctactaagtgccagggcttcatgtctcctgggatcttaaaggttgcttctcccaaagagagaaaaatcaggaataggatttgatataatggttagcagtgaataaagccccaaataattttctttctcagaaagaacccagaattcacaaaagcccttttgtgttatgagtacaagaatgttgccttattctttgatcattttcagaacaactttggttacccagactgatatggttatttgcttgagataaaatatggcacaggtttggatggtaacacatatgagcagtttaaacctcatttagcagacctctcattacggaaaggattctatttgttgcaaaagaaaagatctttagtagtcatgtttttcccctctcaagattttaatacttaagatatctggctttcaaagatcttagtttgttagtaaatcagaagatggtacagcttctgcaaaacatactaaacgagtttaagatttttgggtctgccaggtgcagtggctcacgcctgtaatcccagaactttgggaggccaaagtgggtggatcacttgaactcaggagttcgagaccaacctgggcaacgttgcgaaactcagtctctacaaaaaacacaaaaaaacttagctgcacatggtggtgtgtgcctgtagtcacaactacttgagaggctgaggtgagaggattgcttgagcctggtaggcagaggttgcagtgagccgagattgtgccactgcactccagctggggcgacagaatgagaccctgtctcaaaaacaagattttgagtctaggagacttcactgttattcagggcatttctcactatctttaccttttcttccttaccgagaacatcaccagtggccatgatgtcacatgtgtacatagctgccatcaggcgctgaggtttcacttgcagtgcatagcgacatgcttctttcatggtggcaattagctgtcctgagaaaggtccatagcagtcagtgagtggagattctcctttctgtgatgtcctcttctcaaaggcctcagagcagccatcttgtagctcttggttttcatttccaccagaacaggtttcattttcctcctgtccctcttttgccagatcacttgctccttgttcctcaaatttacttaggtcccatttttccagaacaaaacagacacccatgagaggctcctcacacatggggccagagagggttgctagttggaagccactcacaatgctattgcccaaatctcggtatctactggcttcttttgaagctttgtcagctggacctgtccatactgagttctgaaaatcttcacttttattgactagtatgttgggcccacattttcttgggccaaatgaccagatttggtcaacaatgttcctccatcttctccctgttaggtgttgctccagttttcctttgaattcccaaattttctcttgggtcttctgatgaatcatgtgagtattttcaccctcattcaaagaggatgtcaactgctccatagaacgaatcaaatcactattttcttccagaatctgggtgacttcttctggaaggggcatggctcgaacactgagcgtggcaagtttattgggagttgttatggtgattagcccgtcagagtcaacttggattccttcagggattttgctttgatcttctttcatttggtgtatgactgcaactttttgctgtttgcctatttcttcattgaccatgtcaacttttgggggttttgtgattgtttctctgaatggaataataggttcagatacactgatatgaatctttgcaaacctacagacaaattcaagagaaataacagaaggttaaaatcaaaatagcatcaaagctcctgtgtagaaattactacacagtggagattctgtaaaaacataggaacataaaaattatcttactatgaaagatctgcaatttacattatataacattcaaaaactgctttctttctgattgaaaagactacttctaatgggaatatacctccagggaaatccttgcatgtactggaatttcacttttttttttttcattttcaagatatataaaccacccatttagataagaatgttttgagcagaaaataaatgttttaatatatgaaatatgaatgctttaaaacagtatttgcccatctaagagtgtggagaagaaaagctcaatgattaaaactctaaatagacatagaatcacagaacctcaggatagctagtcaaatcttcacaatgtatttggctttgataatgaggcttatagcaaggctagcatgatccatgagtttgtctagagcagcactttccaaaagaactttctgcaatggtggaaatgttctatatgtttattgtgattgctgagcccttgaaatgtggctagtacagctgaataaatttttaattttatttaaatttaaatagacacatatagctactaagcatttgaaatgcggctagtatgactgaggaactaaatttttaattgtatttgattttaaacagctgcatgtgggtagaagctactcttctggacatcataggtcttgagccccagtctgccaccaagttcagaaagccccttttcccacataatatcaaatttgatattgttgtatattgtatatttacaatctttttgtatattcacaggatatacaacaagatggacccgacattgtatgtttttaaaactactttgatattcaaacctgacaaagacagtatatatacacaaaactgcagttcaatcttacctaagaattcagatataaaatctaagataaaataacaaaaactatggatatgcaggtgtgtgcattaaaaaaaaacttattatgtatgaggcactgtgttaagtgttttacatgtagtatttctttagtaggcactagtactatctaattttgtagaagagaaaaccagataagaaagattaagtaatttctccaaatagtctgtaagtgaagaagctaggattcaaatttaggtctgacttcagaattcacactctcagtcattatgctatactgaaaaatgaagttactcagtacattaaaggaataatttactacaacactacgaagtttgtattataggttatatgaaaattaatttgtattagatctgttaataccacattaaaaatatcaaataatctatgtagccacttttaaatatgctaaattggcattcaataagattcaatacctattcttgattttaagaaaaaagccacttaaaaatcttaggaataggaaaatatttctaaaattatcattacatagagaaaaatatgctcatatacttagaacactcaagaaaaccaacggcaaagcttctgaaactacgagagagaacacatctacaacactgccctcttattcctgtaacatagtcaaaagagctatgagccactttagtccttctaattcctgaggctcccaagaagtctcctgtagtaatcatttatatgattaattaaaaccactccaagctgtggaaggaagtgtgtgatggttgccacactcacaaagcacctcaggaccaaaggttctttaagtcctagcaatgcagagcctgtgatgacactaaaaaaagtgcggtaggctcaggctacatcatggcaatttcctgtggcttcctgctctgattattactaccttgagatctggatgctaagaattctgacagtttctctggcctggagacaatatagtctccttgtctcccattcctggacataatccattcctgaagatgtgtgtagaagttgaaaaagattatatactaccaaaaggtaggctctgtcctatgagaactaaacaaattctataacattatacacattcttaatgtaagcataattgtgaaatgtaatagtcatatagaacagtgcacaaaacaaaaatctactgatctatgataacttacctcaaagtgaacacccatgtaaactacatggtatagtcaagaaacagaacagtcttagccctcagagggccccaatgccattaagtatgaaggtaactgttatcctgatttttattgtaatagcctccattttttttaaatcacctaaccatgtaaccccttatactccacagttcagtttggactgcacttctttttgttcttttttaaaaacagggtcttgctctgtcacccagcctgaagtgcagtggtgtgattacagttcactgcagcctcgagctcctgggctcaagcaaccctcttgcctcagcttcctgagtatctggtattacaggcatgcaccacctgcccgattaatttatttttatttttttagagatgaggtcttgctatgttacccaacctggtgcactatgttttgaacttcatataaatacaaacaaacactttttgggggaagtgaagtggcttcttctgttcaacattatattgtgagattcacctatgttttatatagctgtagttttgttcactgagatcattctatagaattccattgtatgaatacgccattatttatttatttatttatccatttaaatgtttgagttgtttccaacttttggctactaaaattttgttgccatgaggccaggtatggtggctcacgtctgtaatcccagcactttgggaggccgaggaggttggatcacttgaggtcaagagtttgagaacagcctggccaagatggtgaaacaccatctctactaaaaatataaaagttagctgggcgtggtggcgtgcacctgtagtcccagctactcaggaggccgaggcaggagaattgcctgagcccaggaagcggaggttgtagtaagctgagagtggaccactgcattccagcctgagcaatgggagtgccttttctcaaaaaaataaaaataaataaataaataaactgttgctatgcgtattcttgatgcacatttgcctagctttgtgttgtgtatatacaggtacaaatgggagtagatttgccaagccacaggaagtgcctatctcccatcttagcagatcataccaaatcatattccaaaatagttgtaccaattgatatccccactagttgtgtgggtgaattcttgttgttccacatctttgccaccacttgataatatcacttaaaaatatttaaccactctagtgggtatgcagaagtatctcactttgattttaatttgcattccatcaattagtaataagttgaatagtctttcatgtttattggcctttggaagcctcttttatgaagtacctcttcaagtctttgtacagtttttctattggattgctgctcttctcatttatttgtaggaattccttccatattggggatataagtctgttgtctgttacaagtggtataaaggtcttctctaaccctgcggtcagcctccttattatcttaatagtgtcttttgatgatcaaggttttcctttgtcattagtgctcttaacatgctattaagaagctttttgccaccctgaggtcttgaagatattctcttatactatcttctaaacacttcatggttttgccttttacattttaaccaacaactcacctgaaataaatttctgaatacatcatgaggtagcggtctagtttctggaatctggtagaagcttctacaaaatcccacataaatgcagcagcagttattctattttttttgagacagagtcttgctctgttgccaggctacagtgcagtggtgtgatctcagctcaccacagtctctgcctcctgggtcaagcaattctcctgcctcagcctcctgagtagctggattacaggtgcacgccaccacatccagctaatttttgtatttttagtagagagggagtttcaccatgttggccaggatggtctcgatctcctgacctcgtgatctgcccgccctggcctcccaaagtgctgggattagaggcgtgagccaccgtgcctggccagcagcagttattcttattctattattagtaccaggtgttgttgtatagttactactaccaccgattttactgtggtataaagattgagataaatagtgcttaacacagtgactgttatttaatatatgactatatcaatcatttataattattatttttgttatgattatgattatagtcccagaaattttaaaaacaaaaagaaggaaggccattacagggcagtttataattttttctactagtaagcacagaaatgtatattaaccatgaatatctttcatttgtcttcaagattggtgaaatttttagaaaatgataaactatgcaaagttggcaaaagtttgagaagaggcaagttcaaatatttattgctagttataatgtaaattagaacagtctttcttgaggaaaatatggatcataatccttaaaaatatgcatactttttgagctagctataatacttccagaagtttatcttaaccaaataatcagaactgtgtatatagatatttgtgtatatttgaatatgcatagaacagtgcagatttatgaatctgaatgtaatggtggttatttctgcatgataactgaatgattctttttcttcttctgcattttcctaatttctgcaataaacatacattatctttggaacaaagaagaaaaatgcccgttataaaaatttgggatgcccattttataatacatatcatctttatagaaaaacataaagatttccagaaggtttacattgtaaagaccacatcaataagagaagaagtctatcctaattacatagccaacatttacaaaataatatcttgttttgttgtcctggtattttgtgtgttttgtgtacatgcttaaagtaaaatacatacacagaaaaacattttatgacttaagctaaaaatgcaaaattattcaagtgtaggcagtgaatgccatttttcagttattaaaaaataagtctacaatcgaataactgttcatgtctgaattgagggcatttcatttttctccaaaaataagccgcagtctaagttcaactggtttaggaaacactaaaacatcccattgattgagagctatcatttctccatcgctatcattttcacctaacctttcttttaagtcatccaggcatcgctgaaggtggacttctcctgctgtgactaaaacgtgctctcccgtttcctgaattaaaatctggacacagggatcagcctggtttaacagtttcattccttttacgagctgaggcatttcacctaggttaacaaaacgaaatagattaaatatgatataagaactaacacaattcaaagacaatggctctggctactgaagggaaaattacattgaaataaactcttaaaacaacaatttatttttcttccagatagtgtagtgatgtgaagaaaactaccttctagtaatttttttgtacagatagcaaacatgacacatccgcaagcttaccatcaagactcccaaagctgatctatattacttcttcaaatactctgcagatacaagctaccatctttttacttgtgaattcacctaaatcttataacgaatgtatacattatatacctagaaatgaaacagagcatttcctcaaacatcgcctataaaatcaacaaataagcaaaagaaacatttaatgtgatattcaagaaactgtaccagagcctcatattaaaaataattatttgtgaaactgcttgctagaacttgggttttagaataccctaactagctactttatctggtgagctaaaggcatcttctgcattgtgttctgcatgtatttttcatatataattgctttttcctgggagttgagagtagggatagggactgtgacctacatcttgggtttagctgctttttcaccccctttccacatactcaactgctactgctccctcaaggcaggtccaaggaagtctcttgcagctgccttagcagaaaccttggtcttaaagacgtttttatgcagtcttgtttcaattctacatttgaagaaaagacttagcaattcctcaatgcttggttttcagcatgtcaaacaaacaaaatcacaggaactttctgcaatgcaatgattttcaacatgccttataaaagtcgattaactgggagcaggaatattagaacttctatacctatttatttttgaaataaagttctaataataactaacatttcatagcactaacaatgtgccagacaagcactttacatatatgagctcattaacgatgaggcggtatgatgattgttctcattttatagatgaggaaacaggtatagagaaactaataaacttgtgttcaaggtcccagactaactaagtggcagaacctggtttagaagctgggcagccagccagagagcccatgctctgcggatggatgtcagcacacttgtaggtcaggtgatcaaaagccacatatggaatgcaaagaatcccaagggaagacggaaagtgggatttcactgtgtccagggttgacagaggcaccttcatttgttcctttttggcatactgtaattttttttttgtctaattaagtggattttcagatattatctagtgttaactaagccttcacagaattttaaacctggcttaaaaggattcctgcaaagatatcactgataatactataatactaataacataagcacatgggaataataaaaaaagaaatggcaaagctttttgtcagctctccatcaaacaaattataaagtaaaaacaatggttatcaccaagatgagatcccaacaaatatttctgaaaaaatatatacacacttaaatctgtctcttcaaggtaaaataaaggtaacagtttaacaataagaaaagtttttttttttttttcaaaagaaatttgaaacatggagacaacattttgaaattaggtgtttgaaaatgttgccgctgacagctatttggttgccaaagataacataaatacttcatgtataatgtataaaaacctcttacaatttggaaggtgattttcttaacctgttcttaaaatcaccaaatggatagttcaataaagatataagaattaacaaaccttctaattagtgtaagaaaaatggactgccatcaggaaaactagatgttcactatatacattttaccaaaaccttttaataattgggaaaatggaatactaaaatggataacgtgacttagtaaaggaagccaacgaatcattcttccctttggactatgcaattttgtgaggtgccttttccagtgataatggtcattaaaatcaagtgttttaacaaatggaacctagaagccgaccttggaatggctatatcacaaagtgttcaggcaagaccttcaaaaagaaggaagcattattgtggtagccagcctccaagatggctccaatcatccttgcctcctgatattcacattcctgtgcagctctctccaacagtgagtcatggctggcctgtgtgaccaacagaacactgtggaaaggatgatgtgtgattcccaaggctagttcacaaaaggcattatagcttctgccttagtgttttggaatgctggctgcagccaatcaccatgcaggacactcaaacagtcatgtagagaggaactgagattccccagccagcaccaacttgtgagcccatgtttggaagtacagttaaaccttcagatggctaccgcccaaggtgatgtatgactaccactacttgagagacacgatgctgaacgcttccaaattccagaccaagggaactatgaaaaataagtgttgtttcaagccactaaattttgaagcaatatgttacatagtattaggtaactaaaataattataagccacaatcacaaatcaatattatctataattatatgtacatactgtatgtatcttcatcaaatacaaataaaattaggtatttgattttcatcttaatttttaaataacttctattttgtgcttcataatgtatataaaacagcacaaaaattcatatatctatataagcataggtatcaaaaattttttttaactaatatggataaaggataaaacaattctagaaacaaattactctgctcagataaacaggatttcttggattcccacaagtgaagatccagcattgtctctgaggcagtgatctgaattctgacctcactgcttcctaactgtatggccttgggcaaattaattaacttctctaagcttcagtttccctcatgtgaagatgagaataaaaagagtatcctaataaacagggcttttgggaggattaaatgagataatcaatgtaaaatccttagtacagtgtgtggcatacagcaaggttcaattataatgaagaaaataataattgctttggaacatttgtagttctctgtgttgagtttgtagttgacctgtgggcatgaagtagagggtggctgccatgagattttgacccccacttgggaaattagagaaagaaaagtggaagaacaaatgctcacgatttgcttctccctgaaagaaaagaagcaaactgttgtcttctggattaatctagttgtcacaataaaaaaaaaagagaggacatggggatacgtggtctattcaagaaaaacaatgaatgtgtccagtgcctctcagaggcagtattactgcaaagtcttttaagagagtgaaatatcccaatagtcgtcagacatgtaatctacgaataagggggtcactgccccaaaataaggatgagcataagttactagggcaaagagtaaacagaaaataaatatcctctgaaagctcataggaacaaggaagggaagtttccccagacattctgaatgtaaaataacatgtggacaatgtaaaaacaccaagaaggcaaaacaaagagtacaaaattcagacactgaaaaatcaaatggggtgcttcagtaacacagtcaataaatgcaaggtaaatccagtaaaaacaatatacttaaagggaagaaaatagcaatactccttttaaaattatgaagaaaattatgtgccccttctaaccattttagtttactttttacaaagttcagataaatttaatgtaaacacatgaggaagtacactttggcctacaaattgataatcctgaataattccatttattagactatctcatttatggaaaggaaaggaacttaatcttactatgaatcagctatagtacaggaaatacactaggtactagaatccttcatctcatgtagccagtccttcaaagaagctggttctttagggttgggcttttacttagcttccataacagagaccacagactagcacataaccataacagagccttttaaaaattataaatttctattattaaaatatcacatcttaggccaggcacagtggctcacacctgtaatcccagcactctaagaggctgaggtgagaggactgcttaagctcaggagtttaggaccagtctgggtgacatggggagaacccatctacaaataatgaaaaaaattagctgggtatggtgacatatgtctgtggtcccagctacttgggaggctgaggcaggaggatctcgtgagcccaggaggtcaaggctgcagtgaatcgtgattgtgactgagccactgcactccggcctgggtgacagtgagatcttgtctcaaaccaaataaataaacaagtaaaattatggcttaaattattttttcctatttttaaaatgtatgtgcaaatgcaataaactaagtaagaaagaggatacaaataaatagtagaaacatctacgaataagctatggttgccagactcaaatatcacaacttaaataaaactgagctttcttgtatgtatttcttaggattgaacacggtagacaggggttagagccagcctagtgagtagaataaaagaacaaaatcacgaaaggccaggatctgaacaagcctaaaagaggaagcatgttttacacagaatgggataaatccgtgtagcaaccaaggcactgtgtcagtccacagtgacagcccacaaaaaattcctatctcgaggctgaaggcagatggctatttactagggctggccccaaaggtcagaggtccagtcctccaagtatctgctctggggatccagggatccttaatggctaggggtatgtcttagaacttgagacagcaatgagttcagaaggcttagctccagggagaggagggatacatatgttcaggagcaatgaggccattgtacacctcaacagaaaactaccattttaccatttgtcctttggtttccctaaggcatggtctggagattcttcactgacaatcactagcactggaatagcaaagtcacagtgattcaggattagcaatagtcatgggacgtgaaatacaaaagtaaaaaaggattgactaggcaaataccataagccaaagactaaggagttgttattatatggtcaggtatatgtgaatgtcaggtggccagcaggaaaggtgcagaaagtggtttctaaacagacgggaaattctcagtgtgcagataatctgtcaaacctagagggaagaggcaaatgatgaattctgaactaaggagcttgagataagattccaactaagaagaagtcacataaaacatgaaatttggccgggcactttagttcacgcctgtaatcctagcagtttgggagcccgaggcaggcagatgacctgcggtcaggagttcaagaccagcctggccaactggcgaaaccccgtatctactaaaaatacaaaaattagccaggtgtggtggtggatgcctgcaatcccagctattcaggaggctgaggcaggagaatcgcttgaacccaggcagcagaggttgagtcaagatcacaccagtgtactctagcctgcgcaacagagtgagactccgcctcaaaaaaataaataaatagataaataaacataagctttgctaagctacaatcctatgccagggttgtgggggatgtagagatgaccttgtctttgccatcaagaagatgcagtctccctggacagcaaaggtacctgtaaccatggcatgttcctaagacagaagttagatgccctttgaagagttgcttctactatagacctcaatgaaaattcattatatactgctgaaacaagtcatgaggaatcaaatactaaatacatgcatatgctttaaaagtataataaacatatgcttttaaaaataaggtcatcttacttggatgttttggttcaacagcaactctcacaataggagtggcttcgaagttgagtggtataaatggtgggcaggatggcaggctacacagtgttgcagatttcagcacaaaatcttgaaggcctcctattcctgtaggaagaaaagatccatacggtcaataagggatgataaattctgaatttatgtcagaaaaacagcagcatcaacccagtatatgtatcacagagccaaatgcttccaaaatgttgcaagaaatgaggcggacctgcactgtttttttttttgtacacctggataccatttgattgctgtcaaaatacagaaattctgccttttgtttcccacatgtacaaatcctattatatcagattgggctaatgcatagctactttgaccacagaaatgatcacttccagatatatttgtctgaaaacactgattatttctaacacttagttggtttttaaaaatatattaatttgatgaagatgggtctctactgaaataatcttctgccaaatccatctgcatatgagtaaagggaatttagaaacttaaaatgtgatgttgctatgtagtatgttaccctaagctaccctccatactccccctgttttagaagagaatcctagtcaaccccttccccctgccatacactcacttcagacttttggctgatgattgcatgagactctgaaggttgcatatttgtctttgagcagatggaagcaaaaagaatgtcttagaaagagtgataaggggccaggtgcagtggctcacgcctgcaatctcagcactttgggaggccgaggccggcggatcacaaggtcaggagatcgagactatcctggctaacacggtgaaaccccgtctctactaaaaatacaaaaaattagccgggcgtggtggtgggcgcctgtagtcccagctacttgggaggctgaggcaggtgaattgcttgaacctgggaggcgggggatgcagtgagccaagatcgtgccactgcactccagtgtgggcgacagagcgagattccacctcaaaaaaaaaaaaaaaagagtgataaagaggcatattgaatctcacacccagactatgagtagacaacattttagaacaaattaagaaacacatacaaagggccagtgcagtggctcatgcctgtaatcccagcactttgggaagtcaaggaggatcacttgaggtcaggagttcaagaccagcctgggtaacagagtgagacttcttgctacaaaaaattcagccaggcatggtggtgcacacctgtctatagtcccaggtacttgagaggttgaggtgggaggatcgcttaagcacaggagttcaagactgggtgacagactgagaccccgtcaaaaaggacaggaaaggataggacaggagagagaaaaagagagagagtgaaagagagagagcgagagaaacacacacacacgggccatttttgtgcttttgggttgaagaaaggaaacaaagaaaatcactttgctgtccttagttgaccaattgatgtaaaggtacagggtgatgggaggccaccgaatcacacatccagactggtggagaggaactgaagcagaggcttcaggtacacaaacttggaggataatttagaggtttcttgttgtccgactacacagtatggaaacctccatctaacatccacctgaatatctacggtctgacagccactagaatttatcacctcgctacattaacagatagctccaactttaagaaaatcttccttgcagtattctaaaatctgtctttccccatctccacacatcgttcttagtgtgtggaacctccaaaggttcacagaaaatgtgcttctttcactttcaccaactaccttttggattttgaaagcatttgtcagatccttttaactctgttctgcctcacattaggtatcattagctcctttaactaatcagcacaggacatgatttacagaccttttgtgtgcatgggatcctcttcagactaaagtttctaggatgttaaattcctcctgtgcctccagtgtacttctttggtcaaagtctaaatttcttattattgtacctcttagctcagcacacacagtaatacctggctatagcttcttgtttacatctcccattggtactatgatgtaacagatctaggtctaagtttccactaagtctactagaaataacatctccctagaggctaagggtttaggaaaaccccatagtaaatattccctttcaaacctcatccatcctgcttctgacctctgaccagcatgcatttccttcctacacacacagcacatggtttcaatgaaaagataaatgctggtctttcctctgtattaccagggatgcagactgcagatggtcagtatattttaaacactgtctctttgaacttctggtttacattttgctgttccaattaccgaatctactcttgctatttagatatgcccagatttgctaacatgattataattctcccagaaacaaaaagtcaagagaccacaatgttcatagctaagattagaatttatggaaaaagcaatgctccaaagatagtaaaaacttcactacctgtactacatgtcaacatttttacttatttttaaatataattttaaaatctaggaaagggaggaccattaagatgatctagatgaatcactataaagtgactttaaaattccttttcagaatttcttgatttgctatcaattattaaatgcacaacttgttctttacacaaaatacagtctgaagcaactttttgtttttaaaaataacatcagcaagtaccatcttgaaaaaggacattatacccacaatcccatcattctaatattgccactattttcatttttatatttctcttttttcttctctattgtcacacataatttacactgttgtaataaccataaacttcttgtccttcttttttctaattaaatcatgtgattttcatttcagtcactttagtgaaaattataacaattagggacaaagaatttcttcacagaaagcacatttgctaaagcatttttcaactggaattgggggatgagaagtatgttccctccgggtaatcatttcagaattcccagggtaggaagagtgatagcacgggggaataaaattcaaaattagcgtgccattgatttgattttagtcactatatttattttcacatttcatggattatagagggcaccagtatttttttatgtttatcaaaaaagtacatgtgatttacaagaaataaaagagaaagcaggttgaggaacatggagctaaagcaatttactagatgccaagaattctagtttttatagaaacaccagtacttttgtctgattgaagataagtgatcaaacccaagccctttatgatcctgatttttctctatacaacaaataaaattaaataaattggcatgtgaactctatgttcacacagactggaatgacaactgggtacataggtccttgctagactgtatactacacccttcaaattcctcataatcaaaaaccagtattttgtaaagactgttgagccaaatttttttttctaggctgtcccaaatgtttccctttaagaagaatttcagaaagaaatattaaggagagtatcttttatgatatgagactgaaaaaaattgtgtgaggcttgagagatgaattcaccttctgttgaaaacttttttactattcttaacaactccctgttgcacaggtttaatcaatctaggatgaggttacactggcaagcaggaagatggtaaaaccattagtgaatactaacactgctttctgggggcgagcctgttagctgtctggatagggaacagaattaccatcttcaggcaaatttggatttgtaaagtgctctttcattgtactgttacaatttaattctaacattattagaattttaaaaatttgtgggaaaaaacgttagaatatggtctcttaatcaccaaagttttatttcaaactgactttaacattcttcacccaagaaccatcaacctgttcctgttaacctgtttaagctgaattaatggatctctttacacctttgcagtaaatgcaagtcatatgtcatgaacatccatacagcctcatgcctgtgagagaacatcactttggaagagagatgaggattttttttaagtacaagctccccaggtagtgggaatctagagaacccttagttttgaaagaccatcttctgctttaggcccccttgcatttggataccaaagcagctcatatcctctgtttccaattttatgccttggttttgtatctttcatcaaaactcaagattctgcactctttgactcaactacaaagaataacagggaatccacacgctttataactcttgtcacccttttccaagcctgcttggccagcatctccaaagtggatcagtattgcttagctaaggttttcagaagatgggtcaagtctgtccatcatgctaaacaagtccattaaatcaactgccctttaacttcttggtgttatagtaggccttagggaaaaatcttgcaacaatgacatcactatgtcataaatttttttcttctcataggaacagactgagctaataacagttttctgtctgtttgtttttgagacggaatctcgccctgttgcccagactggagtgcttgtggcgcgaggtcagctcactgcaacctccggctcctggggttccagcgattctcccatctcagcctcccaagtagttgggattacaggcacttgccaccacgcccggctaattttttgtattttcagtagagatggggtttcaccatgttggccagactggtcttgaactcctgacttcaagtgatccgccctccttggcctcccaaagtgctgggattacagatgtaataatagttcttacacatattacttcaagatctgtgggcccttttctcagaagagaaactacccagtaaaatgagaagaaaaagtaacacctaaagaatgaaaactcttttttcctggaaatatgctggcttactatctttgtatttgagaagaggtagaaacttgtccctcagtgtcctgaacaagttgagttttattatgtgtcactgtaaggtcccaatttatgccccaagaaaggatcctgagacagccagactaccatcattcaattaagaacagactgacccaatggagcttggttctcatcaagggaataacgcggttctcagtgtgggggtctaggattaaaacagtggaagaaattccatctggggcttggaaacagagtagaatgcctgagtggggcatagtattttatcatgtcttggtgtgtcctaacaggacaaaaagaatctacagaggatctacccaaaaaggatctacccacactcacaactgtatcattttcctggtgagaatgaagctccatttgggtcagtctgttcctaatagaatggtggtggtctggctttcttatgatcctttcttggagcataaattgggatcttacagagaaattagagagaactgaggtagagctgctaagtcttggtggttttttaggagctgggaagaagggacaagaaggaaacaagaataaaatccagattcctgacatggacaactaggcagataagttactagttcaaagcagttgtctattcttcttttaggtttataacttttatcattcatattagttctttatgtaataaacatttgaactctttcatatttttttttctccagactatagtttctcttttcattttgcttctatttttttctctacagtaactttttgagctttttccatttggcgtctaagtttcaaagctcaggaagctgtgctttcaaataattgataaacagttattcaactttctgttagtctttcaatgagttcagttttaacggcaaggaccaaaataggcacttcatagattcctcaatgaatgagtgcacataagcacagttgcggtcttcacagagtttaaaatctggtgagggacaaaggcaaatacacagttaattacgatacaatgtgacacatcttataataggaaaagtatactttttgttcatgtgaagacagaaaccgaaaaggttatgggcctcctggagaaaatggcattcaggagtatggaaataaccacacagaggacatgggaaggagtgatgaggtgtggaaatggcaccactggatgtcttttttttttttttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccccactggatgtctaagtgagaaaccaaggtcattattgacagctgcagggtggagcacaaggcacaagtgaaaagacttttccatcccattctttttcttttctttagtcaacatgcattcttgttatgttcaatttggaatccaaggaacttgaatgttataaagttctaaccttatgcaataagtggaagtagtggcagtggtggttctaacagtcagagtagcagtggttttattcatagatttgttaatcaaatttaagagctattttggagtatgacataaattgcatatttaatttttttgtatatattgttaactacaaggaaagctgtaataacttctttatgaggcataaattcatattcaggatcagatccatttatgagttttgtatcctgtcccatttacctaaatttatattttatatagtaacacatggttttaagtgatactcctttaacatgtgctgcattccaattcaaatgacttaaataaatgggggaaacacacaagattcagtaagtcagaagcacaaaatgcttagtatagttgaaaacaatgctggaaatttgttttaagacaaaaagaaaggggaagagatacggctttacacaaccaggaaatcataactgaattccttctacctttaaaccctaaatatttccaattaaaatcaggaaacagagtcacttctggatgaaatggcaacttcagcacaggtatacaaatggtcctgattgaaatgatcaaagaaacagaaaactaaagaaaagctgaatgagtaggtgaaaactagaggagggcaccttgaactgtgagctatttctgttagtcgtggatcagattaaaggaaaatattaagggtcagttcataactctcttcttgagcaagtggcacaacctcaggggataaaaataaataggcagtgtagtgacagcggtctgttagacaacagatcaatgggaaaaaatgaagagcccagaaaaagaccaacacgtgtgggaatgtggaaatgacgaaggggcaacagtggcagacaggcaggcctattcggtaaacagcattgaaacaattagccaatgaaatgtgaaaaatgatataattgcatctgcgtcataccatctagaaaaagaaatttcatgtagatcaaaggcctaaatgtgaaacataaaacctgaaagcacaaatcatatgataccataagactgaagatttgtaagactcactacattattttaaaaacttcaaaacaaaagataccaaacaaatatgggaacaacagacgctgtggactactagagagtggggagggaggttggataaaaaactacctatcaggtactaagcttactaccaaagtgatagaatccatactccaaacctcagcatcatgcaatactctcatgtaacaaatctgcacacatacctcctgtactgaaaataaaagttaaaatttatatatacacacacacacacacaccctgtaaagataaaagctacaaagagatgctttcaatgtcgaaaggggacaaaaaattttaagtatatgtaaacaactagtacagatcaatgaaaaaaggcaacccaataggaatctagacaaagaatataaatagtccaagaaaagacattaaaagaaaagaaagcctcagtcaaaaaacattaaaaaaaaaaagaatctcattgataataaggtaaatgcaaattaaaaccagatactatttcacaccaatacaactggtataagtctgaagaaaccacgtgctggcagttatgtgcagaaaaagtaggtcttatgtactgtagacaagaacaaaaattgttacaactatgagcgagaataagctgcattattcattaaagtatgattagactgcgcaactcaccaatgtgatttctagttgtatatcccagagcagtgttgagaacaggcacaattgtgtaccaacagcacatcacccacagccatacaacccctctctaggtgatttagtgagtgactggtgggagcgtttctgattggggcctactactggcagttagtgagcaggggccagtgctttgcatgtgtgaaaatatcttcccgtacaagaattaccctctttgtacagcttttgaatattctgctggacaaacctgttcataataatctgagtttaaatctaattccattttaataacaaagacttttttgtagtttaatatacaccgaattttcagaaatggaattaccacgtaaatcaaaggaagaatgaacttgttctgaaaacaagctgttcaacattttatcgacagtcactcatggcgtatgagtcatcaataccatatatctgtatcaagcttcatctgtgactgtcacagaaacatggtgactacaaatatctgacttaactcatgtagtcaaactggaacatttatatactaaaatgcatgttattttattgtaaatcacttcacttttatttatcccttacattaaagtattatactgatatttttgaaattatgcaggcaggcagattattttatctttgaatttcattcctgggtagtaaaagtgatgtcagaatatttgttatgaaaagaaggtagagtttgacagggttaagaagtaccccctagaaaaactcatctatgtgcacaaggaaaaaaatgttcaaaagtattcacggtaatgtgtttgtcacagcaaaaaatcgaaagcacccttcaatatccaccaacaggagattgaaaaaataaattataatgaattcatacaatggaatcaacatagaaaaaaaatctgtaaaacataaaacagtacaataatagcatgttacagaaggtcatgaacaatatgatactattatgcaaagtttaaaaattaaaaaaaatatattgctgacacctactgaaattacaaacaagttttaaagcattggaagacaaacttacacagcaagtttcaagaagtggtactgctgaggaatatgggagttattgatgggataagggacttagatagctaacatttcaccaggtataaagaaagttgtacaattaaagaaaaacatgaaaattagttgagtctggatggcaggtacatgaacgttcattatattatctattgtctgaaatactttaaagttttaaaaagtgaatgattgtttcagtcagctcctggtttttatctttttatttctgtaatttgcaaatattctataattaacttgtttgtaaaaaagtatatctttcctctcttaaaatgtgtgtactttaaaattacaactttaaatgcataaataaaatatataagaaaacatatatatgcacagaaaaaaagagctggaggatatattccaaaatgtcaatagtggctacgtctggatagtggggttaaaggtcattttcattttattttttctatatttaaacaaatggtctcaccaaatgtactatttttatgatgataaaacaatctttttttctttttaaaaaatacatttgggccaggcgcggtggctcacacctgtaatcccagcactttgggaggccgaagcaggcggatcacgaggtcaggagatggagaccatcctggctaacatggtgaaaccctgcctctactaaaaatacaaaaaattagccggaggtggtggcggaagcctatagtcccagctacttgggaggctgaagcaggagaatggcgtgaacccgggaggcggagtttgcagtgagccgagttggtgccactgcactccagcctgggtgacagagcgagactcctctcaaaaaaggaaaaaaaaaaccatttatgtcaggggagaaggggagagcacgaacacagttctctctaccacaaagtatgcagtagagcttcccacatttggggaaatcgcaggggtcagcacacctggagtgtactgaataagcctcgccctgggaaaccaactttgtgatcttggtatctcccctaccaagtaagtacctatgatgattaaaaaaaaatgtttaaaaataactagaagttaaaaaaagcctttttgttatttctgtgccttgaatgctcacattgtttgaattaccacagggcaatgaacctgggattatactgtaaatggattacatttgcattaatcaatttagaccctagaaactgaaactgtggtctcacctctggattgccagacttggatttcatggtgcctggtgtccacagagggagtcttggattcctatctgatagggaactggaatgtttcttgaggttaaccaaggttctgagagtgaggagtcttagccttcagtttaagaaggctgtgttgaaccttagtcccactgccaaaccctaatctccagatctactcacaggccaccgtggaattatatgtgggcctgcatcacccgatgccactcctgtgtcctttaccatttgcaatgatcacttttccaaaggttaatattttctacgaagtcaattcaggaattatggaatttggagggtcctgtagaatcttacactctagtacactatgatttccttgagcgcaggctctgaacagttgctgaaagaatatgtcatatgtcttctgtgctttttagatttatttcattaagtgtctagtaatgactaatacttataaacttatgctgtgcaccacaggggagacagagatgaagacagaaatcccacattctattttctcacattttcttattgtaagtgctcctgaagcatttttacagtgcagtcacattattactgagtatttattccaatcccaagcttcaaaagcttgggatttttgagactattgccctacgtctgcatcttgatgtggcacaggtactgactatgacactgatacagcttacttgaagtaacaatattaggcaaaagtaacaatattagaatgttaactaatttttaagcaaatacagatcatttcaagtcaagccagttatcttttccagggcacgcattacttcctggtgagaagcagcacaagaacagaagcagttctgttattgtggactgaaaaaatacaaccttcacattttctttcttacttagtagatcaatgaaataaccagaactacaggttgaatttttggtattaataccattttcaatatgaatggggttttatactacagtagttatgggttttaattttatgttataaaaacacagtattggccgggtgcagtggctcacgcatgtaatcccagcactttgggagtcatgagttaaaagaccagcctggccaacatggcaaaaccccgtctctactaaaaatacaaaaattagccggcaaggtggcaggcacctgtaatcccagctactcggaaggctgaggtgggagaattgcttgaacccaggaggttcaagacctgggcaacagagcaagactacatcttaaaaactgaattttgaagattacttagaaataaagtagaatatgtaattcaatgtaaataggatgatataaaaatagaataataataactaaaatacaaactgtaggaatgctagtattgagattacaagtaatcttttaaaaccaaaaaattataatttttaccaggaaaagttattagacacaagctactataatttttgaattaaagagctgccattattgaagatgtaaactacacaaactgatatttggcaatggtgacactgcagtacagtggggatgtgataatggttctaagtcaaccagatacctgattgaaaaaaataattgacattgactcccacctgacctctgttacaaaaaccaatgtcagacggattgcagatctaaatacaataagtaaaacaaaaaaaagcttatggaataacaacatagaatatcaccatgactttggaataagcagatttcttaaacaagacacaaaaagcgttagtcgtaaaagaaaaaattgaaaaatattagattatattaaaactaagaacttccgtttatcaagagacatcattagatggcagaaagataactcgcaaaggagaaaatatttgcaatacatatacccatccagggacttttatgcagaatatataaagaatgcctataaatcaatacaaaaaaggcagagaatctataagtgggtaaagacttaacaggcatcccacaaatcagtaaacaacaatggtcaatatataaatgaaaaggacctttcacttctctagtcaccagcaaaatctacgtaatatactaccccatacacacaaaaatgactcgaatgaaagcaaaaacaagtatggacaaagatacagagcaactggaactttcagatacccctggtggaagcataaagtggtacattgactaagcttgagcatatgcctactctatgacccaataatttctcttccatcagaaagcagacacattaaccaaaagacatgtataagaatattcaaagtgacaatattcataatagtcaaatactggaaattacttaaatatccaccaacagaagagtggataaataaactggtagtcacacaacacagtaacatgaatgagcaaatcacaaccatgtgccatgacatggatgaacctcataaacagaatgctaaatgaaaaatgcccaatgcaagagcacattctatatataaagcttaaaatcaggtaaatctaatagggtgaaggggtgcggtggcagtaattcgaaaggagcttggcttctgggatgtttgtaaggttctgtttctgggtctgggtactagttacactggcatatgttcagtttatgaaaattcatcaagctgtgcatttaagatttgcatacttttctatgtgcatcttatgcatcaataagtatacttaaaatgttatttgacacaaattacatgggtattttaagtgtttctgagtcttttagagatgctaataactgcaactaataaaaataaaccatttcagaacctttaaaaaagaactggcagcaaaggggagagcacatggttcatctccttgtatcttttttctccacatcctctaatgactaataaaatgtggctttcattgcgaagtctttacactgattctcctggccaggtctgtcctcaaccaaatcacttccttattcaagtgcgtgtaaacagcctcctcctggctgcatacttctgtctaccctctggctcctgacattgtggttcacatgaagtttttggtcttttaaatacccattggaagacgctcaaaaaggctcagaaaactgttccttgattttggtctgcttcattttttgggaaagcaaaacaagtcccagcaccacatgcttctctactgctgcctttatttatttattaaaaaacatccaacacactacccaaagaattttcaagtgtctccttccacttttaccatctaccactgccaaaatctaaccactagcagagtaaaataatctcagctcacatcatgggaaatatttctttggctctgagaaaaccagagagaaagtgctgcaaaatgtaggttaggaaaataatgtgaaagttatttcaagttgatgatttccatagtatggaatgtgatggtcttgcatatgtgactctctgaataaagaccccaaaaatactgtgaggtaagattgtcatttttaattggccccaaatagaagagtcataagggattttcaggggaagcccctttactctatcagggatactcaggtgtcttttctcaataagcattctttagatttatcagcaacaaactaaagaattccactgtaatacaaagctaacatgctgacagagcatctttgaagaagctttcacaagacagactaatgtaaacaattttttcaaggcttcccagcctatgactaccagtgaagtctgattaataataaccaccaaatcacactggctctctgtccacaccagttcatacggggccttatttggaatgtgtctatcaactaatctgggcatcctagtggaaattcctcatgggcccacgagctcacacttgccatagatacatgaacactagggttgtcagggtgcccaaactctgcagtagtttctggagtagtggaaatgctccttccttgtgcttcactctcttagagggaaaaaggcattgtggtgacccaatgtcttacagaggtcagttcttcaggttttactcttgccttccaaaggtctcaatcagcggagcaatagggctgggccaaaaggcaaatcaagtgacaggcagcacatcattcctccctcttgagactaaggcttgactactggattaccctgtcatgcctggtttcttctcccttaggaggaatttcattccaggaggtatcccaatcactttcaagagctcattctaccaattctctggacatgcccctcctctgaaccctagaaaataacacagtctatactgaagctaatccttggtacttaactgtttgcattactattctccataaagaaaatgggcttagcatggtggctcacacctataatcccagaattttgggaggctgaggaaggaggcccaggagttcaagaccagcctgggaaacatagcaagactctgtctcaaaacaaataaaaaataaaaaaataaaaattacccaggcatggtggcacacgcctgtagtcccagctacttaggagactgaggcaggaggattacttgagcccagaagttcgaggttacagtaaactatgatcgtgccaccgcaatctagccagggcaacagagtgagaccctctctctaacaaattaaataaataaaaaaaagaatggctcattggatttggcttaggtagcagaagaggtggcaatacttcctagtatactcaggtaatgagaaaagccttcagggagatatggaagcagtcaggtctccagacccagtacctcatcaggtaaacaaaatcatctctaaaatggtctgttttagttaacatgaatttttttttaaagctttgcaagcaagttttatagtttgcttgtaaaacagcactgtctctgattgattttaaagacagaatgacaaaaaagtaaaccccaacttagattgcacctactttactaatgaggaatctgagggtagcatggggaaaggctcatcccagacaatccctggcagttctggagagagcccagttttcctgacttctagaccacagctttttttcctctgtaccatgtttcctcagtatctcccagataagaaggctatattttctaaggctaagtcataatatatactctcctttccacaatcattgaaatctccttcacagtggccctccctccctccactgaaagaaaagtaaaaatgccaaatgtggctggtagagaaggaaaagggagttggactaactggtggggacaaagaggcaggggtccaccctcacttctatatggctgggtatgcacagaaacggggcggggggcggggacatcaaggtggagagggtgaaacaataattccaaagagaccagtatctaaaccctgaatcatccttacagaagagcaaaagtgctgggcaaataaatactaggtccctggtctacaaatatctccctacaggtaaaactggtttaaaactaacattgactggaactaagtgagggactaagtaccttgacaatctaaatagaatcaggcaaggaaactgtgagagagtactaactctattctatcccagcttccacacctctactgatcacacttaggaagacctcaggtgttgcttcagcacctccagctatgctatcttcttttctctaatctcttaactcttccccgtccccactccccaactcctactcactatggccttactgtctctctactcagatactcaccagaattgctatgcttggcatctagcagatcctccacagatatttgttgaatgagtgaacccaatttgtgttacatattggttaaaatgaagcagtaactgcgattaaactggcaaaaaaaaaaaaacaaaaaaaaaacaaacaaaaaaaaccagccaaccaccaccacaataaaatatagtgattatcactgaaacactgcctcaaacaggaaaaacaatgaccatggcaatagactaattatccattaaaagggactagttttagaaaaacataaaatttattcagccatgagaaatcatatggtcaatctgaatgtgacaacaaattctatgatccagtagcaaaaaaacactaagatatattttgatttttataaaaagtaaagtagaataaaataacattaatcatataagatccttccctctccccttttaacataaaaaggtatacttcttggtatacttggtaagaagatacacatggtatacgggtaatttttctttcttttttttttttaagacaggctggagtacagtggttcaatcatggcttactgcagcccctaccttcccaggctcaggggggccctctcacctcagcctcctcagtagctggcactacaagctcaggctactatcctggttaatttttgtattttttgtaaagaagggatttcaccatgttatccaggctggtctcgaacttctgggctcaagcaatccgtctgcctcggcctcctgaagtgctgggattacaggtgtgagccaccgctcctggcctaaattttttttttaattgaccaattatcaagaatatcagctagattcttaaaaagtctttcataaaaaatatagaatggataaaatggtatcccaagttactttaagctctaaatacctagggtcttatgagtctattagcaaatttccctttcatttatatatggtaccttctgtaactcaatatatggtttttcctaaatataactgactgtgacaaaatgctctccagatgaccaataagattgaagttaatttatatttctgcattttgcatatccaggaaaataatatttaaagcttctgaaaatcatttcaaactttgtgactatacttgacatgggatggacagaaaaatatctgttacctgatatacattcactatcctcagtaacaacagagaaaaacacaaccatgtaaacacagagctctagaagtggaaggagcttgacagtttacttgctttaaaacaacttgcctgcaatgtggaatctctttcataatatccccaagagaagatggtcactcttcatcgggaaagtatggcagcatattttcctgatgaaaagcatgaattctaatttatgtgtgtgcatgtgtgtgtgtgtgtgtgtgtgtatatatatatatgaattcacttattcatcatgaacatctcctgcataacaagttctctggtaggccaatgaacgtgacactgtgcctccatccctcaggctcttcccagttttcctgtgttacattcaaatcacgttccttattataacaccactgcttctagttttactttctggcataacacaagcctttaaattcttgaaagctggctatcacatcttcccaaatacttcttttttcataacctcccgccctctaaaaacttccagttccctccgtgctccatgtacaaaattaatgaagcattgcatttagttcaaaaaatcagctgtggctgggcacggtggctcacgcctgtaatcccagcacttacggaggctgaggcaggcagatcatgaggtcaggagtttgaggccagcctggtcaacatagcaaaaccccatttttactaaaaatacaaaaattagccagctgtggtggcacacacctgcagtcccagctgtcaggaggctgaggcacaagaatcgcttgaacccaggaggcagaggttgtagcgagctgagatcatgccactgcactctccagcctaggcgaaagagcaagattctgtctcaaagaataaacaaacaaccaaccaattgcacaaacagatatatttttaggcagctatttgtgtgggaaaaggtcttcagtttgtgattgacaataggtttggtgtgagctaatagtctgaagtagctgctaactcaatcttaggttttccttcatgaagcacagggacagtttataaagtaacaggttcctttaatggtcacctatatctgaagtattattctgttagaaacgacaggttgggccaaagaggatggcaagatgcctgtaaatcatatcttacaggctgggcgcggtggctcatgcctgtaatcccagcactttgggaggccgaggcgggtggatcacgagatcaggagatcgagaccatcctggctaacacggtgaaaccccatctctactaaaaaatacaaaaaaattagccgggcgtggtggtgggcgcctgtagtcccagctactcgggagtctgaggcaggagaatggcatgaacctgggaggcagagcttgcagtgaaccgagatcgcgccactgtactccagcctgggcgacagagccagactccgtctcaaaaaaaaaaaagaatcatattttacaggtatgaaggacatggagccaaaatgtggtatgaagtcagaacagtcagccagtgaaggcaccagcgtacgaacaatcgtgaggaaaattaggcatccaaccttatgccagcattggagctgctctggtactggggcatttttagagggtctgaggtggaaagacaacaaggaagtctgcaggtgaaaaaggccagcaaggaggaaggggaactgggaggtgacagcccacctgataccgaggtttgctgaggagatggcaaaaccagggatttgtccagagaattttaccacagaagccctctggctatatactcagcggcaaaaagtaccaatgtctcaaatgtagggagaaagaaaagttgataatcatataataattttgtccttaaagtaaactttgtgttcttgagtaactcaaacaaagcattgcatatttcagggtacatctgcttaatcttcaaacacatgagataaaaataaacttggcagcaaagtttgttttttagcaggcagctttctcactccctcctttgggatgttaatctccttattttggggggaaatccttgcctcctccagatctggtttcatgacaccacttaagggcatctttcagaattaataatcactggcccaattgtccttgctctgctgaatatgtcacactactgctccacagacagcaacaggggccagctgagaacaggtttggtgataacttgcaccaccctccctaaatctgatggaaggagctgggagaaatgtaataataaaggttctaaagatggtctagcaaaatgtattctgtagctctgaggcactgaatatttagccattttgaatattatcactggatttacaataggcccttgtgttctctgtttgtgaatagggtcagttggcagctagttaagtttcttagggagttattgaagccagcattaaaataaaaccaagcacaggattccctaaaaactgcaaagcactgggaagtctgcctagaacaatatcaggtcatcttacaagtccaagagcagaatacttgagcagtatgtattagtaatagagggctcacctttcaacagtggctagaactggtcatgccttcatgcctgtgtccatggttttggtttactttctacggggcttcagaactctgggacctcagaggtgggtaaagatgtgaatcaggctagatagtggctaagaaaagtgacctagtcttactagctgtcactataatcagtggttaataattatttttagccaaaatatttcatcatctttgcatctgttagaaaagtcattataaatgtctatctttgaaaggtccaactgctatattactgtgcaaaagatctgtagttgagatacacaagattctggacagtaaacaatagtcctggtacccacaggaaaactgcagaagcatgaggtaagtaataaagcaagttcaaaccatgaccggtagcacacatttacagcaacctcagagagtgatttagaagcattaattacctccaggaaaggtattataacaatggaaaagacaaaatcctgcaatcaggttgacctgtgaaccataagctcagttgcctggtggaagtaagcattaattaccacagtgagtcctctccctgaggagaaggaacctgttccttctactaccgcataagtcacatttcacattaaagcagcacccacctgtaccttcccagcaggaccaaccacaaaagtaaactaaaagcatagtctaaaatgagatgaagagcaaactgcccaagttagcatagatatttgccctactaaatggttttctctggcctttcatgttcatgttattttgggaattttccccccacatttggaaaagaagtggaagctaagtaaactgtaaggaagaagatgaaacttccaactcccaaattcctcacaatttgacagataagggattattggatgaaatagagtgaaacaatctactatatggtgaaaacatgtgcaatcataaaaacaaagaaatgtagagtttcattatttgaggatttagagacaagaacaacttagagtagtgtgaatagtaagtccattgtttagctaataaataggagaccttcatttccccagactgtgctaacatgaagcaaatgttttagtgaaggaaaaggaaagaaatctatttttatatcccctgctacaatggattttgtctgttagagacaaagttaagttttgactatttacaaatgaactcacacatacatattaccccaactcagaagacatacaaatccttaggaatgtttcatgtgtggctgtgtgtgtgtgtgtgtgtgtgtgtgtgtgtgtgtgtgtgtgtgtgcgttcctcaattcacggagtgaaaacactgggtcacctactttcaaaactaacaaattaaagttaaaattgtatctctactccataccataaaccaagataaaaatctagatggattaaaaagtgacacatatgtgtgactattaaataaaattaaaatgcatatcttcataaatgaaaaagtaaaaaagaaaaaagccaaaaacccaaaaacaaaaaatccaacttgtaaatactttaaagacattcagaaaaaaattttaaaaaattagaacttttcccataaatttttacttttatggcaaaaaatcaaataaacaaagttaaaaagcaagtcaaaaatggaagagaattatcagaacacagatgaatagcttcctataaaaagcttttaccaataaatcagaaaatgaataccacaatttaaaaacacagccaaagaatacagacaattaaaaaaaatacaagtggccaacttacatataaggtagtgttcaacctctttaatagtaaaagcaaatttaaactaaaactcgatacctttagttactgacatattcaggactctactgttgaaacagttttgtaacattttttccctagaaaatcaaggggcgtatttgcatatggaaattaattagccttgaaaagtatacagtattttcttaaaatttaaaatctctatgtttattacttcattcccactcattcctaacttgcttgttttcccctttcctcagtgagacatttaactattgtactcatctttttaaatacatctgctatttacttatcaattctagggaattttgttgtataaaatttaatttttgcttttttctttactagtatcttctttttttttgtaaggggggacttgtcattctttctctgattacctcagtggaatgaatagttgcttgtttttttcttaccaaataataaaagcaaaggctagctttttatactcagagttttggaatcacatctaaaggctttgatatgttgaattctgacttttgtcagtgtttaaatccatataggcacgctcctttccatctttaattaatatctataatatgcaaggggtaaggtcaaaaagcaataagggggaaaggccattaacataacacaaaaatcttctagcctaaagtactatattgtctggctctttagtaaagcccaacctaaaaagcacatctcttaaccatagaaaacggcaaaagaatggatgctctggcagttaaacactctctcacaaactgaatcatttccaaataccaggtgttccagtttcactgtgttttgatattgtcagaaaggctagccacttttttttgctccatttaagcattcattgcctttatttttaacataattaactcgattataaatttatgtgatttaatctttaataatggccaagtttaacaactggttaacaaatttcctgaaaatttagcaatctgctcttatgagccgacagttttccttttccatttccagacctgagtgttctattccacccttttggaggttctagtcccacatgactcagtgttggtcttgttcctgtatctgtttctagtctagaaccttcacagtacttgagtcctctttgatgatcgaggcttgttttgctctaaattgcaggtcccctggaactgacatctcagcgcctcaataattcaggcgcttcttaggtagccttttgagcactccctcactggaacctcagcctgtagtgattttagactaatttctagaggtatgttgtttgtcatttccttgaactctgagtagacattaccatgccctttggatattttgttataccttcttacagaagctatttttatccattttaaagagtaattgaaaaaatgttctttattatacatcatcttacaaaggaagtttgcaggggatgataagcactagtgctactgtagtgctttcctacagaggcggcacttgtcaatgagcaaagaggccaacattgtgacatatgcctggagcttcagtttcacttctttctaatagcgaaaacaaatattgtaaaataggcgtaatttatccttaagctgtttggttaaagtgaaatgcaaatgttttaaaccaaaggattgctctactctgtaactgcaaatttaatttctactttgctctaagagtgacttaggagattgtattttaatatctagctgattagaattattttgaacaattttttattattaactttgagttttagtttattttggtcagaaaataatagcttgtgcacattatattttggagattttattaaaacttttcttgtgacctagtaaattcaatttttaaatttaatttctacttagagtacaaaattttatatctacctattaaacgaagcttattgtttgtattatttaaatattctatttccatatttatcctctacctaatttacatgtcaaattctggaaggcatgtccaagtcttctaatacaatttctattctgtaaattctaatttttattttaatgttttgctttatatgcacagtatctaaaatgtctagaggagggaatatttgttaaatttttatattttactcttttttacctacttaatctactttgacttaatctcagtcatattattctatcattattctttggagcaatatacactgagattttgtcctatatttcacggtaataactataacagtgaaaaaaacagccctgtgtttccagacttttaggatactctgtatttcagtgctaccttacttgggacataaagacttatgaccattataattttagttccaattgaatttttctttaataaaatataactctttgtcctgttgaatgcttttcctcttgaaatttcctctacctaacactaaatttgtatctttatctttacaaaattgtttactttaaacaattgttgtctttatcttttattttcaaactttgaactgctttatttcacatggttcctgcaaacagcatgattctcttgagttttttggagtgcccaatataagcgtcattgtcttttaattaagttgttaagttccttcacatttactgtggtaatatatttggtcttgggtctagcctacttccattttcttatcttttttcctcttagtttttttgttatgttttgttttaccaaatgaagttttcttcattcctttctagaaatcttcacttaattggaaattacatatcttatttctctctctgactagtgagtgccttaaagaaaatctaaatctatctgtctctacctgtatcaagaacaatgttataaccgttgcttcctcgtggggaaaagttaaaaattcaatgtgttttaagttaacttttcttttaccttacaaccctactctatctactttccaggtcttgttaaaacaaagattctacattcagattttttaaaacaatgtgcctcttccctttcaacaattatttttaaaaagacctaagcttgagaaactatataaacacttagttggcttaacctgttcacattaatagttttgttgttctctattctttcctctatgttgtttcacattataattcatttcttggttagctgcagtactattttaagcagttctttgttaaaaggaaaggtatatcaatggtaaagtttgtgagattttgcaatgttagagaatgtgtttatgcttttttttttttttttgctcatgcatccaatcattctacaaatacagtcatgcatcgcttaacaacaggaacacattctgagaaatgcaaccttaagcaatttaatcactctgtgaacacagagtatacttacacacaaatttagatggtacagcctactacacacctaggccaatatggtgtgtaatgctcctagactacaaacctatacgccgtgttactgtaccgagtactatacacaattttaagacaatggtaagtatttctgtatctaaacacagaaaagtttcagtaaaaatagggtatgataatcttatgggaccaccatcatatacgtaatccttcactgaatgaaacactgttatgcaatgcatgactgtatttactgagcaagtatcatatgctaaatgtttttctagatacaagaggtacagtagggaacagcagataaaaatccctacccatatggagcttacattctaagagtctagaagattagacaattcatgaatcacatgttttttcctctcaaattctgcagccaagaagagatgcttgatgttgacttcattttcttttctttaactattattttttaaactgggcatcctgcttcaaaccatctggatgttctagaatattttctttagtcttcaaattcatatttttctctggattatttcaaggtctaggttaagggtcttctttctcccaatgtctcccctgtactccaactatgcctgttagtaagggtgttctttcaatgagagcccaagtccttaaaaattctctcttattattcttcccagtataaacacacacacacacatatacattagtatatacatttatttatattgaattatctgtatctatttttcatgtttccagtcttttcacttaaaattttcactgggctgagcacagtggctcacgcctgtaatcccagcactttggtaggctgaggtgggcagatcacctgtggtcaggagtttgagaccagcctggccaacatggtgaaaccccgtctctactaaaaatacaaacattaggcggagggggatggtgcgtgcctgtagtcccagctacttgggaggctgaggtaggagaaccacttgaacccgggaggcggaggttgcagtgagccaagatcacgcactccagcctgggcaacagagtgagactctgtcttaaaaaaaaaaaaaaaaaaattcatgttactttcctttgagttctatcagaatttctttagctttcttctcactcgctaattcaggtttcttcagtattgaatctgttcctcactgcgttgttttaaaattctgtaaccatgtttttaatttccactaactttttctgttctcagttcatttgtttttcttatctgctctgattttaatcaatgcaatgccctcttaattttactttgagtaataactcatttttctcagttttctcctattttgtacaagaagtctgtttcagacagaaatatcacttttgtcggtcaaattggtctttacttttgaatgctacatctttctatatatccatggattcttctatgttcattccaagagagggaagtatccatgtttgttttgtgagtcataaagagttgtgccagatagtgtgtaagtgttcaaatcggtggtctccataaaaaaaggaggatagattttagttttattataaatttatttgccatgttagtgatccaataatttgtataaaatagtaagtggctggcaagtagaatcacaataagggattttacttttgttccaaatatatattccaggtcttgagtaaactaagtgataatactgattaataggagcatctattatacatgtgttatgtatgtgtattatccatagatatataatacatgtatatctggatttattatatgtgtatatatacagatacatacgtatgtatgcaaattaactttaatatctacaaaacacttaaaaatggatattagatcacaagtacagcctcaacaatgccaccaaaatatatatactgtgcaggtattattttattctccaactttccttgatttttgtttttccatcttattggtatccctactgtaataaaaaaaaaaggggggggagtttattttgtcaagtaattgcttaaaattcctttccatctcctcagatatttaaagaaaactcacagttttctttgtcccatcttttctccttggctacttccctacttttccctacaaatactatgcattattcacattgcagtaagttacacccattcactgtaaaaaagaacaatacaacacaccctgaaatctttggggctactaatttctaaaaaggttacttcaagcgtaaagttttcttttataaaaaagaaagtttaaagtttcatcactcaaatgtagcctatctaaaacacctggaaatgatttcaaagtttcaaagtcactattctgataggtattacttccaacctaaccattactggcctttgaaatatagaagctaaaagcagactgcacggatcaaatactatagataaaagcattttgaaaagcatacggtactatgaaaacataaggtggtagtattaaaaatggatttcgacatgaaatcccaaactcattcatttcagtgattccttagtgcttggatgagggcaagcactcatccagtgagtgctttcatccagatccagttcagcatcttactgggatcatttcaggccagtcagctttaatcaaattacactctatccatacatgattagaaacaaactgaggttttggtcaagtgccacagtttttcactcagggccatcatgctcactttcttggaagacacttggaaattatgtgatcaaatctgaaagtaacttttcaagaggtgtgtgtggtctttctgacaaagaagagctttatatttgcgactgagttaaaatctctggctgtaactaattagcgataaaataacaacaatgaacatggaatacaagctagaagaaatcttagactctaaaacacatgttaacagagtgaaatttataatatctgctattatatctcgtctatcaaatatagccaagaatatggaagaaaaaaattgttaaagataacacctagtaggaatttttaaaaaacatctgctgagacaaagaaggctgggcatattgtatgtaaaagtaaaattacaggccaggcacggtggctcatgcctgtaatcccagcactttggaggccgaggtgggcagatcatttgaggtcaggagttcaagacaagcctggccaacatggcaaaacctcatctctactaaaaatacaaaaattagccagatgtggtgatgggtgcttgtaatcccagctactcgggaggctgaggcaagagaattgcttgaacccgggaggcagaggttgcagtgagccgagatcgccccacttgcactccagcctgggtgacaagagtgaaattccgtctcaaaaaaaaaaaaaaaagagtaaaaatacagtaagtaaaatgaggtgttttgaaaacgtatggaacctaccgaaataattaaaatataagcagagggagcagatttagcagtgacaaaaattagaattattcatggataaccaattcttagtaatcatgcagtcatagctcactgctttatgcttaaccaagagctttaataaacattacattatttgggtttcacaacaccatgaggtggaaagcccttgtgaacttataaagagaatagcaacagtaatgaatttgaaatacaacaaaagagaatctgagaaattgcccagggacagagattatacacactcatagcacagtggctcttgacaccacgtaagcaagagctcaatacatatctgttgaactgcaccaaactgataatacattcaataccacttttattaaaaaaagaaagaaagaaagaaagaaagaggtaggaaaaaaagtacaaaagcacctgtgagaggggagcactacaggaaaaactatggaaggctataaggtgatttgtgatcaacggttatgtcagagaagtggtggcaaagatgaggagactgttattttgacacttctttattgtctggattttcacaataagcatatataacttttgaaattcaaatgagtgaaaccaaaataaaaatgtgccagctaaatttgttaacaaagaataggtattgcttttaaaacaaaaaaattcaaattttgtattttttaaaaatgaaagctaaaacaccctaggattttgctatagtttgtgactactggatcctgaaaatggaacagttaacttaatgatcaaatatacttgacagagatcttggtggagaaagaaatttagattccattaatacatattgagcaccaccatcagatattagacactgtattaagcagctatgcagtaacttaggacttagaaagtacctcaactcaattcatgcacatccttccttatctataaccaattatatccccttccagctttatagataagcaacccctatactttgaacacaaagtcaaagataactattttctagttatcaaaggcttctattcatgagagtccatggcattattacatttaagaacagttaacttgtctttattttgcctaagcttggaggcacttagctagagtaaaatttggcaaaacaaaaagatgactcattttgtcaggcactgtaaactgcctatcagaggacaaggtgtattttgcaacttaaattctgaaaaaggtcattcttccctcctctggctcgtaagtgattgactgttagggactacacctagctttctattatatgtctcctttaaattaagaggacaaatctattatttggaaatacacatggctcaatcaattgaatgtgcttacaaaaatcttcaacctctttcaagaactctttacatgccgtgcaaactattgttgcatttgggctctcccacccaactcgccgccttcactctcctcattctggaaaacagtgctgtcgctaacacggtgagcagccacagtggctgaaccaggctactctctgtctgtctttgcttggcactggaaaattcctttgtctttatacttagcagtagtgtaatcttagagaaagaactttaattgaagaagactttactgaagactcacttgggagtccctaggtgagtttaaaacagatcattgaaatcttttccacagctgggtttggtcagtagtgccattgggcggactggatcttcagcccaagcacaatcccagttcctttatcgggaggtatctataccattctagactagaccaaatttcgctcttcattttgataaaaccaaactgcttcctaagattcattccataaatatttcttgagtattttgtgcaaagcagattactaaatactgccagagacacaaaaatgaatccggcgccattctcaaagaacttgtaatgtctaagtcttaaattgctaggacacaaaggagaacatttcagtactgacttacatttaaagaatgatctgaaaaacacaaaaagcagctactaatagaaataaaataggatataccttccaaaacatgagaatttaaaaatgcagaaaagtatagtcaaaaatgcacttacagaattattaaaatcaaagcataaaataatcaaggacagaatatatcagtgataataagggtgaccacatagaacttatcatccgagctacgattttaaacggtgaaaggcgacactattaataacttctccaagatgacaggcataaacaggatgtcctcagcaacccacgttgtaaggcctccctagttatgaaaataaatagcttgctttactcaaaaagatagatgaagttagtgggttcaaatgctcagcttctctacttttccacaaaatctagtagtcaatgttttcggaatcttgtaatcaatgaggcaaagaaaacaaaataggatacacagaaagattctatgatgaatacaaagaacaaaactatggatctgctatattttaaaataaacttaaacttggtaatgacttgtgaccttgggaaataatgtatttttatatcacgtagcgttcaatatcaatacattcaaattattgttataattttactaataaactgtcactttctacctgtttgggcttttcttaaagacaattttatattttagcataggtttaatgaacttggtttcggttataaacttgtctaacctcataaggggaaatttttcaaatgtattatccaaaaaactctggatgtatctgaattatgtagaaatcagactttaatgagccaaactcaaatccagaaaacactcaaagttactctgaggagtgaagatatttagaaagacctaagtaagactaatgttctgttacccacaaactcttagagctgtgttttcaggctgtaaaccgtgctagtgtatctcatgtctgggcagattaatatatctactaatgaaaaacacacacccaacctcgttgcctactctaaactgatgtaggcccttgggagaaattaattcttggggaacacagtgaacatgagaatcaacgaagatgtacacaagctggtggccacatcctagaaactcaagtttcctaataagctggacctccagtctctctttgtgatttgctgtccctcaagtttcccatatgtaacctagaagctaaacgccaacaaactaatgagtaactgtaagaatatctcctagaacttccacagactccattttcctcctgctcaaacttctattccatttctgtgctcagaagcagcacctgggaggggagcacacagtcattcatttattcattcccacccacacttgaacatgcatcctagtaaagtgcacccaggctcaacatcagagatatgcctaaagaatgaggacccttgccccaggagctccgagacactaactgaaaacacaaacaatgtaaaggaatcaatgttctaagggagatctattaaaagaagtacaggaactcaaagaaaggaaagagccagatgtatctgtctgacgcagttggggaaggcttccaagaggcggtgacatttagctggcaatgaagggagaaagaacacttgaggagaagagacagcgtgtaccgagacacagaggcatgaaaatcgtggtatattcaggagtgctgagaactgaagcatagggaggtcagaagaagcagacagtgaagggtctctttccaaactgagcagaactgacgaatcctcactgtcagcttctctcttccttttgaggagcccagctatttctctgcctgtcctttccagtggttttgccccttacaaagggaaagacccgggttctagatcaactctcaaactatcagctgcccaagcttggaggagacccagcctctctgtgagtctcagattatttataggagaaagggcctacagaacctatgaaactcaagggttctatatgcagagtatcaaaaatcattagagcatattttcatttttaataatcatagtaagtgagaagaatcagtaacagtgtttcaaataatctcagctatacaactacacagaaaataaaattatagctaataagcaatggctgggatagtgtaatttgctgagcaagtcaaaatcctttcagttttttaatatgcaaaatgaagagaaatttaccactaaagtttgtttcaaggcttaagtaagaaaacaaacaaaactgactcagtgaacacctggcatgcagttggtactaaataaacgttggttaaatctaatttgatatatctttcaagtgcattaataattgtggcttcggccgggagcggtggctctcgcctgtaatcccagcactttgggaggccaaggcgggcggatcacgaggtcaggagttcgagaccagcctggccaacatagtgaaaccctgtctctactaaaaatacaaaaattagccgggcatggtggtgggtgcctataatcccagctactcagaaggctgaggcaggagaatcgtttcaacccaggagtcagagattgcagtgagccgagattgcaccattgcactccagcttgggcgacagagcaaaactccaacttaaaaaaaaaaaaaaaaaattgtggcatcattgttagtatcagttaacaaaatatatgcaaatatagtgaaactgattatgtaaactgtttagaaagtgaaaatttactattgtcattttagaaaattgaaggcttgtggttttgaagaaaaacaactattatacaataaatctactaattgctcattttgtttagagctaaaaaaaatgttcctctttcctttccacccctattcccaggggacagaaaatttacctttgatttccaagcatatctgatttcttccagtcattatagagtcaaataataaaacaaattcagatacaacagtgaaggaataacaacttttacttcaattctacacttgaatcaatagactcaaatccttagaaatatgatcatcaatgcaattatgtgctgaactgctaaattaacagtcatctgggaaacataaaacaaaactagtgacaatgtgcttctaattgcatgggggttcaggatattagtgatattttatattctgcttcattgctcactaaacagcatatattttcataataatgcttttttccaactagaaacaaccaaaggtgtcataactcaatttccaagatgaagagaaaacaaaaatagagaaaatatatacagttgaaacaatgcctttagtagttggaagaggggtaggaggggcaagagaatgaaaaaaagggccaaaataaatttaaatgcctgctttgaagtcattcttcaggttgaaacagcaggctaaatcaatttcaactcctctatattaatgattcagtcatctctaagcctccagtaataaaaagtgcctgcctgcctgcctacctgctgcctgccctgcctgccaacctgcctgcctgccatgtgtaagactctgggctaggcagggggatatagtctataacctacaatgagaagtcctgggttgtgttaacgaaactgtagcacagtaaagcacaaaatctactgagcattcatatgccgttaaccctaaggccctttataaacagttacaggctacacgttttacacatgggcactggtgtggacagagcacaggctcatgcatgcgctgacattgaaattgcactctgtttctctgtgatttgatgaaaatctgtgggaaaggctgcccccttgtgttcatctcagtgcagttgtgaccctgctagagctggaacattgcagatgccttttaccatcatcccatgatggcttcagagaggggacttcggcctgctcagtctctacccaaaatcaaggccagtgtaaacgagaaagtgccaatgcttctgagctcgttcaagtccaagaaagccattctggacctctcccgaggcacagccaagtgagctagtcctcatggatccaatcaggataactattttgttttgtttaaaaaacaaaaaactcctgcttatgagaagagatctttggaaggatggaattcctctatgtcaaatggcctctggacctctggctgtctgaatgtcacttaaagcaacccacagatagagaagagggcacagagggtactgaaaacagcaacgtaactaagaaatacaggaaaacccaagacatggacagtggaaaaggtgaggaagggtcctggaaaaccaaccaggagagaaaggaaggccatagagattcatctacctcaacttccttctatgcagatgcagtttcaggtctggaaattcccacaaagtggccaacttgccagaggtcccactggtaaaatccagtgctgtttctccaaccagaggatgccttatttactagtttgcgatcaaaactgtgaagcacctacaaataatttggaagactaagcacccagtatgagaaacctaacctagtgatcaatatagaaccaaacatatagtaagcacaaaataaatgtgagtaaatgattaggatataaaattaagccaataaagatttcacttttcagaggaaaaaatagttcactgcattaaaaaaaaacaaaacctgctttttttctttttaaaaatctttggatcctgagaaaggaaggcttatgaaagacaccttatattccttcctccctctctcacatccttccacctccaaatcccaagtccaaaaacagataaaattagggagaggctatgtcaatgcaggaaaaggtcttatccaaaagccaaaaactttgaaaaatggaactagattaaaggccacccaggtatattagaattaacttatgacactaagatagcagttggttgctccagaagttgagaaagagagagagagaaagagagagagatcctgggcttcacaaatatccgagagtaagaaggccaagggcataagtctttgtctcagggaagaccctcaggcaaaagtagttctggctgctgccttctggctcaattggagacagctaggactgcggcccgcaaaataagaccttgtatgaaaatggaaaaggctactccctcaaaagaaactagtgctgggataattttaactgtttcaaatcatttatttggtaataataaagaaaccagaacaacataatgctgggtttaagctgcagtcccagctttagctccctagtgaacttatttaaattcacacacatgaatttatttcttactatgtatgcatgtattatgcatagatagaagtctggaagaatacaccgataacacctgtaggaatcagccctaggaaggcaacttgcttagctttttctatataattacctttacagtaaaagagtggtcataatttacttctgtaaataagatgtcttaacatagacatttaatgtatcgcaggagataaaatcatttcaagtttatatagaataaatgtttaaaaatagcccccaattattaaagctaaaagtgacagaaccagattcaaaaatgaattattgataccctcaaaatcaaacaatacaggcttgcaaatacagcagaatagaaaacagcatccagaaacaaactacagttgtatgggaaacgtggtagtgaaacagcggggaaggaagcaggggcaggggcaagtttatttgatatactgtgctggcacaacacctatgcatcgggaaaaaaacaaacctgaatacccaagcttatgcattacctgggtcatgccctagaaaggcttagccaggcacatgagagttatagaacgtaaaacattcaaagaaaaacacaaggaagagtacaaatgccaaaataaatggtagaaaataagagaatttttttaaaaaagagggaaagcagtagtggagcttaagtctatacagcacacctatgagaatactatacaaaataacaactttaggcagaggcaattgagtcttgccttcccttggcagcaaccttagctcaggagactggaaaccggctccaagcagcttctggggggtaatcttggctttacaaaagcctgggacaatgttctcccctcctgttgactggaccatggcacagagaaaagaacagaaagatactcagaatatttctgcttctcttaacatcaaatggcctcacctttttcagtccaggacatacctgggagcctcccagaacacagtgagggcaggaagaaccagttagtttcagtgtactatctgagctaaacaaaaaatccccagtgataacatcatcttggctctgggagttgaataatccgaacacattaaaacatcactactctgatattctttaataagaaatgttcagaccaagaaagtattttgctttcacctaaaattccagtagatttatactgaaaagccaatgtattcacttctaaagaaatatttctatactttctatctcccttatgtacttgagaattttttttttaagacagtgttccactctgtcacccaggccagggtgcagtggcacgatcacagctcactgtagctccaacctcttgggctcaagcaatcttccacctgggtagctgagactacatgcaagtgccaccatgcctgtttttttatttttctattgtttgtagaaacggggtcccactatgttgccaaggctgcctgagaatattttaaactttgaagaaaataaatgatgaacactaaatagcttctggctgctcatgtattccctcgcctaagcgtattaagtgattaattgattcatgcattcaaccaatatacattgaacactcaagagatcttcaccaggaataattaagtgtgaagatttgggaggcccagtccttagggaatttgcagttagtcctctctaaatcagcaggtctgggtgttaggaaggtaaaagctctgtgctcatctacaaaggagagggggactttcttccctaagcaaagataactaactctcctcactctatgtataaaaccagaaaaaggccaagtgttttttaaaagaccataatatattgtgttccagggaagaatctacgtgcttgcaacccctactgctcttaacataattctggaggttcagttgaggattttccttgtaaacgatatcttaaaagaataaatatatccttttattttaataaaacaaattatactgcaattgtgtgggctgctttgtatttgtgaaccattattttgtcagaatatcattttagaagaacatatgcccatttttatagttaataacttcttgcaaaaaaaaaaaaaaaaaaaaagaactcaaactttcactctgaatctaccccacacagctaatggctttgttgaacaggcatatggcttgtcagagaagaatctgggacaatatggttactactgtttccttctccactttgtctgtaagcttgtattaatacatatgcctcccagtagaaaactctctccctcctcctactttaagccacaggttctgcatcagccactcctccttctccaaaatgtctacttgcggagtcacactccaacccgaatctggagtggggctccaacatcaatgttgacaattcaggagttttaaggattcactccttttgccttggttctcagaaaaactaattccctctatcacctctgctatttcaaacttcctcttaaaagctatcaaaaagttttgaatctttgcaacactgaataagaatggagagggaaagtcagagtttcagcaacagacagtgaatctgatttcttttctacatatattgctggacgacgtctttcagatcaacttcactagaacaaaagagtacttttcccccagaaaagtactcttttcctattttttttagtagcctacttaaattctttggattaaaaaaaattgcatttaaataaatgacattttttaaaaggggaaagcattctttaatcttcataattaagtgcttcacttatcattttctttctttatgtgtgactttggaggtctatttgttaattataatatttcccaaggaaatcagtgataacaattatgttgcttaattgacattttgctttttgatatttttttgaaatgaaataatgtgcatcatcccacaggatcttcggagctgccttccatgatcctcagctcacaaataagaaaccaaggatcggtgaggcagaagagaggatcagagaggttgaagagaagatcagagaggcctgttgcccagggctacaaggcttaaaagttagctgaactagaattttaacccaaaatattctatttccaaattaaacactttttacctctctactcaattatatgggataaattctacaagacaccaccagcaaactcaaggaaagatattaatagtgttccctaatttttttttttttttgagacggagtcttgctctgtcgtccaggctgaagtacaatggtgcgatctcagttcactgtaacctccgcctcccggtttcaagtgattctcccgcctcagcctcccgagtagctggggttacaggcatgttccaccacacctggctaatttttgcatttttagtagaaatgaggtttcaccatgttggccaggctggtctcttaactcctgaccttgtgatccacccacctcagtctcccataatgctgggattacaggcgtgacccaccacgcccagactgttccctaactttttgaagaaaaaactcgttaatatttaagatataaaaacaggtaaaagaaaactaaaacagacaatataggtccactactcatcttaagaaacagaccttaactaatacttgtgtatttctcctcagtcatgtcctctctcaagacaaccattaacttgtacttactgtttatttctctgtgcatttatttattttttattgcatatatatctgttcttaaacaatatatggcatgtacatgttttgttttttgggtttttttgagacggagtctcgctctgtcgcccaagctggagtgcagtggcgtgtggcgcaatcttggctcactgcaacctctgccttccgggttcaagcaattctctgcctcagcctccggagtaggtgggattataggtgcccaccaccacgcccggcaaatttttgtatttttagtagagacagggtttcatcatgttggccaggctggtcttgaactcccaacctcgtgatccactcactcccccttggcctcccaaagtgttgggattacaggcgtgagccaccgcgcctggccacatgtttttaacctttatataagtggtctgcaacttgcttgtttttaaaattaattctatttgtgagactgactgaagttgatacatataatgtacttcattcatcttcacgaatgtataatattccattgtgcaccataatctacttatctattcttctgccaatggatatttagggtgtgtccctttttctgctttcataaacagtgctactataaatatccttgtacttgtctctttaagagtgtacttaaagctcctctaagatacacacctagaagtgggattgctacatcctgttgtcaagtattttttcaagtggttgtatcaatttacaacaacagtttacaaatgtttgaactgctccatatctgtaacacagaacactgtcagattttaacatttttgtcattttaatggttatgaaaggacatttcaccgagattttaaaatgcatttccttgattacttcacatctaatgtctgccacatgtcatgtttcaggtcatactagaaacatgtttctctatccagtatcacctttctcctaatcatatactttacattttctggaaagaccgaaagacctgccaagtctttataataactgccactactcaaaattcatacttactgttataactgaaaatcacctttcccccaagctatcttcatagtctttaaaaaatacctttccttttggaaatcaaaaaaaaaaaatctacttaaccaatttacccctgtcttacaacttgcactccaatcagactatatcaatttatgggcgtaagagagtatatttccaccttcttcaaagcccttttgacaatcacttgcttttctgttggaaaaaatcaaatctgaacttatcaaccaaaagactattgtgtgaaccatcaaggatatcttcctaacctgcatgaaaccatataaatgtcaaattatttctccattctgtcatgtgccaaaaatactaagaatagaggtcaaatgtctcactatctgttccttgagcatgacctttgcttggctcattaccgcccacctactctttcctccttcctatatctgacatttgacctgctagtgtcttattagtttagctaaattccaggctctggcctctctggcctgcccagtgttggcatgacaactatgctgataaatactcaactcacgaagtatgtttccagcatatctttggaagagaatatgatctgcagtctattcattattatgtgcaagttctaaatacaattgttcactttttcaactactgtacctgaaataggattagtagggccaaaaccacagatggaaatgaagaaaactgcaacaagcctatcagctgagtttgcaggaggtggctctatggcaggggagactgtcccctctttcccaacaggaagcaagaggacctaatgcttgagagaagatggtctcacgagcatttcctccaagcttgtaactagggaagccccaaatcatgaatagcctatagtccctctggcactttactcaagacagtcttatatttcaatgtctatgcaatgctcactggactacccatctccacttcttcccagaacctcattaccgtccaatttagtcaaggtataatctaatgatttgctagcaaatgctcgttgtggcttttccatgcatctaccagttttcagaatcttattctgtccaaaaccttccttcttaacagatggctatgttttctacattgttgagttggaagagactataaaccttgtattattgaccatttaagtttttcattgcatcttttatctttcctcttttcctacctattttccactgatacaacaagtataatcaaactccagtaaatacacacacacacacacacacaaacacactcctttgactcaactattccttcaaactgttaacccattttgctcctttctttaactgacaaatttcaacaaaaactgttccaattatctctcatttcatcttccctaattatctggcctctacattgttaaatgtcatttaagagtaaaagaggaatatactctttgaagatggaggggaagagaattcccatcaaataatcctttgttcttatacaatatctatggcagcaatgggcttattagtagataaacagttattagattatgaagctgtattaatctatgtgttcaaaagaacttatatagtcattgccagttacttcagacagtgaaaatgagaattaacagacacatcttaagttgtaaaataagcattttatcaacctgtatgctaacaatctgatctgggtgatagacaaggggactcccaccttcccataacctgctcagcagcttcaagagctaaagaaatcagtggcttgtcacatctgtaaaaggcaactgtaatccactagtcgcaaagcattgaattagagtacacataaaaatatgataaagagaatatagcatatcaaataaaagaaattcattccaaattatactaagattcagaccataaatgatttcctttgagaaaaaaacaaaccaaatctcaattagaaaattaaaatataaagtcatctatgataagcaggaaccaagacttaaagatgatacataatatattagaagaattgtagtatataaagaatgggttatttaagggcagaaggaaagatacaatgtaacaagtcatcaataagacatcaagagaaaaggaaaaaaactcaagtaatatggaaacatattaaataactacagatacagaagtaaatatcccatcttaataaatattattatgggatcaaggaaagttacttaatctttgtgtcaattttcccatctgtgaaatgtatgtatctcatttggcagggaataaagaagataatcacttccgaatatttagtataatttctagcacatagtaagctctaactgatgttaattattgtcatgaatataatcagtattaacactggtctccattacaaataaactggatagtcaatctgattacctatgagcataaagtaccaaaactgacataagaaacagtaaaaagaacctgaaagggacaataacaattaacaactaaccaaatatagctgacttcatgggtgctaatatccaaaattttagggaccagaaaattgctatgccatttaaacagactagagaacaataaaaaccatcccctaatttgtgatttgtttcatgcacctaatataatgctgatatcaaaactccacaaatacaaatatacacaaaaaactacagaccaaacttacaaatataaacgttttactaaactactgacaaactgagttcactgctcaataatatacttgaaatacactcacctaatactgtattccagaaataaaaactggcttaatattaggaaatgtgttaatatgattcatggcataagaggatccaaaataaaaccctcgtatgtgtcacctgaaagatgtagaaaagaccatttgataaatctcattatctacccacattttaaaaattaacctagtaaacagaaaaaggaggatacttccttttcattataaaaaactaaccctaatctcaaggtaacatatatatatatttatgtgtgtgtatatatatatatatatatatacacacacacatataacatatatagataacatgtatatataaattcctctaacttaacaaatgaaacaaagattcttattgcaccactatttaacactgttctgaaagttgcagcaaatgcatttaaacgaaggcagggaaagctatattcaaagaagggattgtctccaagagaaaaatatacaggttaaaaaacagtataggaagtatgatttttaaattaaaaaatgctactgaactgtgtactttttaaaatagttcagatggtaaattttatgttgtgttttcttaccacaattttaaaaaatatgcatatatatggacagaaaaagactgatggttacccctatagtaagcaataactcttatttagcttatctgcattttcaaagttgagaataattgattgattgattttttttttttttttgagaaggagtttcgctcttgtcacccaggctggagtgcaatggtgcgggctcggctcactgcaacctctgcctcccccgggttcaagggattctcctgcctcagcctcctgaggagctgggattacaggcacccgccacacacccagctaattttctatttccagtagagatggggtttcaccatgttggccaggctggttttgaactcctgacctcaggtgatctgcctgcctcggcctcccaaagtgctgggattacaggcgtgagccatggcacacagccttatctgcattttcaaacggaccagtatgatggtttacactatactgaaagtcatcttttaaaaagaactttaaaacattaactatatataaaactatattaaaataaaaagacaaatttcataataaagaaatcgaacaagaaaacacaaatatacagaactgaaaatgagaaagataaagtttaccagatggaaagaatcaagtattttatgcaccaagcccagttagttttgcaagtgaactatttcaaaacttttgaagaaaaggtaattcttacgtcatatacacatttctcaagagcagcactatacaatacggcaaccgctagccatacatagttattaagcacttgaaatatggctagtgcaactgatgggtaaacttttaatgttatttgaattcaatctatttaaatttaagtaagtgaatgtacctagtggctaccaaatggagagtgcagctgtagagggtaaaaaaacgaaagcttcccattttagtattatgataccaagaaactaatggccattttaacttataatgcaagaaaagtctggataaaatgctagtatgttgaacctaataggggttgaaaagaatatgcaatgatcgagtgctgttttttttaacgcaggaattcaaggacgccttaataatcaggaaattaaatataattcatgacatcaattacagcaaggagaaaaactctataactttgtcttcagatgctaagaatgcatcaataaaattcaatatccattcccgattattaaaaaaaaaatactttcccggcacaataaataagagacaccatgaatcgacaggcatcagcaaacctgaaactaaaacaccagaagtattcccattaaagtctggaaggaactagacaaaatagcaactgtaattattattatgtaccatattcttataagcaatatgaaaataaaaagaaatatgacacataactactaggaaaaaagagaataaaatcattactatctgtaaaagaaaagccattaaaatcagttgaaactcttaaaactaagaaatgactattaggttttcactcattaaaatagattatcttcaaatggaaatgctgataataaagtacatttaaaagaaattcactagtaagtgaatttaaaacattataaaagtatcacaaagtcttaagaaccaaattctactgagctttcccttgaaataaattaaatcaaatttgctagtaaaacccttcaaaggtttctgacgcctaggttaccccacatgactaaggattcacacacagacacagacacacacacacacacacacacacacacacacacacagattatcaacactgacttcctattgacccagcaaccaaccatggcagacctaaaaccagttcagaaaaaggctaattaatatttattttcctcatgctgtgaaaagaagaatatcatgtttcctctcagaatatgtccttgaacttttaaagatttaaccatatggaagagatctaaaggagtatatgaaaaggctaaagatttggaatcctaattcaatttcccctcacattttaataggagcctgcagcaaatatttatttttagagatattctcagtagggaaaagaacaaaacgctattgtgtgctaaacatggtgaggtctctctggtcccatctataccaactttataaacatcaggttagaattaaataactttaaactttaaatcaactatttccagaccacaaaatctattctacacttatcggcacacataagttctctaagtgacttatagctgagttcaaatgtgaaatctggatttttcaagtgccaataaaagaactttccttcggactttgactgaataatgctgaattgtccaagaatgccatgtaatgttttcatttccttttccaacaaaaattttcatctgcacttgataaatttactgactccgtatcatttatgatgaaaagcatatgggtaccgatcatattggtctccactattttcttattaaataggaattacaactttttctcaaagtttaacaaaagtaaaaaaagatgaagtttacaggtgtgccctgatcactatgaacatctctttatatgtgtcctgtcatgagtctgttaaaatgcaaaaggaaacaagaaattatctacgattagcaatgtggtcattttaaaacatagccacaaatactttgacatgcctcccatcaaaaggcagagtcagttccctccctttgaacatgggccagctgcagtgactcacttctaataaacagaatgtggcagaagtggggctgaaggctttgaaggctaggtcataaaaggtgatataccttcctcctggctctccctgttgggttgcttacccataaaactttgccaccatgctgtaaggaagccaagcagccatatggaaaggccttagttctactcccaaacaaggttccagacaacaactggcatcagccccgagacatgtgcttgaaatagcctccatatgactttagcccccaggctttgggccatctcaatagacaccacgtggggccaggtgcagtggctcatgcctgtaatcccagcactttgaggggcagaagcaggcaaatcacctgaggtcaggagttcaagagcagcctggccaacatggtgaaaccccatctctactaaaaatacaaaaattagcctggcgtgatggtggttgcttgtaatcgcagctactcgtgaggctgaacctggagaatcgtttgaacccaggagacagaggtttcagtgagctaagattgcaccattgcactccagcctgggcgacaagagggaaactccattacaaaaaaaaaaaaaaaaatagacaccacgtggaagagacaagctattcccaccaaaccatgcaagaatggcagatgcttgaaaaaataagaaccatctttattttaagccactaggctttgagtgttaattattatgcaacaacaggtaactggaacacatagattatttcagcccaatgcagccatcttattctttccatttcaaaactacctgagaagacaaatctgtttcaaagaaaaaaaaaaaaatgttgacattcctggtctcagtcaactcaccctagaaagccaaaagctggaatcccagcatttattacctgtggctgccagctagccttctcttgggcagttttcttctcactccttaatataccagactctcggctgggcgcggtagctcatgtctgtaatcccagcacgttgggaggccgaggcaggcagatcatgaggtcaggagttcaagaccagcctggccaacctggtgaaaccccatctctactaaaaatacaaaaaattaggtgggcatggtggcacatgcctgtagtctcagctactcaggaggcttaggcagaagaatcgcttgaacctgggaggcggaggttacagtgagccgagattgtgccaatgtactccagccagggtgacagagtgagactctgtctcaaagaaaaaaaaaaaaatctatatacacacacacacacacacacacacacacacactagacacatactagacacacacacacacacacacacactagactctctggcctcttctgtcctgtcttaaacttactcctagctttgaaaagttgcttttattaaacaccctggcttatgagactgctgctactgctaacatacgctacacatttttaatcaaggaacaagtaaaatttgcctaaaaaagtaattctatgactttgaggcaggtaaccagttcaagatgttttaatgaagccattaaaatgggttatcaatcaacccaaataatcatatcaaaacatttactcttcctcctaataaacactagggagggaaatatcctaattactcaaataaggtttttcttaaagaaacacagcctaaatgttaaaagctagaagcaatcgtgaagataatctagtttagaactttttttaagccactgggaaactgacaaaatccagggaagatcttcatgacttaagtaaaaaatgtctacctcactccatctccacctaggatgtcaacctgccatcatataatgacaatttgaaacttcaattctgtttgtattttaccaaaaaaattacaaatacaattttgttagtattttatagctacagcaataaaatgtactccatgcaatgttatttaatgttttatctttaaagtttaggattatgacaaatcccagttaggataaacaaaagtatccctgggaatccatagtcttcttataaaaaattaaaagtggctgttctatttctatcataagaagtattagtaatcattgccctagtccaaatcatttgggaaaacaagcccagcaaggttacataactggcctgaggccataaaactagttagtggcaatactatggccagaattttggtatactcatgcttcctagtcatgcaggggactcaaccagatttcaattaataaaagaaaaacaattactatatgtttcaattcaaaaagccccatcaaagtggctggctgcatttcagttccttcaatgttacactcaaaatccttctggtagactatctttctctttaatgtaaagaaaacagaaccttaatggaggcacctcaggcatcaccaggtgaatggaaggcgaatgcagccaagagtgtggactggctattcaaaagccattcacaaccccaatatcttttgccttaactacagaggctggaagagtaaaacactcaatcccagggctccctggcagctagagaggatatatgacaaaattacaaaaatgagcatatatacagaagtcactagagaggcatttctttccaaataaaaacattaatcctgttagaaggtcttgacccttgtgctctcttcctgcgaggaatgtgggtatgattctcagagatataaggccatcttgcttctacggggacaaaagccacatgctgagccactggctccctgatgacacagaagagtcatgacaccagccctggactgtccacccttgggctttctactgagtgaagtttaagactatgcagttggttttctggttacttgcagctaaatacaatcttaactcttataggaaataaatctggcttttcctcttcaatccattttttcccgaagtggttggttgtccatcaggcttagtcttatataagtaaatttggtaaacaaagatttagtcaccttcatccttaccccatgttgtgctaccatctcacttttttaaaaggtcagtaaaagacatcaaggtatatctcttctccaagaataaatgaaaaattttagcttatagtaggtttgtctccccgtaccatatggcagagccaaggctgccttgggaagcagaagagagagaaatggtatctctccttatacaccacttaacctcaatcctggaaggcatctagaaattcagcaacagaaagaaaaccagaaactaatgcatgccacagtctcatcctctactagggaaagaacacaagcaccaggccttaattagagaagatcgtataaaaaccattcactcagcagaatgccttttctttcccttgagcatcatgctggagatcttatacctcatgttccatttaatttgagcaatacagtaatctcaaggaaggcttatgaacaaaagtagggtgttttccattcttccaatgtcctttctgataaagctggctgtggcagcttaataagatgtatcaattgttaaggttaaatggcattttccaaagggatggaagaaaataggtaacaccgatgagaagctaagcattctacaaatttcatgccaaaaaattaaataaagaaaagaatatatctctgtaggtgaatagcaaaatgctttggcaaatttttgggattcaagtttataaaatccagacaaaccattagctattctggaccaacagactaggccttttttaaaaaagttaaacctttttctaaaaagcggagaattcccaaaccaagcaatcactcaataaatagctctatagctgacaatgaccctaagggttcagaatctaacagtacaatgggatacagtattctacaatacactctggatgcaagagaaatttcttaatctgagtctttagggttgcactagaaaactcaaaaagtgaattctgcacatgggggacagaagtcaaacaagtgataacattaaggagatgaagagtaatatttacagatataaacgacgatcaactaatcttagcaaagcaatattcaaaggataaaagcatgcgaaaaaagcaatgagtttaaatagacctttacatcagaatagtttctgacaatttagaacctaatctgtagaaccagaaatgccttagtcatctagattgactttatgtgaacaggaatttcccctctcgctctgaaataaatggaactccagcttaggctagagcatttactaattacttaagcaatacatttttaaaacagagcgactataatttacagcaagaaactgatctccatgtgagttactccaatgtactaagttaaagataccagaaaaaaaaattatcaaactaaagaataaagttattcccttcaaaaatttcactaaattttcagtgacatgttagataatctcctagaatggagtaaggataaaataaacagcatcaccctacctagcacatttcctggaggtacctcctctagatattccagttcccttcccatcagaagatacaggttttccagagcacagtatgccatgtgggggacttgggggaggccatctggtggagctgagaagcctaatggtacctgggcaaagaaaaatgatggaagacaagttaggaggcatttggaagcattaattggtatttgtaaagttacttctattcatcagtaagatatggtatagcaacatttcatgtaaacctgaaatatgaacatttgaaatggtgtgataaaatatgcctcactttatgaataaaatctgaaatactcaaacttctcaaatactaaaaaattgtctagattcccatttaatcataagctttatggctaagtaacataaattctgttgtgacctggtattgtcactttagctgatcctcacagtcccttgttatttatgtgaaccacatcatacaccagttctggtgactactgtgctatcatttgaacactcattattactattatcctttcaagttgttttatttataatgttcttcaagtattcaacaagggctggtgctagtgccaagtaacatataaaaataactttggaagggtagttagatgtgataaaaatgccaaaaaaaaaggcctaactgctattatatgctatattgttcatatggaagagcatgctgtgatatattaggaacactaatgagaggacagagtacatttacagcaaaaatatacaagtacaagtacattagatttattagctccccatacatcatatttattcttatggaactattgtctcaaatgattcaaattttgcattgtgtgaagtcttcagaaatatacccaccatataaatgcaagtatccagaaggcatttcaattaaccaaccaaccaatctttggtgctcataggcctggggtgctgccctaatgctatgaagggaaaaaaatggctgagatacaacataaacaaagagattaacatcacaagcatagggtgaccaacaaaaaggtagtataggcaagtaaattcataaaggttcagaggaaggagaggcccctgtgctagggtagactctagaaatttcatgaaaatgatgacctttcaggcacatgttacatctaaatgtatgtgttctgctaaaatgacaactctcaaagtagctctaaagatgggctggagagatagaaaaattataagaactgaatagaaagaaatggaattatctacacaatatgactgtccacttaaaacaagctacggataaattataattagtgagacagcttagcaaggtggcaaaaatgcaagatcaatatacaaaagttaattatacttctataattaggaatagaaaatgcataaatagaatagcaataaatagaaaatatgtgtatttaaaatgatttttagaatagcaacaaaatctaacaagtgatcaaaactctttataaataaaactataaaacttcatgaaaaacatttaaaatgacctaaataaatagataaataaacctaatacattcatggatggaaagatgctgtattataaaatgctgattcatgccaaataggtgtatggacataaagtaattccaatcgaagcctcaacagggcttttcatagaagctgacaagctgaccataaacttgatatataggagcaaataggaacaaacaagacactaacaaagaaaaacacggtaaagggatttggtctttttgatgtcaaaacatttaaaaatgaagacagcactgaatagagatagttagagacaaccagaaaaaaataaaattagtccagaaacagacctatgtacataggtaataatctgatttctgacagagtggacaaagctaatcagtggataaagatggactattcaataatgttggaacagctggacatttaaatgaggaaaaaatgaacctggatgccttctttgcaaacaatgaattaaatatttaaacatgaaaagtaaaatattaaaatttagaagaaaacataagagagttttgtgacttcaacatagacttaatttcaattttcttaggatacaaaaagcaaaacccataaaataatgataattcgagtacatttacattaataacttctgcctattaaaaggtaccaaatggaaagtaaaaacaagttctacactggagaagaaatttgcaaaattcaaaactgacaaggaattagtatccagaatatacaaaggacatctgaaaagcagtatttaaaacaataaagtaccataatagaaaaacagggaaatgactccaagaactattaatatcttcacacgagaacacaagattgaccaataaacacattaaaagagttataaagaaaatgtaaactaaaactgcaaaataccgtaatatacccatcagactggcacaaatcaaaagcctaacaaaaccaaattttggtgagcatgtggaacaactgtaactgttaaacactcctattgggagtgtaaatcagaactactttggacaataaattggaattatcttgttaagcaagagattaccaaggcaactccactataggtatattccctagaatttcttgtaaaagtgcataaggagatatatacaaaaataatcaaggtagcattgattagatttgaaaaaaaaaaaaaaaaaaaaaacgaaaacagcaaatatatagtgaccaaaacactgtataaataaaatgtacatttaagtaaaggaatcctatgccacactgaacaataaacgagctacgggaataggcattaacatagattaatctcacaaagttaaaaaaaaaaaggcaggttgtagaataactacaatgaaattccatttatacaaagtttcaaaagcatgcaaatgtgacaatattctttagaaatacgtacacaggttgtaaaactataaagaaaagcaagagaaggatgtggcagacagactaaaagtgcccctcccatgatgcctgcttcccagtgttcacacctttgtttagaaatctccttctcgagtgtgagtgggacctgtgacttgcttcttctaacaaacggaatatggcaaaagtgatgagatgtcacactgtgattctataccatcatacaggactctgtcttgctaggagattccttctactctcttatatggcttgatgaagagggcctccaagttgggaaggtccatatgacaagaaactgtaggtggcctctaggagctgagggcagccaaaggccagaaaaaatctgggactcttagtactgcaggtgcaaatatatgaattctatcaacaacctttagtgagcttggaagcaggttcttcatcagtcagtcctccagatgagaatgcaccctggccaacattctgattgtggctttgtgagaccctaaggagaagatgtggctaagccatgtctggttttccaacccacagaaactgtggatgacaaaatgtgtaatgtttcaagctgctacatttgttgtaatctgtaatatgcagtagcagaaaactaacacaaaggatgaacacaaattctgggtaggggttactttgaaggtaggtctgaaatatttcaggtttttttttaagcagttggaattaggttttatggtgctctggttactgaaataagaggccatttgagctgtcaatgtattgtatcattcctgcttaagacatgagacacataagcaactgatttcaacctgtagcaaagacacattatgcagagataaagtggattgttcatggaatttgtaatgccaaataaatcaatgtttcactaaataacaatttcttgctcacttaccttcacaaaaaaggaaaaaattaactgatacttgacccttactgataaatagcaaactatcaagccaagataatcacagattacgtagatgtataaaaaatcatagatgagtttttatacatatcactttcagactcccataaaacataaccctatacacaccaagtgctgcaatctttcttgctaaattagaacatgccatagctcaacaaggactgcttcactgccacgcagctctgcactctccaaggattaaactgctaaaactcatggaataagcattcaaggcaaagaaaaactgatggcagagacttacttcaactgctacctccttctctctcacttgtagccaagtaccacagcttccctggtttatctacagacaggctgcttcctgcacagagaggagcatgggtttttgtgctcatgatgctccacggtgccagctgacaatttcctagcttactgctttgtgctgatccagactggctgcttggacctctggcactgtcttcatcctatgacctctattatttaattatgatataattataatgtatatatcttgcttacttccaaaaatgttctgagacatctctagcctgtgatccctgtttcgccccttggctcaggcatttttagatgctgcctgttcacctacttacagaccctcctgtccagactcagggtctgtgtgccatgcaactcctgcctatcccctgctcactgcccacacctttggcctaagccagctagtttttggatcttcctatttctcaaagaccggccattgccctggctccagcatgacatctgctcttatcagttcttttctctaaccacaaggtgactcttgcctagaagagaaaagccttataattaaacaaggcctgaaaatttggtccacatattggtttcctaaatgctactaattgagacatatatgacaaatgttatcaaagcaacacaaaaggatacacagtcactcaagtgtgcctttccagagacaaactaaatctaccaacaagataatcaccagtcccaacaaaatgtgaaaagatatcagaccctcgagaaacaatatataaatattttactttcaattcttacccttcgtaaaaactcaagaggactgtatttgggccccaagacaaaaattttctttcctcttcgagccacaccactgaacacccgagcaaatgcaataaaagactcttggttgttttcttcctggagcacaggtttaggggtcatactttccacctgttgctcgtcacctgacagaaacaaaaagataattagtgccaagaatgccctcttaattcaagaactgtctgaaatatagaaggaggagtgaatatgatatctttcgtcaagtttcaggaaaaaaaagaaaacaaaacaaaacaagaatggaaagaatattgataaaaactacgattaaagcttaaaaatctcaagaactaaaggatgagtgtcccaagttaagcaaaaaggcaaatactttgcaacagagcctacttaggaaagctatacctcttggctcctctccttttggacatgtttcaatggcactcccatcttgggtgggctccaagggtgcctgtccctgtgctgctgcaagcttctctgcatgcctttgtcttgcacgctcacgtctctgagcaatttcttcttgagtgagaggcctacaggatatcacaaatatgctgtcatctctcagttcatccaagtagggaaacagcaagcattgacatggctgggtaagatgaagattggtcccagctccattccaggcaattttgtccaagtcctctccctgtctgtagcaataagagagggcctatcagcctctctctaataatgctgtgtcccaactattctgagcttatgaactgacatgcaagagcccaagtccccatctggagcaatgtacaatagtatggaacctttctcagatacctatattccttctggaaaaggcaaagaacaggaagaaggaagggaaacagtgacagatactagggtttggaacgactctggcagggaaacaagcataaggcctcaataactggggttcaagaggaagggttcaaggtcaggatgagtactggcaattcatcaggactagaaggtcaaactgaaatatcagccactgtgttagacctaagaagtaccatcacagaaaaggcagtgtgtgggtgtgtatgtgtggttttccatgggggtgagaatgagaaggggtgggggaggtaattaagctctttttcctaaagaactaccctcatgtctgtcaggacgcagagaaggtatttagagttttaatactaaaaaggtgttgacaaaaggggaatactaagttgaatacaaattctgtttgggagtttgggtttggaaggtagaaaccaggccggtagactgtttcctaggacttggctcccttcccacgtagaggtccttatgaacctacctgcatgctcaaccccaacacatgaacaagaccaaaccctgtcctaaggctgatagattaacagcatcttctgccctatactctgggaagtgaacatcaaagcactcaggctagtcctctggtcctaactttatgctccagctctggaagctggacaactcttcatggtcccaacactttgtgcctctctcccgtgttgtccatcacctttgatattatgattcctgctttatttgccaatctcagacttcacacctaactgataaccttcatccccactttgccatgccatattcccctcctctctccgtaagcactggaagccatgcaggtaaccattctccctacttgtcttccaaatggccacagacccttagggctcctgatgcaaagtggcctaactccttctacctttctatttcacgtaagctaacctgcaaggtgactgcttaaatcattgactgtccactgctatactcttcagatatccgcctgctggacaagacttctctagtcctagtatccaggactagacactacttctgccttccttagcacctgtccctcaaaatcaatgagtttagttccaagagtaggcccttccactcacacccactctgctgcaggtcactgggctgtgcaatagaatacaaaaatatgagaaacaatccttgagcctggcttggtcaggtgtcttgttaggcaatcaaaactgctggcactagggggccacactaccactgcaagagacaagctcctcattataggaagctctaaatgtcagaactttcaaatacagaatgaactctgcttcctcacaatttctagccatggccgcagttctctcctccggagcaacatctaacaaacctacttccctctcctttcctttgaatcaccagcattcatgccttccccaccttccttctcttccccaggctgaccattctagccgttccttcaaccaatcctttgacaactttccttgtttctagacttttgctaaaaactcataagaatatctgaaaagtgtgaattaaaatataaatgcagaacacatttttattattagagtaggaaggaaaaaataccagaggtacctgctagcatctaaagagaaatggtctcttccaacaggtttatcactatgatccagagactgttaatcactttacatatattatagcacataatttatcacaacaattaaatgaagtagatatcgtattcctattctacatataagaaaagggagactggaaacttaagtaactcgacccaaagtcacacagatattaaatggaggagccataattcaaatccagatctgtatggctctgaagtctatgctcattatcaccaggttatgtctttccttcaagaggaattaaagataaaattgtcatcttatgtaaatgtgatttcactttagttttagtgaaaaaagaagtgtatttgttcacttgcagattaaatcctcatctgtctaagttcatgaagtgatctggaataatcagcatgtacagtcattaagtaagcatcaactgtatagatgcctgctgtctatctatgtatctatccatccatccagttaacaactactgtgtgccacacactgctgggcactgggaatgatggtagcggggaacaaagcagatagtaatcagcaaggatgtgtaaaaagtacccactgtgtatccagcatttgttgagaacaaagaaatttaattacaagaaaatggggccctactagtgaggaaacagttgtgagtgttaagttatttaggctatagttaaactaaccatggatgttacttcttgaaggggcaatagttactaatactgagatgaaggagaccagaggtgagaatgttgaccgaagattcaaatgtcaggttggaaggtgaatttgaagaagcaaagaaaagaggcaagaacacaagaacagaggagaaagtcctgtaacagtcccacacttcatttacaaccacagtggcactgttgagcagtgagtaaaggtcagtgtcttcactaagttagggaaaaaattttttaggctttgtgggcgccgaatcctgtttcctgccttacttttctccctggcacatatcactaatacattgtactctatactaaaggaaaataatactctgctattcctggcttgtatgtctaatacaatggagatgaaaatgctatcaaaccaacttccaatggtacattttcccaaatttaaaaaataaaacttaaatgaaaaaaaaaaatcagctagaagatggaaaagaacaaagtaatggtgatgaccttgcccaggtatacctgaaaacactatattattatgtaacaattgttgaacctgatatactggttaaaaaacaatgacaaaaataaaatcagtaaaaaaacttcatggaatagaatggattgcactatcagaaatatactaaaatcagaaaagcatatgatgaattattaggaaaaacattcacagaaaatgtaattaacagtagaggcataataatactattattcatcagcaagaaatgaaggatgggtagagctaggaattttaaatgctataaatacatgtatttcaaatcttaacagcaagttttccaattctctgatattccctatgattctaccagaatctctcagatactcccaatggccaaaaaacatccaatatcctacatttgttactacaagaaattgttactacatgtagcactgaaatattatctgggagtagcctagatacataattagacattcattcattccattattcactcacttacttactcagttagccactcattcacccattcactgacctgttattcccccatttggatattcactcattcattcttcatttactcacccatctattcctttacttatccccaggacaaaaattattgaatacacttaatgtccaaatcactagggaagtactaaaaaacaaagcataacctttcccctgaaggacaaacagaattttatcagaggaaaagaagccttctcagatggaggaacagcacaagtacagataggacatttgttcagacactagtatattagagaaacagaaataaaaatctagtcgaaacatggtttggggtcaggtcatggtgggtcagaaatgccactaagacaggtcaagtttatttcacgggctgatgatctgaccttcagtcactcacatatcattttcatgatttctgctatatctgcatattattatttaatacttatttaaatgcacaaacatttttaactcaataaaactttaaaatctcatcatggtaaaggctttatcacttgacatacacaggcaatacacacaaatacacattaaaataaatatgacaactaattatattaaaacttgtttccctaagtaccactgaaatcatcgccaacactttacacttgaatcaaaactgctcaagacagtgaggatcattaagggtttttgagcaagagacatatcttcatagctgagtcttataaagatcactctaaagaaagaatggcaagtggatcagtggaactaaagatggggcaggagaaccagctaggaggttgctgcaacaatatccacaagagatgatcagaatctaaactagtggggaaagcagcagagacagaaggaggggaacacacataaaaaacaggaaatgtagaagacacagattccccaagactctggaacttgaggaatatccctctcctacacctatcacacctgtgcacacataatacacacagggaagcagagatcctcatacattcataatctctactgaggtaggcagaattagatgagacaaggcagacttagattagaacttgcctgacatgtttaataaaagttaattgttgctactactgctaacatactcttcaaacttacatcacttcaattcaatattccagagctgatttcaacaactttctcctacagaggtatcacaaaaggatatactactgtataaattgtatgttaccctgggggttggcttgatatgaattctgggttgaggaggaaaagcattatccgtgccccccctacccacagcccaactgcatcccaccaaacatacaccatattcctagcccagcccaactttcccctttcccttaccttggcttattctgaggcaaggccttagcatcaactgcaaacattttggaaacaaatataataactggagcagtgtcctcacttccacatttcataaaagctaaacaaataggaagtaaaaatgtcactatttttcccattattaaaaaaaaaaaacagatttttctggaaaacaattaaaatgtttagaacatggatggcatcatcaaaatacaccagaagtccataactttttccaactatgataaaaattttaattagaaaagggtaagattgctaggaaagaatagcagagcaagagcaaacagttggcagaaataagaaaagaaaagcaagcaaatttgacagggtgagggatctcatatgaaagctaaagctatgcaatgaggttaaccacctaccataagcactaatacatttttcactgtatcaagtatagaaaatagaattgaggaatgttaccaaaggccaacaatcaacaaggtagcttgttaataagatacataaaaatcaatagctttcccaatcccccacaataacaagttagaaaataaaatggacaaaaatactgtattatgatattaacaaattcttagaaataaattaagattcaatactattaagataccaattctccctaaatacacaaattttaatgcaatttcatattaacatatgaacattttccttaacctatactggaggtaaaaaaacattgattaatgaatttttttaaaacaattccatcacctcacgttaaaataatttatatataaagaattcaacagtaaaatacaaacaagaaaaaagaaaaccacaggaagtaagaatcaaacatgtatcagaagtcttgccagtggaagctttgaatgaggaacagaatgacatgccctgatttatatcttaagaggatcactctgttttgtctgcaatagttgagaaaacactaacaggaatcaagagcagaagcagggatactagttgtttcattgttgttgttgttgtttgtttgtttgttttttcagatggagtcttgttccgtcgcccaggctggagtgcagtggcgttatctcggctcactgcaacctccgcctcccaggttcaagcgatcctcctgcctcagcctcccgagtagcagggactacaagcgtgtaccaccacgcccagttagtttttgtatttttagtagagacggagtttcaccatgttggccaggaagtgaaaacattgggaaatagttgaattctgtatttcaaaggaagaataaacaggatttgctgatggactggatgttggagtgtgagataaatataagggccatagatgactccaaggtttttggactgagtaaatgaaaagattgaggtctccctaactgagatgggaatgactaggtgagcaggcttggggataagataaaaagtccagttggggatatgttcagttgagatgcttcttagacaacacagtgtagagggagttctagatatcagtccagagtccagaaaacagacatgctctgaagacacataatcgtgggaattatgagtatgtagctgtcatttaaagtcttgagattgggtacaattatcaaaagagggactacagataaaacagatgaggatcaaagacttgaaccttgcttgaggcaccccaaagttaaaaagccagggagatggggaggaatcacaaaaagagatattaaggataagcagccagggagacacgaagaaaagcagaagcaagggaatgaaagcaatggaagcctaaaagtcaagggacgaaagtgtttcaaggaggagtgatcaattgcgtcaaatgctagtgacagatctagtcctgtgaagactgaaaactggccattagatttaatgaaccgaaagtcaatagtgatgccaagaataacagtgtagtggtttgggggcagggttacaaaaccaatagaactggaggaaaagaattagagataagaaaatacgtggagacaaatttcatggaacctacaaagcccagaatgggagcttcttttctcacgaggagcatgtgtacaagtcgctggtctcaccctactgcctgagcaaaatggctgtaacaagaaaacctttggggtgagggtgggaggcaaaactggtgaaatggtcatttgtgaaactgttcatctgtggaagtggacatttggcaaattggccatttagcaaactagcgttcagcaaactggtctagagcagcctggatggaggacagtcaatgacatggtatattccaacaggtccatctttcctcacctgctttcagtgcttgagtttctggtggaaaagagtcaaaagtttgtgatcctgtgcacatcagtctctccactctctcagctgtaatatcaaggggactaggaagtttctgacacaccatagctgaagtctattgttaaggactgaaaaccttgagccagtgcctcccaccaaggcgaagattcactgtatgcactaaatattgaggtaacaaagtctgtccatacagaaaatgcctgtgctacaaggcaacactgctttatgcatcacatctcaaaacatgcatacaatttcagggagttcacaaactccttaaagctcagaaaggatcctcatgacagatactttaacactgaggcccatgaaacaaatgagaacagagcttagcaggttggctacaggtgaccttgaaatgaaacagttatctaacacaaacatctaaatcatctacttatatttgaatcttagtgtaaacatttttatttttatagattactaaacaaacacaaaaagaatagtcttcctaaagaagttcactattagtaatgttaacacaaattagtattagtgtattaattatcaaagtatttaatacagtttcatggtagaacactaaataagcagagaagacttattttggattgaatgttatttccagagaatttcttggttaccataacgcattgttttttctagctttatcaaaactatttcattaaaaaccattagaataaaggataccaagaacagcatgggatatgggtagccactgactgcaaatggcgttgatctgaactttagggtctgaatgtcgtgcctcccgggctccaatttttaatcctaaagaagtcactattttatcaattttgtctttgtccctgtggtaaacacaagattggagaggggaaatgtcatatgcagatataaacaggcagtggaacccaacattatttggcatatttttaccctaatgtgttactttttcaaaaaaagctaaaaatgattgaagggaatcctgccgccacacaaggggcctccccaacctctactcttacactttcaagtgaatccttctttaagatttcccaggaagtacttctccaccatctcctcaagcaagctataccaagtggtaaagcagtcttacaaataagtgctaacaagtcattattccatctcaggaataacttagaaagcaaatttactaaagcaaacttataccagaaaagttatttctcaacttccccattaatgatcctagctatcaagcaccttttctactttaataactattttttaaaagtgggtttgcataaacaaagacccaatgtttctttctatcctttcatctcttctcctcagcactctataaaatattgctatcctgtccctccaacatcaccctttagctgggttacataggcttctttaaattgcttccaagccctgtaatcaactcatctgtagaagctctgttcattttctcagaaaatctcagctttctgaaatatgactcatcaaactggaaagtgagacaaattatactgcctaaagatgcctaaaggtaaacaataagagtcttactttttcaaaacagcatcatacaaactccatatattttccaggatcaactgtacaaataaaggtttctttcctttggcctgtacaaaagaacatacgggcttaagttcctgaacatttaataggcatttatatattccttcttgacatgcttttattatcaatatgtttcatttctacttgaaaatatttattcaaaaataaagtagatgaaagtagttataagaatgcactaaacagtcaataatccacaatcaataataatccactgttctttcctctgggaaccatagactttacaagtgatatgaccatttgtgggtcatattaccatggctgccatcaaacaaatacacacagcacacaagccaagagctaaaacttcactctgcacatgcgggctctttccatggacttcagtctaaaattatgttacaagaaacataaagcattcttaaacatatttctaaaggttcacaaggataggaaaattttgaaaacccaaaaaaccccatcattactcttaacaaactatgcaaaaagttaatagcaagagcaccttgaggggtatactcttccatacacgagatgggatatattaataaattgatacctcctttctgaagaactactggcaacagtattaagaaattaaaagtcattggcttagaatgctcagttttaaaaaaaagcatcatgaagacataaaacttatgcacaaagatgtctatcataactctacaatatcaaaacatttgaaaaaactatgtccaatcttaagagaatgattcataaatgatagtgctctcacaaaataaaataacagggtgcttactgaattatttcatagaatcataactatcctatgagataagtgctattatctcaattttacagatgaaataactgagataaaagtcatagagccaataagtggtggagccaaaattcaaacacagagtcaactctcaaggcatgctctttcccacttagctatattcactccctttaaaatatattgtttataaaaaagcttttaatggcaagggaagatgttcatgatatgacaaaagcaaaagggcagctacgttgtataaacagcatatctcaactgagggatgtatatatctatgtaaaaaggatgaaagaaattataaacatctactagcagtgctggctttgatttttttgtttactgtggctttatacttgtgaatattttctcaaagcaatgtatatgattttcaatgagaataaatttatgaaatcctggttttaacattaaaaacacaaagctccaagaaaagtatcctttgagggtatatgacagcattcctacaccacctctatctatagaaggggtttcagggagcacccacctctcccgatctacactgcacgatgaccagcatgcagtgagataaggcctcagctgacactagaaagacagtgtgaaccatacagggatgtctagaagagacatctctttatggtgacagggacaaacaaatgcacagcacaaaatgtgtgtcttcaggtgcccaagatctaagatttttggtcttctgaaaaaaaaagaaaagaaagaaaagaaaaggcagttctttgctcactatacttaaaaggactaagaattctgtatgaataatacctgtatatggacttgtaagcctttcccaattatatacagtaaaaaatccctcatgaactcacctgcataaattaaagctgaattacatttattaaagatattacagtataggttttcatagggcaagaatatgaccaacaaccaaaagggacatataccacattacctgatcacccttcatgatctttttagccttcatatttatatagtaatctccccacaaggttttcataagaacttcctttttgatgccaattttttgactgtagattctggcgaagtgctcaattctgaaagaagaccaaatgttcatgttattaataacaacgattattgatttctgtgacaggtactgttcaaacttctttacacgtgtattactaaacttaatccagtatcctacaaaatttcctcattttacagaaaagggtaatgaagcagagatatcacacagggaacaagtgaggtggggatttaaatccaagcggtctggctccaaagcccatgttcaggtctacaccaatatgaattgtactacatgctatagctttctttcttaattttgcaggtgtaaaacaagataaaattagggacaagaaaatgcaagctccagctgcctgtcacaactatgccaacaataaaattttatttcagctactcactgctgttaagtgacagctgctcacaaatgaaagaaattcttgagccacaacctgccaaaacaagatttttattatcctagattaatggtaaacatacacacactgacttaactcgcatcaacccacagagaaaaaccacttaccaccgtggtctccagtcacaggaagacagtcaatcaacaactaagggtcctatatacagcatctgcattgtctggataaaggacctaagaaataccttttctttagagaacaatctagtttaaggtttgagattagaattttcaaagtaccagcatcttaaaagatgcctgctcaggaaaaaaaaaaaggatatccccagttttttccacaccatactgaaagcccaacctaatgcaatcgcacaagaaaaggaaataaagggtatactgattagaaaagaagaaataaaactatctttgttcacacgtgactctttaatcactcttccacaaatgaagacaaggtgaaaggctgaaatccactggtagagttcctatgcctcaaaaagaaagcaggctctgccttgctgcctactctgtggatccctaaaaagattcaggcctcctcctggcttccggtgtttcagcacacccagaacggcacacagagccttacttccagatgttaagtcaggatacccttatctctgtggcttttcatttataaatacccagttttgctaggcaggctgcaacctgccatgcagatttgcaaatccaattcaggacctacaggcaggtccaaggtccacatatggaaagaaacaataggaggcaaccactgtggactgacttcccaggcactctccaacctaaccttagaagggagccctatttgttagtagtgatgctccctggggcctcaataatacagctgaagctttgctctccatattggcgacttgggtctattcttagatggttaaaaccagagataatgactgagcgatgaatacatgaaacctgtgacattttctttcttttaaatttgaattattttttcacctgatataggaccaatttttgtatatccttcactgacacttaaattctgactttaattattctattcatatggttcatgttcctgtctactaacctgtgaaaatcgcccccaaaccatgtgcctacagagttctacttatagttctatttttgcctcatgcactttgttgttatgataattgatagttaatctcttcactagtaaatgtgtcaattatctatatgaaaatgatccttatgccataattcatttaccataaatcctattttattgttaatattgccaaacctctcttttcattcacatttggttgacataatctgagctaaagctttggtatttagcctctgtccattatgctttaagtttatctcttttatgtagcaaacttatggatttatttttttaataaaatttcctttctaaaaaatatctccttagtaggggatttcatacatttattggtataatcatttattggtacaactgttttgatcagttagatttctggtgtggtttctattcttccaggatttttttttaaatgttgatttgtgttacccagactgtattatacattattttatcttttataatatgtcagataaatatcctgctcttaattctgaaagtggtaaacttaaagatttttataaataaacactctaaaacctctatcaaaatcataaattatagtaagacatttgcccatttgcttaggctaggctcttctagtccaccatattaaatattcacacatgtgtacacatacgggtacacaaatctttcaaaaatcttgttgcttatccttttcattcttttttatcccgtagttactacaaaatttgcttaacatcaacccattcgacattactgctagtgtttttatttatttttgtcattagttacaatttttaaacactgacaatttctagcacttccccattcttgaattctattttaattcatttcctctacagagtaactgcaagcaagattctaagagacctgcagaaagatttatattccaagactactgatctattcattgcctatcttcctgaatgacaactcagtcaagtatgaaattactgagccacacacacccttttgccctccaagctacccagtagattaatgttaattacagaattctaatactcagttacacaaagacaagtaaatctattacaaagggcttttcatttctcttctctcctgtccctcttctataaggttgaggactcagttctatgtatctaaaacaagaacttagattcttgatgctacccatccaagtcaatatgcttctgcttttcagagcagactctcccagattaacatcaattaacaggatagatttcgggagaagacctaggttcagcctctagtcacacttcttaatcctttcccactgcagagtttatagaaccatcttgcaaattctggaatgtgctcattttccaccttttgtgacacatgcagctgtcaacttggcctattcactgacattttagaggaaaaggggaaggaaaaagtctctggtgctttcatttccaccactactttcccataaattcacatatcaacttgttgagaacagacagtagccaatctctaaatctgaccttgtctaatacaggggaacattcatttattggctgatagtatctaaaaatgtcaaaagtaagggctatgtaaattacccttattctatccattcaactttctccctattccctgtccttccacaataaacttcccccaatttgtgtgatttagactaaaattagcataaaacattgaattacttatgaaaatcaatgtaagaaagggacaagcctcccatcttgtggcttattagcagaatgctcacaaatcaggaaatcaacaagtacgaccgtattatatgactgaatgaatcactgtgaatgaatctaaagaaagtcttgaaatcatcttagcccaatattcttgttttttcagataagtaaactgaggcctagaaaggtgataatgacaacccatcaaccatatatgaaaagtacaaattctcagcaggttcacaatttctattttcatcatatatgcattacttcaatttatttagctctagtatcatctttcgggcatcaaatggactaagatatctataatttattacaaacagaaaattatgatattatattacactgccctgcccaagacaaaatctggtcaaagggaaattggagaacaagttcctgtaaaaaggaaaatacattttaaaaaacggagccagagatttgttaggctacacccaagccttgcattctagtcagctcctgatcctttctttctttccaattctaagtcatactgatataaatttcatgaagagactctgttttctcctagtgcatcatttctagttctatgatccctgcaaattacatgcaatatcaagcccacaactaaagttaactacagttatggtcccactactatttatccaaaccacagacatttttctcaaagtaataatcttttaactacatttggattttttgattccacaagtcagaaactgttgcagtttaaaaaatgtgatcaattacctactccattctgaaatccaatgtcactgttaacatggcctcagcatgtgcaaattcgggagaggcaataagaagaaataaggatccttataccccatagggaagacaccaagagaagaaccatgtcaagaaaacacaggcttcagactcaggcagactttaatcttaatatcaactctgcctcttagcagctgagtgatgctgaacaaaagttacttaatgttcttgagacttagataatagatagtaatatctgtttcaaaggagtgttgtcagaatttggtgaaataatttaaataaagtgagtaactcaatatttagcatatgtacatcctcaataaagctagactaacttttgctactgttggtatcaaagttgatataaatatatttgttcatctatgtacaaataactttaagaagataaacaaaaaactgacatgaaataaactgagctaaggaataaggtgggatccctttgtggtatacatttgaatttactcaagaataaagttaaagttaaaaatcaattgtatataaaatctataaagaaatgcaagactggctcaatattaaaaaacatcaatcaatgtaatataccatattaacaagctaaagaagaaaaatcatacaaatatattaattaatacagaaaaggtatgtgacaaaacttgacacattcataataatgacattcagaaaaataagaatattaggggacttcctcaacttgataaaggacatctaaaaacagcctgcagtcctaacattatttctaacggtgaaaggcttaatgctttcctcctaagaccaagaacaaggcaaggatgcccactcccatcaatgtcagtcatatagtgctggaaattctagccagtgcaatcagcaaaagagaaaacagcatgcagatagaaaaggaaaaaaatacaacaacccctatttgcagacatgatagtctcatagcaaattccaaaatatctacaaagaactgcaagtgagttcagcaaggtgacagtatacaagatcaacatacaaaaattaattgtatttctatatactagatgaatgtgctaacaccaaaattaaaaatatcatttataatcattcagaaaaatgaaaaattaagtgtaaatctaactcaacatgtacagcacttggatgctgaaaactacaaaatgctcataaaagaatttttaaaaattttaaataaaaggagaggcatagtgttcatggaatagaaaaaattcaacatagcaaagatgtcaaaattctccccaaattaacaggtttaccaatcaatttccatcaaaatcctagcaaaatgtttttgcagatataggtaagattactataaaatttacatggaaaggcaaaggccttgaacagcaaaagaaattttgaaaattaaaaataatgtggacagaaataatctacctgatttcaagacttattatgcagctacactaatcaaaattatgtggtactgttggaaagacagacacatagattaaaggaacagaacaaaacactcagaaacagacccacacaagtatgtccaagtgattttgacaaaggcacaaaagcaattctatggagaatagataaccttttcaacaaagcgttctagactaaatggaaatccaaaggccctctcctcccaccaaaagaaaaccttaacccaagcctcacactttatacaaaaattaactcaaaatgggtcatggattaaatgtaaaaagtaaaaccaaaacttatagaaaaaaatgagagacaatctttaggatctagagctaggcaaagagttcttcaacttgactctaaaatcaagatccataaaaagaaaaaatgataaacgaaacttcagccaaattaaaaactttgcggactttgatggctgggagcagtggctcatgcctgtaatcccagcactgtgggaggccgaggcggatcacttgaggtcaggagtttgagaccagcctggacaacatggtgaaacctggtctctactaaaagaaacacaaaaattagctggcagtggtggtgcacacctgtagtcccagctactcaggaggctgaggcaggagaatcgcttgaacctgggaggcggaggttgcagtgagccaagattgcgtcactgcactccagcctgggcaacagggcaagactctgtctcaaaaaacaaaacaaaacaaacaaaacaaaaaacaaaaaataaacgttgctcattttgaaagacactgttagaggatatgaagtcaaactacagactgggagaaaatatttgcaaagcacatatgagacaaaggactactgtttagaatagaaaaaactctcaaaattcaggagtacgaagaaaacacattaagaaaatgggaaaggatgtgaaaagacttttcacccaagaggacctacagatgacaaatcagcacatgaaaagatgttcaaggtaaaccagctgttaggaaaacgcaaattaaaaccacaatatcatattagtacacacccaacagaattgctaaaatgaaaacggtgacaacaccaaacgtgaacatttggagaaactggatcactcacgcatgcactgctggtgagaatataaaatggtacagtccgtctggaaacagtttggtagtttctttaaaaactaaacatacaactatcatatgacccagcaactgcactcctaggcatttattccagagaaatgaaacttatgttcacacaaaaacctacacatgaatgtttatagcagctttactcataatggcccaaaaaggaaaaaaaaaaaaaacaccagatgtcctttaatgggtgaataaactggggtacatccacaccatggaatactactgagcaacagaaaggaaccaactacagtattaatgcatgcaataacttggataagtctctagagaatcatgctaagtgaaaaaaatcaatttaaaaaatattacatattttttggttccatttctataacacccttgaaatgagaaatttggagataaatggttgtcaagggttaaaaagggtttgagggtgggaaggaagtagctgtggcaatataagggcaacgtgaaggagccttgtggtgatagaaatgttttgtatattgacggcaaatggcaaagtcctgcttggttattgtactacagttctacaagatgttatcatggataggaggcagttactgggtaaagggcaccagagaactctctgcattatctcttacaactataggtgaatctataattatctcaaaataaaagtttcactaaaaacaatcaactgcatataaaatctgcaaagagatttaatcagatgcaaacagacttacccaaagccccacccatctattgcactggtaaacaccacatttccctgttctggagagaagtaaaggtgagaatcatctgtgtcctccaagccagtgctccagtcatatacttgctctccttgttcagaatttggattcacttgggattcagtctccctctctgctctttcttctaggactttagaagtaaaaagagtccctgtgagcgcattaatctaggagagatggtgaaatggcagagcgtcattcagatgctcagcatgctcacggcaggagaaacactgtttaacctgtgttagggctagaatcattagtcagtttgggctcattaagcatacatgaatggaggtgacattcataatcagtgaataacttagatgtatccattcttcctaaactcagcataactaaattataaggtttttggaaggttattttgtgattattattattagtttaatgtaaatgttaatgtgtcatatccttaatttgtttctcagtgctgaggcctagtatcacaaagtactcatgatttccaaccccacaatcctagtttgtaaccttagtccactgccttgcccatctctcacatcggctgtctgaaatgtgcactaccctcttcaggccctcttcccaactcctaatcctcaactctactttcactcccaaataggcagtaatcttatgtcctacctcagagagaaaatggaacctattactcagatttccttcaagtgccccacatcccaatctacaagctcacttatgtctgcaaataccactgacctttctcctgccaatgcagggcaggagttattttacctgttcctaatttttttcttttttctgaggtggagtctcgctctgttgcccaggctggagtgcagtggcgtgatcttggctcaccacacgctctgcctcccgggttcacaccattctcctgcttcagcctccctagtagctgggactacaggggcctgctaccacgcccggctaattttttgtatttttagtagagacagggtttcaccttgttcgacaggatggtctcaatctcctgacctcgtgatccacccgcctcggcctcccaaagcgctgggattacaggtgtaagccagctcgcccggcctacctcttcctatttctacaacgaatgatatccatccatcattctttttcactgttctacttttattgtttcctgcctttaacaaataaatatactcaagttgctctcatcaacagctttccactgtgttgaggaagacatttcaaactctcacgcacggcatatcaggttcactgacatctaaatcctatatcctttttcccatctcttgtaactgttgcaaacgatctaattcttcagctaaaaaacaatttgcagttccttaaatgaaacactgtactgtgctttttcttgcctttatgactttgcccatcgtattccttctcttttgaatgtccttttcctgtctacctggcaaacacctactttacttccatctcaaggcttccattttaagacttctaactcattcttccctcttgacccagactgggttagatggcccttatctatgctgttatatcacacccaggacttatctcattgttctccaaatatctctttgtctcccctactatactgtgagctccttgaaaatagggattctgacctgttcatcttatattcacaatccctagtgcacaatggacatttgataattcatttattcaacatatatctatgaaatatttgctgaataaataaatgaatgaatgcttgggtaaaatttcctgtaacgacaggtaataaaatactacagacaggtaataaaatcctaatatggcttcactttggaaccaagatacagttttaaacaagagagcctattgtccaagctttatatgatgggtgattccaagagatggaaaagactactgagaacatgctttttctattgcctctcttgtagaataacagcaacacgtatgaatctgaagtggaaaagttcccttttctgtagcaacggctcatacccagctcagtaacttccttacaactcttcttcgtggctaaattttttaaatactaaaaattaaaatacctgttctaaaatattcttgaggtgagaataggcctcttgtggggtgaatttcagttccactatcaagcgatcaatcttattaatcactaaaaccggacggatgttttcaagccaagcttgtcgcagaactgcctgtgtctgataaaaacagaaagaaaaatgtaaaactcatgatttgaaataattagagcacattagaaaatcgtgattaataaccactctagactatgccagtcagacaaaggtattcattaggcattcacaaactatgtatacagcggagtagcaaagaactacacataagaaatcattgttgcctttatgcaactgacagttaagaaggataaataaggccgggcatggtgggtcacacctgtatctcagcactctgggaggctgaggcaggtggactgcttgaggccaggaattcaagactagcctggccaacatggcaaaatcccgtctgtattaaaagtacagaaattagccaggcatggtggcacatgcctgtaatcccagttactctggaggttgaagcatgaaaatcacttgaacccaggaggcggaggttgcagtaagccaagatcatgccactgcactaaagcctgggtgacagagcaagactctgtctcaaaacaaacaaaaacaaaaacaaagtatgttaaattaaagtcatcatctctaagatcccttcagaactctggtgatttaactccttcacagactggaacgttaccaaatgtgaaatataaaaccaatgttgtgattgtcagtgaaatgcctaaagtcagtcagttccccctctttcctcacccttaaccatttaagtattttctcatcacaatccattacctgtggacagactccttccacagcatctaccacaatgatgcatccatcacaaatgcgaacagcggttgatacttctgaggaaaagtccacgtgtcctggagagtctatcagattgatcaggtactcctcattacctaaaatacaatttgtaaacacacattttcagttgtccaggtacacaatgttcttcctcaggcgttctagaataagaaagctgaaagcttctaagaaaaaactgaacaaagctaaaggagttgaaagctcaatccagagctaccattccaacttttcccactgatgggactactgattccaaatagcatctatataaaatgttaaaggactttattattctaatagttaccacttaagagcttattgggagccagccactatgatactcacttttaatgtgctaatcacatattattgaatccttacaatatccctatgagatacatattactattctccttttacaggttaggaaattgaaactgaaagaaatcaatgcctaagggcctgacagtaagagctgttcaaagggccaacaaagcagttggccaagttcttccctacagtttgtcaaagagcagtgtatgaatctgctcaatcaagatttagactcaattctacaaaaacttaaggagcagttactatgtgccaagcagtgtgctatgtgctctcccattaatatctccttcaatagtctcaacagacaaatgtattaaacttatagtagggtgatgacacatcctgagttgtctggttttagcacggaaattcccacatcctatcaaagcccttagtcccaggcaaacaagaaaaaaaaagatcatcttaggttatagagagttatcactaaacataacttagtataccatgcagaaaattagttaatactttagaattctgtactcattccccattattgataaatttgatataattctcttttaaaggcagaataactattagaatgctcaaacatatactttacttttgctcctccccttaactcagtgtttatcaacttgaatgcactcaagaatgactacagggttgagtatcctttatctgaaatccaaaatgctccaatgagcatttcctttttgtgccatgttggtatttgaagagttttgaattttggagcatttcagattttggattttcagatttgggatgctcaacctgcaatttatgggccatttaaaggattttcccccaatataattttaatgacttcgcttgtgccctaggtgatactgatgataaacaccaccacaacaataaccacaaccagcgcttaacatctgtggactgcctattcatggctggcattgttctaagcataatacagaaattatctgatgtttacttacaacaatcccctgtagtagttacaactattagcccaattttatatagcaggtaactaaggcacagaaaagttaagtatttttctcaaggacatccagctagaatccaattctgaggttgactaagatcacacaattcaaaatgatagagcataagttcaaatccacttaactccaaagaccatacctctaaccactacactcagaaggcagtaactttcacctcacatgccaagattccactgctaatgaattcctaaaacactgggtgaagcattcccaagtgtactgaggctcagtgggaaagactgccatcagttagcaacagactgccttcttcagtaccactcctccccgctgcctcctggtcttttcatgcaaactgctttatgaggaaccattgctctgctgaaaccaccagagaaggctccaaccagagaagaccatggagatatccagtgaaaatccaagaagtcaaataaccagagccctggagcaatggcccactggacctcaatcgagcctttcactgtcagatctcacaccagttctcctagtcaacattttcgataagtatcgtgatctcaaccaagtacaccagagaaaaaggagcatgtctagtagtggtctagggtcctatcatacaaaattaaagctgtgagattcttagaatcactcagcattttctcagcctaagcctttattccatagaaaaacatgctaacgccctcaaaaggtaagagactgacccaaggtcccaaaagaagcaagccagaaatacacccagggctatcgaaccatcttagtcacttctcgggtcttagattccttcatactttgcaactggggaaacaacacttgcctattcatctggctaaactccagactttagagtgggagaacttcaagcacttttccatcctttgtgatacgaccgggacctgatactgaagtttcagagactgggtctccagtcaagttctttacagagtctaaaaatgcactcgtacagacatttcaggcttcctatacaacagtgctcttaccttttattggagttacagaccttttagggaatagtcagaaaaacgaatacctatctacttatctatgctcccctaagtacgcgtccatttccagattctttgaaattcattcaggaagggcaggttcagatctagagaggaactgaaagctagagatacaccaagtgtttccacccgacaatctacatcctaaaaaataagtgtctgatcaaataatatagctgagaaataaacagccagccttggagctcacatcacacatacatattaaaggttcagagaagccctgtaaaagaagtttgtccaattctgtttaacctggagtttctcaaatatatttaatggtgagaaggaggaaatgccatggtcagttacacagctgacaaaggcttggctcagctctgagccaggcctcccaattcctccttcaatgcctttttcatcttaaccctttccaaacaacgttaacctaaatttcaaaggttggggacagaagtcccatatccattagagaaaaaacgtccccaagcacagctcttctgctgtgacttcagccacattatgtctctttaaaaaatgccacttaccacttttgcgtgtgtgtgatcaaattaaaaaatacataaacgcagttataggggtttaccatggtagatattattgttattgccagtattaattatttaaaaagtagagaatgcataacacttttcaagagacaaaattttttaagcatgctaaatgatctttccgatttgtaacaaagtcctgaagctatatgttgaattaatccctgcaatagcattcagggacagaaacttctgctgctttacttcccaggcattccaaactaaacggcttcatttcaaggcacagatctaatcagtcaagcaacaatccaatctttttatgttccagggggctgaaaaaaaagttggaagaactgaagttaattatgggagatatcttccagacaatttctgctgctaatagggagttatgggaaaagaattcctcccttgcccatggttttaaagtgccatggataattgtctcacagaaggtgcacatttgtcactaggacctgccaaaacatctctgtattcagtaaaacttcatgtaaggagtttagtgttcaacttccaaaacactggaaatgctcactaaagcatacatagaaagctgatgagagaaaactttccataaaataaaaaagaaaaactgaagttatggaagaagatctgaacctcctgaaagtgtcctttatgtgtcagtgtattggtagagtattttgcctgacaacaaaaataacagaaatataggcagaacctgagttatctgaagacatgttcctacattccttatgtatgaacttctaacaattatatacaaaaattgtaccccaactatatataaagtaaccacaagtctccctccacaggaaatactacttttttttgttttttgttttttttagagacagggtctcactgaaacattcaggctggatgcagtggcacaatcatagctcactgcagcctcaaattcctgggctcaagcgatcctcctgcctcagcctcccaagtagcagggactgcaggcacacaagggtaacttttattttttgtagagatggggtttcactgtgttgccgtggcaggtctcaaactcctgtccctaagtgatccttctgcctcagtctcccaaagtgctgggattacagatgtgagccactgcacctggtttccttttatatcttaaatcactattatccttttatattttaaatcaatgtataacattataagttataaatcaactaatacgacttattatttgacagaactgtaaagcacaattgtaaagctgacacaggtaacagggtaactatctttatgagaagcctgccacaaggagaggtgaagggtggttgactctgatagtatgtgtcaaaactgagatggggtcaggcacagtggctcatacctataatccaaatgctttggaaggccaaaacaggaagatcacttgagccaagaccagcctggacaacatggtaagaccatcatctctacaaaaaaatttaaaaaattagccaggcatggtggcacatgcctgcagtattagctactcgggaggctgaggcaggaggactgcttgagcctaggagttctgggctgcagtgagctatgatcaccactgcactccagcctgggtgatagaatgagactcttgtcttaaaaaaaaaaaaaaagtgacaggggttaggaaaatgagaggaaaaatgatctagaaacaactatgaatagcaaactgattaagttttcttttgctgcacaaacccgacccgaagacctctccagaccttcctccaacatgaaactagaccacgtacagaccacttctgattacatttggcctcacccgcttttggtttttctcagtatgatgccagtccacatctgccacccagtactgtggccacaccctgaactctgacatcactgagaacttctccacctttcaaggcctgctgcgtagatagtaaatctaataattacacatccacattgtcttgattcctttgatcattggcagttttgcttggaagggtgtaagaaccagaataagaaaccctggagtaaaaaaaaggttgatgtttacttcttataatctctctatgcttagcatcaccctggagagaaggtcatagatcaaggaccaatttcacactgctaatgcatgtcattactgtaaggtgctagtctcattatcggagtaattgagagagtaattgtaggataactttgactaagaagggggaagagggaaaatgcagaggaatgtggggctgaaagaaggatttatgtatttttttaagacaagaaagacaagaaagacttgagcatgcttaaaagctgatggatacaagccagtacagagggagaggtggaagatactgaagaaaagatcattaagtccagagcacaggtttttgccagtgacaggaggcaagcaaaaaatgcccataccattacgttttgagatacagtggcaagcaggtgagaattcttctcttttctgtgaaatagaaggtaagaatgtctgctgagattgtggaggaggggatgacaggtaggctgaaagagaccagaaggtttaaaataggtattgggaagaatgagcaagacctaacagtgagagatgggaaatctgccagcagtctggaggaccacttgagaacctagcccaaatgcaaggatgaagacgtgtagagaattagctttatcaagggttaaagttttgttgggaaaaatatgacagaaggtcaagaaccaaagagactgaagacgctggcaagactgtcagtgaaatgacaaatctgggctgtatgaagcaggaaatgaatgaagaaagaggctgtggggagtcaaaaaaactagagaacattatgaagtcaaagaatgggtacctcattaatcaggtgaaagaaagagctgggagaatcaaagattgtagagaaggaagtatttaagtttgaaaggtcgaagatggatagctcaaggtgatgctaaaatccagaaagtattcatgacaacaggtaggtgaaacgcagaatcaatgttgttgagaggataagctgttgaagaagtcattctcagggatggtgaaaagccaccttagaagattcaggtaaaaagaacaattatgagtccgggtgccaaattcactaatgaacaggaaccatcaccaggagctgacaatgactggaaaggtgaataattggatggtctgagtcttgaaagaagaagtttgaaaacaagggtagaagaattaacttttgtaatcagatctgggaacaaaaagaatggcaatcccatatgctaacccagagatacgtggaacatgaatgaatgagtagcattcacttggaaaaggtacaaggcaggcaatgtcatcagaagacagccaggcagaagggggaaacgtcaataaaaagacattgaggatgtagcgatgtttgtttctcttggaatgttttcacagtaagttttggtaaggaagggaataatgggaaattgaaagagggtgtcagaatcacagagaaacatggggaagagactataagagaggccagatcatgtggcttgcatcgtgggcagtgactgaagaccacagggacgtaggtagtgttggccacaagacgtgcataacaatccctagtggaaaggagataactcaagcctcaggaggaattagttgtggcctgacttccaagagactaatggtccaagtgaatatgctggaaatgtgggttctaggactactaccacatgctagaaattactctgtccttgggaaagtgtcttcacctctctgaactccatttttgcacatgtgtaaaatcagagtaatacccatcacagagttgctgtgaagattaaacaaaatcaggcatatgagacacctagctcagaagtgaactatcgtgtacctagtttcttaggcctggcatcaactgaatacttcacaaagtaaagcattcattgtctgacgagaacaaaatctacccttcagtcaaatgaggggtaatggaactcttccctcccagcctcattctggaaagaataaggcaagttaggaccatgggtaaacgttcacacagccagaggaaaagggaagctactgcctctgaataagagatgactttctgctacatgctggccttgtctgtaattagatggcatgagtcagtgtctccatggcctagtcttcggagtataaaaccagagagccacagagctgaaatcaacacatgcgtaaatcctccttctgcccacaaccactaaccctatcctaacagaggtatttacaaagtgatcaacttgcatatggacctctttgcagaagactgctatatccttggtctccctgtttggaggacaacctcactgcatatggctgactcttgggtgaatcccaagtgtaccactgaaccaggctattagctagactatatgcctaaggttactaactaaaagctcataagctaaagcccactgcagtgttttccatatggtgttttacaatttttaaataagttggcagcattttgatacttggaagattttaccgaaaatcctgatgccaacttttcttgaaaaaaaaaaaaaatcactcaaactgcctcacttatgcagaggtgtcaacaccatgtcaggaactaataatattgtacttaataatcacatctgacaggtgttagaataagtaagctatttggggggagaaataaagttagatagttacctcacagtgtgtgcatacacatacaacttgcattaaatataaaaattgaaaatataaaataactggtgatgaactgagagtgatttttatttcatttttgtgttttactgtatattctataacacacactaaattttctatagtaaatataaacttgggccaggtgtggtggctcacaactgtaataccaaaactttaggaaataggtagaaggcttgcatccacgaggttgagaccagtctgggcaacatagcaacatcccatcgctacaaaacatttgaaatatatatataaataaatatatacattgaaatatacatacatatatactatatatgcaatatacctaatatgtatgtatgcatataaacttgtaaatttatttaaaatattttaaaagatgaattagataaaaacttcaaaagttcagcaacagcaatatttgctcagatataaaaaatggctatacagtagaaacgactgcagtattccttttgatgaatttcaaattatttaacccatgtgaatctatttctctcttctgtatctggattctaggctaaaggattcaaaggcattacatccccttaggatattttacagaacgtatattgttaggaatacttcctaactcttgagatgacaagataaatgtatggtatccttgtgggtgggacacaaagagaggtaagaaacaggcaaataacaagatttaataatatgatcccaatatttgtagcaaattttggtcacaaacgtaaagataatagaggttccattttctcaaagaaaaattaggttcctggaaaatgctgagatagtgtatgaccttgatggttttcaacaccacttctataatgtgcaggatttatctgtttactttaaactagaataagaccctatatttcaacccaaataaatatttgaaaatacttttgaaagctcggtaaattaagagtcagaaccacagaaagggcttaacttgcatttagtacacagattctcaaataagagggcattcgaagtgggtgagaaggaggggaaggcatggtataaataaaagtcacctgtggagtttcttcaatcatcaggtttccctctttttctcccatctaggttccccttcagacgtcccaccttcagaacaggaaataccccattctggagaatcagtactaagatacagataaaaacatatctcatctctcaagtgctctgagaggatatgtcccagtcaacattcctaacttctatccccataaggctctgcactgtcaagtgtgatgactgctcggcccaaattcccttctaggcagtaatcccatgctcacaagaaacatgtttgacactttgtgactccactccgatcaccactgattggattaggaggtgactaaccaacccaagcgcagccaatccataggtgcaacctctgtgatgggctggcatgaaaagataagcagagccgcatcctgctcttgagcctgtgtgctcagaaacacaagagattgaagcagtaggcaacagaaataaggtgaaaacagacaggataatagggtaagaagtcagggcaaggtgaatgtacaaagatgaagacatgacagtaggcaaaagctatgagacagagaaaagacatacaggataatagtggaaatacaaacagacacccaaatccaaggacaacagtggagttccagaggaaggatccataaacttttactgatacggtctctagagctatcttggatccagaataaaaatctggctccaatttttatgagacatcactccaataagactcctgtttttccgttttcatgaatattatttccaatatcatttcacacatatgctttcaataatctatcccaccccaacccaagctagcttaagtctctggtctatgcaatcaagaaagcatacctggctgggcgcggtggctcccgactgtaatcccagcactttgggacaccgaggcgggcggatcacctgcggtcaggagttcaagaccagcctggccaacatggtgaaaccccgcctctactaaaaatacaaaaattagccgggcacggtggcatgcatctgcaatcccagcttcccaggaggctgaggcaggagaatcgctggaatccgggaggcagaggctgcagtgagctgagatcatgccactgcactccagcctgggcgacagagcaagactccgtctcaaaaaataaaaaagaaagcgtacctaaaacaatctgatctgtgagcagccaaggtcaaggtcacagagctcgataaaatagagttcagaccattcagttcccagggtcctatagcaaattctcctacaatactacaccagaaagataaatgtgaattggaacaggtgaattttatggtatataaattaaaccttaataaagtggttaaaggactcaagggagggggactagagacaaagtatagagcagaacaactaaaactgacaccagaggaatcttcaaataaaaacagactaataatctgagtaaggaagaaggcagccttcaaatctcttgaagtctataaaacgagataagaaatcaatagacccttaacctcattctctggatcacaggatgagaatataacctttaaaatgtgagaagtggtttaaaaaaaaatgaagcgttaaacattaaacatcgagaaatcatgtgcctaagagcttcaaaactggtttggtacaacagccatgccccacacagtacatcttttggtggcagtgtcaaagatatgacacttgtgaaggatgaaccacatgtaagtccattagggaaataaaatttatctttattattttcttctaattacaaaaatatacattttgtgtaaaattttcacatactacaaaaataaatattttgaaaagtgcaagtttctccataatctagcccctgcagagagctactgttaagggtttggtatgtatccttccagacacctttatctgcatatataatatatttttattacctaaacacattcatatcttacaaaaatactctgcaatttgttttctgtctctgaacataccattttcccctgtacaataacatatatattaaacatttgttttaacagctgcacagtatttcactgcttggatatatcagtttattgaaccattctcctattgacattcaggttgttgttatttttttcacgaatacaaactttttagtgaatatcagtgacatgtatctcatatacttacatgactatttctgtcagataaattcctagaagtgttactatcaatgtagcatcctcatttgaggacagcaagctggtactgatcacggcagtctacctttaatctactccaaatctaacatgcaggccaggccatgaggcagaatagtaaggctgaaccagctaaagtcctagggctcctgactttccttgtgaaggaatccatataatcacctggtggagggggcaggtgtgaattgccagttcttctgccctcaaaccagtcagaggtttccatctgcatccaagcctggacagcctgactctgacaacagatcatgtggagaggccagaataaaatacgtggaatataagcaaagaaactgaggcatgcaattaattcagaaagacagaagaggacatgaaagatgcaaagctgtgtttcgttaaaacacagactgatttacctgttgcataatgtagggaaatggcactggatttcatagtgatccctcggatctgttcatcttctctgctgtccatgtaccttaactggaaaaatgcaacatatgcatcttcacttcccaaagaattaaaatgtaacattaaaatttgctaatttagatttttgttttaaatacttatatttaatttgttatttttatttatttttgtagagacagggtcttgctatgttgcccacactagtcttgaacttctagcctcaagtgatcctcccaccgtggcctcccaaagtgctgagattacaggtgtgaaccatcatgcccagccaatacttaaattttaacctatatagagccttttttttttttgagacagagtcttattctgttgcccaggctggaatgcaatggtacaatctcggctcactgcaaactctacttcccaggttcaagtgattctcttgcctcaggcctcccaaacagctgagattacaggcatgtgctaacacacctggctaatttttgtatttttagtagagacagggtttcgccatgctggccaggctggtcttgagctcctgacctgaggtgatccacccacctcagtctcccaaagtgctggcattacgggcatgagctaccgcgcctagccctctctcttttttttttttttaagatgatgggggtctggagaagtgaagttgattgaggggaagggaacatgaaaaattgaaaaacataaccactaggaaccataaatgtattgaaatactgcataccctccccagagtgttgctcatccaaatatcagccgtgaatgatggggcaggtcaagaacaacttacggacagtagcatttgagggaattctttctaaacatcaataacatagccattcttttcctatttataagctgtttgacaaattctgagcagagactgaaacagaagtctctagaagcaagagaagtctttattcctttcccaaattaatagattttgaatacatcttttttaaaaaaagaatacagtagaaaatatttgtaatatgaccatttagttgatgactttcataacactgtaatacccaccaatgagtgtctacatctcattttctaggccttgcagtgcatcagtactgacagtggtgtcgtttaaataaagatcccatccctttccaactccttagccctaagcaccagactaaccttctcctcctttctccagaatgattttcccttacccttcctccattctctccactgtcaaacttttgaaaaattcttaacctgtctattttctcctttctttcattcaaaagcaccaagaattatctgttgatatgaactgccacatttattcatccatattaattctgaaattttcagaaaagcttccatttccacagctctggcaaaatcaaagtcctaaaagctatcaatgacctctggcgaaacgcaataatcattctcaatcctcatttttcttgattccagtgcagcatgacagttaccctttgtgtgcatgtgtgttacgtgcatatgtgaaattcttccaagagtctgaaacctcttaatttacctccatctctccttagatcccactgctggtttcccttcacctctccaacctctcagtcagtccttccttcagaaagtctcagtcccttgtcagttttctataatgtatgtttttaagcactgaattggtatgaaacgtgtaatacataaataacaacacaatgaacccctgtgtatgcaccatcccatttcaaaaggaaaaaaaaaaatgtttgttacttttgaagtaccctgtgcccctggcttacaggtaaccactatcttgaattttatcttgatcatttccttattttctttataatttttaaaaatgagtgtgtcactaagcaatatatcatttagagtggcaagttttaagccttctataagaatcatacttaatatattatactgtcactttttctctgctcaatattgttttcctgagattcagccacattgacgtaatttattcatttttattactgtaggactccacctcacaaatctaccagacccattcgtccattgtagagaatgaaggaagggtaagggaaaatcattctggagaaaggaggaggaggttagtctggtgcttagggctaaggagttggaaaaggatgggatctttatttaaatgaaaccactgtcagtactgatgtacttcaaggtctagagaatgagatgtagaccttcaactggtgggtactgatggacatggagactgattccagttttttgtaactattactgagttgatatgaacagttgtgggtctcttgtacactccctaccagtagaatttctgagttattaaatctgcacatcctcaacctaacttgatatttccaaattattttccaaattgttggactgatccacagtggaatagtgcgtttcttgatccataacctccacagctgatattgctggactttattttctaagtaagatgggtgataaatagcatctcatggttttaaatttacatttatcctattattaatgggattaagtatccttttgtaagttttttactggccatttaacattccttttctgtgaattgcctatacaaggcttttgtccaccttcctactggttgcaatacagatttattttgttttggataggagttatttatagtctctgaatattagtcctttgtcaattatatgtgtgttattaatatttttcacagttaccaggcttgttttttccatttctttctggcatctttgatgaatatgtacttaattttaagtagtttattaaccttttataaaattgtttgcacatttttgtcttaagaaatcttcctttaaggtcataaaaatattagcccatattattttctaaaagctttagtttttaaataaaaaagcttttaaataaaaatgtcttaactgtgcaatttgtgtgtggtgttaactagaggtccaatttttttttccacagggataaccagttgcccaagaaccacttgaaaggttcatctttttcccacagatctgaaatgccagcctactattctgagccgtcagtcaatttcatgcctcagccgattccaggccacaggttacaacacatcaacacattgataagtcttgccagtgggtaagatgtatttccatatcttactcttcttcagtcccggctattaattggtttatttgctcttctgtatatatttttaaatcagcatatcaagttgaaatttttaaaaatctgttggaatttttactggaattgctgaatctacagatcaatattttttaaatgtcatttaaaaaatagacagccaatacgtaaatatggtatatccttccatttaagttttctccaatatctcataggttttgttgttattgttgttgtttttgaagagatggcgtcttgtgctatccaccaggccggagtgcagttgctgtcacagctctttgcagcctcaaactcctgggtttatgcaactgtcctgcctagcttcccaagtagctgggattacaggcatgagccaccatgcccggcacaggtacatttattatgctatttaaatggtttacgtttttaaattactgtatattacctatttattgctcacgtatacttcttttcaacagttttcgtatcctgaaacctgccaaattgttactaatatcctagcaatttatctacatttttgttttcttcctttccaaaattcacactttttatttttctttccagctttatcactgcaactagaacctccagtacaatctaaagtagaagttataacacaatgagcagaagggtgtgacagccattcttgccttattcctggctatgaatagagaagttttaacacttcatcattaagttcaatcttcattttaggttttttataaatatcccacatcagattacagaagttctcttctgtaactacattgcaaagaggttttatcacaatagatgttgaattttactacatgtctttatatctgttgaaatgatcatgattttcttcctttaatccattaatatagtgaaattacatgttaaaccaatcttgaattccttgggataaactcgatttggatatgaataatcatctttttatactatgctgaattgtttgttaatgaggatgataatttttgcatccataatcataaggttggtatataattctcctatattgtactatccttaacagacttttggtatcaaagttatgctatcttcatatgatttggagaatactgccgattgttgggtttttctctgctatattttgaaatggtttaagtaggactgaaattattctttgaatgtttggcagaactagagagttaaaccatctgggtctttactttatggaaagatttttgccagccaattcaatttcttaaatgactatagaataattcaagtttcctatttcttcttgactccattttagcaagttatgttttccagacatttttccattttagcacttttaagtttactggcacagagttgttcattatatcctattattaccttattaacttctgcagcatttttctttctgggtatcacatatttctgcctcctctcttttcttcttgatcatcttgctggtgttttgtcagttgtgttactcttctttaaagtcattcattcaaaaatatttatttatatatactatgctttctatatgtccaaagtacagtgagccacattaggaacattaccaggtcaaaagtgtcaaatgttcctcaacaatgtcaatgaaaaacaaaacaaaaaagtttcctagtcaagagaatcaaaaattgtctatattgctagtaattgtttaaattaataactttatatttttagagcacctttaagtttacagaaaaattgactgaaggttcccacatactctctcctcccacccacacagtttcccctattatatctatcttgtattagcatatggtgtgatacctttgttacaactgatgaaccaatattgatgcattatgattaattaaagtccatagtttacattagggttcactctttgtatttgttagctgggttaatcttttccaaaaacaaacttctggcttcactgatcctttctataaaatgtctgtttactatttcattaatttatgctttactatttcctttcatctacttacttcagttttgtactttctctaaattctcaagtggggaaaatataagcatttcattatttcactcaacctagttttcttcagcctcctctagatagtatcttgggccagcttccctcccaacccacacatcaattcccaaatcgatcttcaagtctattgggtctaccctgtggattcaattttgcttctccgtctcctcttctctctattctctgtcacctgataaaccctattgatcatatcctaaattcattatggaaacgaatatatctttatttttctactgccaagtaaattattccaagccctttcaactcatagctacaaataaagatctctttaattttatttcctcaaacgctattttcaggctaggtgtggtgactcacacctgtaattccagcactttgggaagtcaaggcaggaggattgcttgagcccaggagttcaagatcagcctagggaacatggcaaaaccctgtctctacaaaaaattagccaggtgtggtggtgtgcacctgtagtcccaggtacccaagaggctgaggtgggaggatcacctgagcccaacagggcgaggttgcagtgagccgtgcatgatcacaccactgcactctagcctgggcaacagagtgagatcctgtctcaaaaacaaaaaccaaaaaacccactattttcatcacaatcctcaggcacaagcagctttcctttgatacttaggttaacttttaaggtcttctataatcttattctccctgccagtatgttttctctgtcactagtctctaggcaaacactccactcaaatagagcacaacacacaaattagcctttatccgtcttatttcccactacctggtagcttttctgtcttctcctcaaaccactcaactcattcacctacaaagaatctcttgcgctgtgaaatcttccacaatggtgtatcatttgcttgctgcaaaaactcacttttgcacttaggataaagcaatacaaagcaatacagaagtaactatttttctcctcagcatttttatcttgcaaaatggattggcagcttttagacgcaagaattatgttttatacccttttggatggctgaagaacacagaaaatggttcatcacattgttgatagctaatactgaaatgcaacaagtatttataaaataataacataccttgcctgctaggcggctggagatgattccattgctagatataagacagtcagccagagtagtttttcctgttaaaatagcaacatcaattcaaatctatatcttttttaaaaggggtcatggatcatacctatagatttaaaatctggtcataagaattggtttagtaaagattttctatttacctatgctaggtgacaaaagagatttattagacttttgaacagaatatcatctggaaggacacagaggctagcactctataatgctgtaatcttatctccaaccctgtggatctactcaacctcatctgaaaagttgtcaagtaactttagagaacatactcttttgccatatttccccatgcatggcctcagctggaatttgctaaactgtcttaagaaaatacttacttatcaaagaaattcaggaacattatccatatctcttactgtttgtaatatagcatgtggagggcataaacatactgtaacaaccaatgaaacctagtatccaaatctaaacctaggaatctactttaaagcaaaagaatcttcgaatatatttatagttacttttattaagcagactacatacaactaaagtctatgagattttatgtgatataaacaggtgattctgtgtaaagaatgtcaggggtatgcataattactacaactgggttggagtaagcaaaggagggtttttttccttcaagacaagtctttattgcactttaggaacttcagcaaagctatggaatctctgtattgttcaaaccagagaccaatgagtaggagaactgaagatatttaacactgctatctgtctgcaatgtaaatatgtattagcatataatcctagagcatcactttcctgctacccagtaaagctgaatttattctaagtacaccaagtatatacctccctagaaaataattatcaagcaagcaggaactttgctttattcacagcagtatccctaggaccagaacaacgcttgtcatatagaagaccttcagaaaatacttgttgaatggatgaatcccaggttttttaggatagtagcagcttaacataattttaaacaatacatttaaagtaatttgttacaccccactaactttccacttgaataaattcataaagaaaaaaaaaacccttttatcagccttcacattctcaaaatgtgagcagtaaaattataaaaactcatggaggcaggggttactcactggatttgtactaaaactcattcacagctggcttcacttgtaagtgatccactatctgtctttctgtcagtttccatactcacattacttcagctcttctatcaatgacaacagccacctaatctctgactttggatccatcctaagcatgtctaccaatctaatctttctcatgttttatttgattacatcattcctgctccatgttttcccccaaaggctccctactgcctaatagtagacattaatgatcgttttcatggtgaagcgtttaccttccctctcattattatcacatttaatcctatagcctataaagcaggtatagttttcatcctgttttacagatgctgtatattgaagctcaaaaaggcaaggtatgtaacttgaaaatggagatctgaacttaggttgtctaactccagagctggagcactcaactcttatcccagttcctagctggcatgagcagctctatgagatatgactcagcctgcttcttcacctcgccaactggtccttcatcttcaggatggtaaatatgttttatttcatatgcccatcccaatcactttgctgtggttacctaaactaccaagaggtttgaaatcaagaggaggcttagcatgaaggagcgctatggagttacagcagtatctgtcagaagaacataccatgggttagctatctctgcctttcccatatactgggctttgaccacatatatttccctctccccttgatgacacattcccacctgtaatgattatctccatttgtcatcttgagcccccttcaagtgtcatctctaatactaattatgttgtgaggtcttttcctaacccctcacttcctaatcctctagttctcccaaccttagagtctacttttttctcttgtttgtctcattttgctctgctccccgttaaaacctcccctgggctagtgccctactcataaatctccaccttcagacatactaagcaaaatatcttgaacttaacagacgtttgataaatatctgatgaattaaataggatcacataccacagactctaaggacattatgtcaagactacagacattttatatgtaaagccatttcaaaaacaaaaaattcaagttctgctttaaaaaacaacatgacataatatatagaagaatgctactcactaggtaaccgtgttcatttcaaatgctttatagcaaagcaggcttccctaacatcacacaaaacttttaaagaaagaagacttgcttcttagcaaacatcactctcagctgtccacagcttcactccactgagacatacagagacacatctcccttatttatcaaaataagccatttaaaaagtattcttaccatggtcaacatgagccaaaacacaaatattcctgatgttggcagtgtttttctggagttgaatcatcttatccaaactgttgagcaccatgattacttatttcctgtgactaaaaattaaatatgtattacaaatggcccagaggctaaaggtcggggcaaaagaaaaaaataataataaacgctgggaggtggcaagcttctcaaaccccttaaaccaagaacccagtgaatgtttattgatgagatagaccaccaaggcctaagtccagttcgagcactaaagtcagtatcctaccacgattacacttaaggagtttgctcatccttccggatccaaaggctgcgatgaatcacgcagctcgaggggactgggtgcacagtgacaccagtaaccctgccggtggaggagtactccagtaaacatctccaggccaatgaccacgtacaggaagggttgcatccaggagggagagaaaatgctgaagaagatgctccctttctctcttcagtcttcccccaagtccctcattctgacattctcgctcgtcctcgcgcgaggtcaaatacccagctttattcctgcccatggagcccgaacaaagttttgggtcacgtgcttattatccaagcaggtgcactgccggtctttcattcctttctaaataaaaaggaaaaacctctacactacatgcccttcatttctgcagggtcccagattcgttctctttgaggatcctgggtccacacagacaggcgaccgccccggccccagacgggaagcggcactccggggaccgaagctcccagcccgcgctcggccccagcccctgttcccgcctcagagccgcagcgagcgggttcctccggcaccgcccaaaggctggcctaggaggttccagcccccagcgccagcccacactcaccggctgcagcagccccaccagccccgctccttctctcgggtcgcacccacaccgagagcttccgaaagtccgagagctctgcgggtccgacacgcccgcgcgccagggggcggggccggctgtcgctcgacctttcacccgcacgtctct

SEQ ID NO: 1907 - DNA, 132545 bp, Homo sapiens; identical to SEQ ID NO: 1906

SEQ ID NO: 1908 - DNA, 22117 bp, Homo sapiens
gttgccttgactacggcgggcgctgtgggagtggagaagctgcaagtgctgaggcgcggtggaggaaagcatgggagccaagagtatgaggagctggtgtctgtgtcagatttgtagctgcgggtaagaaacggctggtgtagcggcgggcccgggcttgggagccgacctagggcctaggtgcacggagccggctcctcgggaaccctgagagtggccgtcccccggagatgaagggacgagggcgcagcgacatccccacttatcccgctccgcgaatactcgctcctcacccgcctgctacccgggggtaaaacgtttgttcgtagcccctgagactcccaatcaaggatgcaaagtaaaatgccacccgggccaggtaagtaatatatgtgaagccgcgacgggatataacgctggtgagtagtgggatgtgatccgactgggagagtgcatttccaccccataatcccccaccacgaagatgagaaagaacagtgctcaaggccctgagtctgcaacccatatcacattttctttcatctgtagctttctgtcctcccagccagaccatattcccattcccgtccaggcagcagttctttgggatccgcctgactgaaaagtcagtaagtagtccctaccctgaaatctagaatccaactgtgagtcctgcctaacaaccttccatcacctgtaaacacagtcctctccttcctcagcttcactattgacccagggattagatcattatttgctaagtaaatatgaacgttgtcaatccctggtgtatttgtaatcccattcaaagaaaacacctacatgttgatggaaagcagtttttttaatagtctcataataaacacagttcataattatatatagattaaaatatcaacaaattaactttgggtgtatgaatcctcagactggtgtgcaggagaaaatttttacttttctcctaatttatattcaacgcaagttcctttctcattcaactgtaaggaaattcagtcttcattatgttgagggccaccattggaatggcgtgattttacttcttgtttgtttgttttgggctgtggttgttagttttgtctttttaagggtttatttttattttttgacaatgcaataaatacacaagaagtatcataaaaatctaagcaaaaatatctataatattgtaaaacgccttcataattctatcttccacagataacaaatgttctttaagacttgttttacatatgcattgatttttttttttttttttttttgagacagagtctggctctcttgccaggctggagtgcagtggcgcaatctcggctcactgcaatctccgcctcccgggttcaagcaattctcctgcctcagcctctctgagtagctgggattacaggctcgtgcgaccacacccagctaatttttgtatttttagtagagacggggtttcaccatgttggcctccatctcctgacctcatgatctgcctgcctcggcttcccaaagtgctgggattacaggcgtgagccactgcgcctggcctgcattgatttttttttttttttaacaaaaaaagagaatattctgagcatactattctacaatccggttttttactatttacaatctcaccaacttccaatgatcatgcataaagaccaccctcattctcttaaataactgtatactattagcttatatgatatattggtcaaggttcttagttgtggataacgtaatctcctctggttagtctaggcaaaaaggaatttattaaggagtatatatatagttcacttggaagaacttaagaaatcattttcaaaataagcttccacaaaaattttaccacagaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctctccttatgtagctctcttctgaatcaaagtatcatgtgaatacacatagtaggtgaaacctaaattgtatgtggaacctttctgcaagagcatgggaaattccctattagcttttcagcttctatagtgtaagaagacactaaattgttatgagacacttaattgctgtgcttccaccacatagggatagaccattatttattgattgtttttgtaaacaccattacagaggaaacagtttttgggggtttttttgtttttagttttttgagacagagccttgttctgtcacccaggctggagtgcagtggcaggatcttggctcactgcaagctccgcctcccaggttcacgccatttccctgcctcagcctcctgagtagctgggactacagggtacccgccaccacgcctggctaatttttttgtatttttagtagagacggggtttcaccgtgttagtcaggatggtctcgatctcctgactttgggatccgcctgccttggcctcccaaagtgctgagattacaggcgtgagccactgtgcccggcccagtttttggttttttagtaaagctctagaatttagaaattgtgagtttattagaggtctctgattaaaacgcagttataacacaaaatttttttaaggttaatctttcagtttattttttgcacaggcgacatcattgtccacgtggaaccacaaggatttatgaaaattctggggtgttttgccctacaactgaatatttggaaaaatatcctatgtatgacaatgttcttccacctcagagtcttaaagccaagcaagaaattcgagcatgccatggtaaaatggaaggaataactacatttaagtaaatatttagtaactatttgctttacttatttttctctcaactcttctggtgtcaataaagttttctagctatttaaattgaactgttcagttgatttaagttgaaccaatctaatagtcaagagactagttaagtcacaacttgaaaaaaaaaaacagaaaaatgagaattaagttaggttgacaaagtgtgagaagaaaaaagggatataaaaagttctatttttttttaacttcttaaaatatctcatatttatctactttccactgtcaccaccacctagagtagggtgtctaatcttttggcttccctgggccacattggaagaagaattgtcttgggccacacataaaatacaataacaccaaccatagctgatgagctaaacaacaacaaaaaaaaaatcacaaaaaaatctcataatgttttaagaaagtttacgaatttgcattgggcctcattcgaagctgtcctgggctgcatgcagcccataggccgcaggttggacaagcctgacctagaggaatgcagtcactttctaagtataatatctgaatctactctagtttttgcagtttgatctgttttcaatacttcagcctgcccaaataattttaaaatgcaaaccaaaccctatcacttctctgcttaagatactcttaaactttcccattatctttaatataaaccagaatccttaccaaaatcatgtagaggcatggtttgctcactatttacttctctaattcattttcactgtagtgtccttttcactcttttatgctccattccatgggccatttttcatttccttgaaagtgccaggtttcccttgtctcagagtcttccaagatactgttttccctacctgtagttttccttccctctcctagctaatgctcattcaatctatagatctcaactaaattatcacttgaaaaagccttctctgagacttttcagattaggtaaaattcttctatgtaagctcccaaagcaccttcctgttatttatcattagattagtttcagtgtttcatgaaagcaggaactaagtctattgttatctcagcattctatttttagaaaacgaatacaatgcctactagcacatactaggtacccaatatttgttcagtgagtgatgaacaaaaatcctcttaagtctatacttttcatttggacttaccttttttgatctctgtatttttgtcaggtggattaagtattacatttactcattattttatttaaactgttaatgtatgtgctgtattcaaggtacaatcttagtgttaagtataaaaatgtcaagtttgtgaaccccaaatatctgagataggtgtcagttaatttagaaagtttattttgccaaggttgagggtgcatgccagtgacacagcctcaggaggtcccaataatatgtgcccaaggtggtcagagcacagtttggttttatacattttagggacacacacatcagtcaacatatatgtaagatgaatattggttcttccggaaaggcgggacaactggaagcagggagggagcttgcaggtcatatgtagataagagacaaatagttgcattcttttgagtttctgatgagcctctccaaaggaagcaatcagatatgcatttatctcagtgagcagagtggtgactttgaatagaatgggagacagctttgccctaagcatttcccagcttcacttttccccttagcttaatgattttgggactccaagatttatcttcctttcacaagttgaagttcctgctttcagggaactcagacatcatatttctataatttagggttttaaaaatgctctgtaatagctttagattttggtgttagttattttcatttcagatgcagctcattcttatatagcaaaggtggagactttccaacttttagtctaatatttatatttttaacatttcaggcattccttgcagtaataatattttggtgactctagttactagtgtaggggtatggctcttccatagatggaagattttacttagtcctcagattttggtatgcagtagtgccatctagaagtgttaaaattgcagactccagagctctatctaaaagagccagtagataatagagtgggtctcaggaaactgcatttttaaccagcattggtggtgattctgttgccactgattgagtgcagcaggtcaggcactggactgcttaatgaggatgacatggaacataaaacagagaaggtctttgctttactgttgtttatagtctgtgggaaagtccagaaataaaaatatcagctaaataactaagataattatggattatgataaatgagatgaagaaattgaataactggttgagattgattaaatgggaatggttgttcttttttcttcactttaatttattaatatttttttcttgatgccttaatggttcatattagagatttgaaataaattttacaatatttgtgtttattgaacaaagattttgcttttaaccagttctaaatgtagaaattgagaaaatttaacctgccatatctttcttttaaaaggctttccaattctggatttcccctgttgacttattcaagtaagccttaataatttaaaaaacaaaacaaaacaagaaatgtcccaaaggtccatatatgccagtaaaactaaaatatttgtttattaaagtgtcatctcttcacttagtaagacatcggatcttttctttatattttcactgggaaactagcagtatttctaagagtcataatctaggagcttgaaactcttgcttgactctctcatgttggctgtgttgactaggcagtagaaagtggatttatctgtacaaacaaagaagcattctgtacctttgtatagtacaggaagtgactgtgtaaagaggtgtctgaacttgtacaagattttggatcctttatagcagtacagttgtagctcacttagatgactgccagagttggcaggaagcctgccctgaacgagtaggattctagacacatcaaatgtttcaggatatatcagatgaataagactgcattcaccctctactactactccatagaaagctgctttgggtttggaggcatactttctgacacttaaatagtctaaccagagaaactgggacttctgagcttactctttgcttttcccttcctgattctctcacttcctgactgcattttagcctattcccctctagttcgtatttgggaagagcaaagaacaactcagatgtcttgacaagcagaggtatgtgatttctactactcttcatccattaaataaaaaattattaagcatttattaagcatgaagcactatactagtcacctggtatacagtggtgaacaaaagcagtcatgatctctgtgctgacagatattacaatctattagaaatggcaatcaaaacattactcaaaataactctaaaactgcaacagtgataaaatctatgaaggacaggcacaggtaccttgacaaccagaccaagagtttgactttatcaggggaatgagaaaaatgagtcaaaacctgaaggatgtcaaattaactggattaagagggggaaggaaatgcattccaagtagagagagagagtagcttgtagcaggaaggagcatggaaaggagaaaattgtcaaagaaagccaggtggagcagagaaagcaagaggaaacaacggtgagagttgaggctagtgaagaagaccaggcagagcctttaaaccatgttcagtgttgtctatgtcctacagtaataagaagccatgaaggtttttctgttttgtttttttggtggagggtggagggtggacttggggaggaagaaaggtaaggaagaggctagggagatgagggcaggaatgacttgatcagatttacatgagaaagaattacttcaggtgccatgtggagaaaagattggagggagaactaaagtggatgtgggtaaatgagtttcgaaagttattaaagtgattcaaatgagctgttgcaaaaactttgcatattatggtggtggcagatgtggagaaaagtggttagatttgagggatatttatgaggcaaaattgacagtagttgatgatggactagataggggagagaattgaggtataaagggtgagtcctagatttctgactatgcgtctgaaaggatggtgatagtgttcacttaaatagagaaaaagcaaaaaggaccacatttattgaggggaaatagcgagttgatttgggacgtattaagtgttgagttgccatcgaatccaatggcattgaatccaagagaccatcatagatactggtatgaagctcacagaagaggtccaagctgagatgtaaatttgagggttatttcgatctaggtagtgatctaagttgtgggagtagaagagttatcctcaggagtgaacagtggatgagaagaagaatgtgtaggtaggtccaagtcttgaggaacgctaacatgtatttaatgatggagtagaggtagatgaagctacataggaaactggaaagaaataatcaggaagtcgggaagagaaagtttcctagaaacagacagtgtgcacaataatgtcaattactgttggagaggtcaggtaagatgaggactaaaaatgttcgatgaatttaatcacatggaagacattgtgaactttagagctgtattagggaagtggcagtgctggaaaccagactgaaatggattgaagtgggtgagaaaacagttaattagtctaagaagttatgttgtgaatagaagaattcagtgagggttttgggtttctttggggaacttacagacatacgcagcaaatattggttaatacaagatagtttaatcacaaaatgagtcacgtgtcaatagagtccagaagaaaaaagcaatccctgaagtcttggggtagtaatagtggtggctaccatattgatcttactatgtacgaagcagtcttcaaagcatgtgtgtatatccttaaaacaactctgtgagatagaagatattattgttccattttatatataaagaaactggggcataaacaggttaatgaagttatccaaggtcctgcagctagtaaatgacagaaccaggatttggacctaggtggcctgatcagtctaagtttgtggtcttctccattcctcagtttttacctcagtgtctgcagtactacctctgtcacataatgttacatagtacccaggttggctgcgttaccatctggcatccatccatgacaaggacttctgggagatccaaagattaggaacactcaaatctataatctgaatgtgatttatgtctaaagaccagagttactaatcatttaacaataagcgagaaaacagcatgaattcaaaaagaagaaagtatgccaaaatagtttgctggagactgtaagtaagatgaataaggactttgacaaagtggactcaggggtaatatattttttaaacttttcaggtttagtaaattttacctgaaatttccttccaggttagaaaaaaaatcaattacttgaggatattatttactgaagatccgattaactgagatctattgtaatgatgttttaaaaactaggatttttgatatatttacttttctcaagatatttagtcactggataggaccttataagaaattcagttacctctttcaagtagtttatcaactattaccattttaatatcttctcagacttttccagtaaaaaagaaaaaaaagccttgacattttccatacttcattgaaataattaggaataaaagaacttgtgaggctatgtttcaaatttatatatttcaggtcggattattgtccttatgaaatagttaaacagcctcgccatgtgccagaagaatataaaccaaaacaagggaagattgatcttggtactacctacaaacgggatttgaattcgtataaagtgcagcctgtggcaatagtccggcctttggagagacaagttaaaaaaggaaaattggacactgtcccaacctataaaggtaacttgctgtttcatacatgaaggagccaaaaaactaaaactcacttccagctttaacatctaatatcaaattataactttggtgtgctgccaaacttagcctccatggcttaggaaagaacatttctctctttggcaaaatagtattgtatagtaacaaaagaaaataggccatttgtctgattgagtggtaaaagacccacaatcccatccaaattcatctactttgttagttttctgtctcaaaacatgaaaaacaaaggatgccattaaagaagcattatgtcacatttgtcactttgtgtcacatttagttggcattgttcttttcttcccatcctagaaaaagttgaaactctaccgagagtattgggatctttgaggtcaaataaatagcaatgcttttctccattcaagtcctgaaccaacctataaagcaaaagagttgccagatggagaagcaaaatactgcttttacactgataaaggacaaagtagagaatgaacttttcatctgtaagcagacgcttcctgatactgaacctcagaattagataggcttatctaccccatgatagacagtgctagactaccacataggggtcctgctcctctaagaattctgggatggtggaagggtgagaatactttctctttgcaggcaactgacttagaggagtacaagttgggccatgtatgcttttctttccaaaaacctgtttttttgttgttgttgttgtttttgggttttttttgtgacagagtctcgttctgtcacccaggctggagtgcagtggcacgatcttggcccactgcaacctccacctcctgggttaaagcaattctcccacctcagcctccaaagtagctgggattacaggtgcacaccaccacgcccagctaattttttgtatttttagtagagatggggtttcaccatgttggccaggctggtcacgaactcctgacctcaagtgatccacacacctcagcctcccaaagtgctaagatcaaaggcgtgagccaccacgcgtggcccaaaaacctgattttaaaatactctagtacttttgaggaatggggtctttgttttttaaacacaggctgtttttttttttcaagatggagtcccactctgttgcccaggctggagtatagtggcgcaatcttggctcactgcaacctctgtctcctgggttcaagcaagtctcctgtctcagcctcctgagtagctgggattacaggcacccgccaccatgcctagctaatttttgtacttttagtagagatggggtttcaccatgttggccaggctggtctcaaactcctgacctcaagtgatgcacccacttcggcctcccaaactgctgggattacagatgtgagcccctgcacctggcctaaaaataggctattttaggcctattttgattttgatttatgatagtagatattacttttatatctttttattaataatgtaattacatatataggattacatttttccattggttatgtaaaatagctgaatggatatgtcctaatataaaacacttttgtaagagtgataccatcaataatcaaagtaatgattcatactttatttaggtaatagttaaatgcctattttatctttaaatttcacgcctacccattcaacgagtaagtaaagtgcaggatatcaatatgctttcatctatcagcctacctattagggaggtcaagaaaatgttttttctgttttttaaatctttgagcacataacatactacacaaagaacaaattgtgaagactatgtgaatggtgaagaagtatattataattaaatgtagcatagagtaattgctgataaatagattgatatgcgtaggagaaaatgtactgtgccaaatttggcataaataataattgatgaaaatgaatttgttctttttttgtttgttttttgagattgagtcttgctctgtcacccagactagagtgtagtggcatgatctcagctcactgcaacctccgcctcccgggttcaagtaattctcctgcctcagcctcctgagtagctaggattacaggtgtgcgccaccacgcctggctaatttttgtatttttggtagagacagagtttcaccatgttggtcaggctggtctcaaactcctgaccttgtgattcgcccgccttgtcctcccaaagtgctgggattacaggcatgagccactatatttggtctcttatacaatcacagtaagattttctttttttctacaagatccataagaaaaataccagtaatactgttgtccccgatgctgggaacatgtacacacaatacacgcacacacttataccaacactactagctttccatgacctgggtttcctgtagattctgatacttccactcctatggttgtagttcaaggataaagaattttgagttcctctggcattctcactactgaactttcttagtcaacaaaggtgatattttgtatttcagattttcaggcatgagacaacaaaaacactaagagccaaggttgtacttccacactctgtatgaatgtgctgcaggttttgtagataacctatttaaaaacaattctacagctgaagagaagccacaatgggaagatactctcactgtcctcctttgggaggccaaggcgggtgaatcacaaggtcaggagtttgagaccagcctggccaacatggcgaaaccccatctctactaaaaatacaaaacattagctaggcatgatgatgggtgcctgtaatcccagctactcaggaggctgaggcaggagaatatcttgaacccgggaggtggagttgcagtgagccaagattgcaccactgcactccagcctgggcaacagtgcgtgactctgtctcaaaaaaaaaaaaaaaaagtatttgaaataaataaaaatagagacacaacataccaaaacttctgggatgtggcaaaagcagggttaagaggaaagtttataatgctaaatgcctacatcaaaaagatagaaatatctcaaattaacaacctaacattgcaaccaaaagtactagcaaaataagaacaaactaaacccaaagctagcagaagaaataattaaagtcagagcagaactgaatgaaattgagaccctcaaaaccatgcaaaggatcaatgaagcaaaaagttcattttttgaaaagataagattgatagaccactagctagattaacaaaaaaagacatccaaataagcacaatcaaaaatcacaaaagtgacatcacaattgatcccacagaaatacagaagatcctcagagaatattatgaacttctctaggtacacaaattagaaagtctagaggaaatggataaattcggaaacacaaattcccaagattgaactaggaagaaacagaaatcctgaacagatcaataacgagtaaggaaattgaatcagtagtaagaaacctatcaaccaaaaaaaaaaaaaaaaaaaaaaaaatgccccagaccaaatgggttcacagctgaattctaccagacatagaaagaacagctggtaccaatcctagtgaaagtattccaaaaattgaggaagaaggactcctccctgactcattctgtgaaactagtatgatcctgataaccaaaatctgacaaaaacacaaaaagaaaaagaaaactacagaccatggtccctgaacacagatgcaaaaatcctcaaaaaatactagcacactaaatccagcagcacatcaaaaagttaattcaccacagtcaagtgggttttattcctggtatgcaaggatggtccaacatatgcaaatcaataaatgtgattcaccacataaacagagttaaagacaaaaatcatatgatcatctcagtagatgcagaaaaagcatttaataaaatccaacatcacttcatgataaaaactctcaacaaactaggcattgaaggaacataactcaaaatagtaagagccatctatgacaaacccacagccaacatcatactgaatggacaaaaaaccggaagcattccctttgagaactggaacaagacaaggatgcccactgttatcactcatatttaacataatcaagcaagagaaagaaaaggcatccaaataggaaaaaaggaagtcgaattatgtctcttcgctgacaatgtaatttatacatgggaaaccctaaagattctgccaaaagactcctggacctaataaatgacttcagcaaagtctcagcatacaaaatcaatgcacaaaaatcagtagcatttctatacaccaataatcttcaagctgagaatcaaatcaagaacataatcccatttataatagccatacacactcacagtacctgggcatacatctaatgaaggaggtgaaagatctctacatggagaaggaaaccatagactacacaaatgaaaaagcattctatgatcatggataggaagattcaatatcattaaaatgtcatactacacaaagcaatctgcacattaccaatatcatttttttgcagaattagagaaaaactattctaaaatttatatagaacccaaaaagagcctgaatagccaaggcaatcctaaacaaaaagaataaaaccagaggcattacatctcctgacttcaaactatactacaaagttacagtaaccaaaacagcatggtactggtacaaaaatagacacatagaccaatggaacagaatggagacccctgaaattaagccagacacctagaaccacctgattgtccacaaaattggcaaaaataaacagtggggaaattgtttatccctattccataaatgatgctggaaaaactggctaaccatatgcagaaggatgaaaccatatgcagaaggtgcaagaaggatctagaattttaaagccagcaaatctgaaaactgtgtatctagtaaaaatagcctttaaaaattaaagcaaattaacaatgttttcagacaaaaaaagaaaaagctgagataccttctacaaaaagcattaaaggaaattcttcagttaaaaggaaacttattccagatagaagcatgaaatgcaggaagggatgaagcacacagaaagggtacatatgtgggtaaatatgaaagaatattgacaaagtcaaaattactatattatgtttttacacaaatataaaagtaaattatgttagaacagtagtacaaaaggcaagaggatttaaatagaattaaattgcttacaggttcttccatgctagaagtggtaaaaatatccatttaagttggagccagaaaaatctcataataagtcaaaaattcatttttatttttaaaatatagaaagttaaaatagtaaagtggaataatacaaatgccatttattaatacaaaagaaggcaagaaataaggggtatgggaacaaagaagggaaaagtcaaaagcaaatagcaatacaatcaacttaagcccagctagatcattgcattaagtgtaaatgaacaaaatattgtgattaaaattcaaagattgatttttcacacattaaaaagatattattttaaaaaatatgccaataatttacaacttacataaaatggataaattttttgaaaaatacaatttaccaaaagtaacccaagaagaaataaaaagtcaaaatagccctatatctataaaggaaattgaatttgtagaattgaaggtgtaattttaaacctcaccataaagaaatccagaatattcagattctgtgtaggatgcagaaggctagaaagattatgttgccaacataacaataagaaaaagccagataatctacaaaatcataaatgtttatgaatcctttagaaagctgagatcacaggttaaccaattagcctgacatctgaggagaaacaacttccacccagttgagacaggaggcaagcactgtttcacccaaagcagggcatggaatgaagactagctgttacacaagtgaataaaataattcattacatctttaattgctaaagacttgagtatgagctactgcgagagtatagaagctctgagaacttcagacactaaagggagagttcaaaaccactcatagactcttccctatggatgttcactgtgtgatcatgagaaagattgggagaaaggctggagaccacagaaagtttccttcatagtgcgggcatggagagaaaaatggttgtttttgcaaaagaaaaaaaaaagcaggaagctccatttgaatgcctctaacctacagagcaaaagcattaatccactgcaggaaaggcaccactctgacaaccccaaggaataggtgaagatgtattgcaacttgatgaaagacaaaggaaaaacaagaagaagaagcaaaataaaaccaaaccttgaacatgaagaaagaacaggaaactgtcttgggaccaacaattagagacctactacatcaagtgaaagggcaggtgctctgagagagccctgcttctgagacccaggggcacagggcctgcctaagattgaagctggactgggacaacagagaaaccaccacacacccgctttccatttctcaaacacaagatcctaagcttcaaatatacaaagcagcaagaatttatagtactaacataagaaatgtgaaaatatgcatttgtagttggagacttcaacactgtctctaagtaatctatagaacgtagacaggaaatgaatatggatataaagacctgaacgacactatcaacaatgttgtccaaattgacatttgtaaagcacttctgtcaacaataacagaatatacattcttttcaagtgcacttgaaagcttcatccagataaactatattcagagtcataaaaaaaaccttaacaaatataaaagacttgcagtcgtgcaatgtgtgtttttgatcataacagaattaaattagacatcaataatagaaaaaaatgtggaaaatctccaaatatttggaaattaaacagcaaaatcctaaataactaatggctttaagcaaaagtaacaaaagaaattagaaaatattttgaatttaatgaaaatgaaaatatagtacatcaaaatctgagagatgcatctaaagcaatgcttttcagaaaatttatagcatttaaggttcatattagaaaagaaagtcttaaatcaatagtctaaaccttcattgcatgaaactagaaaaataagagcaaattaaatccaaagcaaagcagaaggaaataaatgaggataacagcagcaatcaataaatttgaaaacagaaaaataatagagaaaaacaatgaaaccaaaaattggttctattaaaagataatgaagttaataaatgaaaagagagaagacaccaattacaaatatcaagaatgaaagagaatagaccttatagacgtttattttacattgtggcctcttcttttttctttttcttatttttgacaattttatcaggttgccattcattccatatttgcttcaagaaggaagacattaatatttagaaggtaatatcaacagtatttgaaaaccacttgaaaaggagagaaggaaatgagggagagaaagtcaattaaacagaaccttagcctgagatgccaaattcataatagaaactttgttgatgtgttattttctggggaatgtgagtctgagtgagataattaattggggcatgctaagttttcatttatctgagggacatccaaataaagatgtctagtaggtggataaatatgtgggttggtgtttgaagggaggtctgaagtagggattcaagtttgggagtcaccaccttacaggtagtattaaaaccatgggagtagattggtgatatgtagattgaaaaagctgaggccgaggatgatgtccccttactttctaaaagtagtttccaattcctcggtaccacaagacaccacagggagcagtcccaagtaccaggaaaaagaactagcataagcaactcaagacttttgtcctcaaagaagaacctagaacagctcactatattaaaatggggttggagctgtgtatacaaatagtgggcaagtgcatgcaggcacttcttggacttaaacctgttcagaagagaataaactttctaaccagattttagtggctagacataaaaagtgagctgaggaaacatctaacaagggcgatagtggagctgccacataaccaaactgtattgttagacatggacagcattgttttcttgtttttccataagtatcataaaacactaaaaacagatgataatgattatgatgttttaaagatactgctagaatgttatcaaatattccataacagataataaatattccaggcatatgagcataggcatatttatagggagaaaatcaattttctgcaattatgtagaacttacattcatactattgtatgctatcacatccatctctcagtgtccaaattcttgcttccattttgaaaaccaaagctggtttggtgagggagaaatattctcttctgtttactctcttataatgaaaatcttttttctcttgtgtggtagcaagaattctccctatatgattgtgtggaactataaaccttcaataacatctatgattccttttagctagtgaaaaatagtgttatacttttatactgtagtttgcaaagaagagagattccctcatggtacctcaagaaaaaaaaaagactctggtaaagcttcatgtgaactgaaaatggaaagctatcaggtgcccagggagcttgaaggaagagcttttcccttcatctctgcaataagctacatgatttctctcacagcatcttcacttcccttcactcatctgctctgattgccactttactaactggccacctctgcctagttatcatttctgtttctttacaggtctattttgaatgtaacttcagctttccatagctcttagctttacctcctggcatccttttcaattctcccatttctatctcactcattattttcaattttaggtttacaagaataacaatgcttgatctagctcatcttttctgtcagtttgtcttaaaggtctctgctggcctaaaggtcacctattcttgagtcaggtacacgctctcatccagacatcagtaacttaatcatttagtccaatacttggccattttggcagaaatggatacgcattttttctcttcaaagaagatatccacataataagttttcaaagtttgacctttcctgtaaatattgcatagactttagtccagattttagtacattatcctgtgtaataaatttctatcttttataaattaacttttggtatttagaaatacatattttggggtgaagtcaattctatggtatttcctagcttactatcttcctcatggagaaatagaaaacacaaataatccttagttgaaatataaacatttcagttttagtgaagtgtactatcaccaacttgtaatggtgttacaagtcatcattctgcatacaccagagtgacccaaaatgctccacagtctaggtaaactgcaggagtaagcttaaggttatttaacttccaaaccccagatctctgctctgatggtcacttgaaattctacaatttcaaacacctctgaagacattcagttaaggcctctggcctctagatggccctctatcttttgggaatgccttaaagtccatttcatgagggaaagttgaagccagtgatctttctgggatagcacaagttaccctgtatctttgctcaaggaattctttctgtaggcttcctagagtataccagaattaaatttttctcccctttgatgagtctctccaaagcaaggagtaatacctgtattacttttgcccacccatgaagggcacttgattttatttcaagccctggcttttagacgtaccttagcattttgtgagttgtaattaaaatcccaacctcttcctaggaatacaaccataatctcctaaactctgtcctcacctccaacacagtccttttggctttcaagaactatccacaatcaggctcagatgtgcttttcctttgttatgtaatcagatgaatctgaaagtggaaagttacatgtattaaagtgaggagatgggtagaggaaggtggaaatgaagaaaaagaacgaatctgaaaggaatcagagaaactgtattctgatactattgtttagatttctaaaggaaatggaaagatgtttggcaatgagagaagtcagttatgatttttagaagatggttgttttcttcagcatttaaaaatgtttttgctttgttttaattttcaagacgattatagagcttgggaccttcataaaagtgaactttataagccagaacaaacttaccacccgcctactgtgaaatttggaaattcaactacatttcaggatgattttgttcctcaggagataaagcctaggcaaagctttaaaccctcctctgtggtcaaacgttctacagccccttttaatggtattacaagtcatcgccttgattatatacctcatcagcttgaactcaagtttgaaaggccaaaagaagtttacaaaccaactgaccaacgctttgaggatctcacaactcaccggtgtgactttcagggtctcattggtgaaactgcaaaactctgcagacctgtacacaccagagtgacccagaatgctctgtttgaaggaagcactgaattccgtgaaagttttcaaccatgggaaatcccaccacctgaggtcaagaaagtaccagagtatgtgcctcctacaggtagcatgctgttaaacagcacaagccatcttgactatgttccatatcaggccaaccatgttgttcccatcaggccagtttctcaaaaaagaagtaacaattttcctttccaaggaaaaagcatcatgaaagaagattttccagcatgggaaagttgtcgtcaaggacttattaagaagcagcagcagattcccaacccatctggaaaatttgatggtttgagcactttcagatctcactatgtgccacatgaattgatcccaacagagagttgcaaacctttaaatattgcttttaagagttctgttccatttgatgatgtaaccatgtactctgtagagtacacaccgaaaagacaggaaatttgcccagccagctatccctctcctccaggttatattttcgacaatacaaattcccaaggtcataaattcttccgcaagattattcctgcagtgaaggccttctaataaccaaaatgtgcttaaaaggaaggtactagcaagttgttgtttttccaagagaaaactcaatttttatagttaaaaaatttatgatataataaatcattttttatatttttaaacaagaaaattggaaaatatattataagaaatcagaatcttaaaaccattttttattgatattttaatcaagattgttctttaatgtgcatttcagaaggttgaataatatgcattcccatgagaactattttagtattcaacatactgcttagtagcttgtccccagtctattatcatttgtaattctgtttataattatggcaattgtatggttattcacataccatttgtcatttatcaagcacatcaggattatctagaacaacattgaaaatgatacatggattcctcttccaaggcaacaggattcattatactcagacttcacggcatctacatagcatccactgaatcaagttttggttggtggtatacagactgctgcactgctcctcaccatgttcaagttagcaagaggcactgtggtgtggcaaggaaaggctctgtgtgctgggaatcgaaggacttgagttcaagttctgactaataattattattatttttagagacagggtctcactgtcacccgtgctggagtccagtggcataatcacagcttactgcagcctcagcctcctgagctcaagtgatcctcctgcctcagcctcccaaatagctgggactacaagggtgtgccaccacacctggctattttttttaaacatactttgtagagacaggttcttgctgtattagtcaggctgttcaatctattggccaggctgctattgaatcccaccttggcttcccaaagcactgggattacaggcatgagccactatacccaacctgagtttaagttctaataatatagatttctatttgtactaccttaggcagtgactcatatctctgagcctcagtgtctttatttgtaaaatgatgtctgttctcaaaaagagtttgttttgagcatcagactgtatggtacattttaatccttaaagtacaaatgtggaggatttttttttaaaattgctcaatctctttttgtacttgttttctccttttcaaattaggataattacttactcaatgctcattttctggcctgtagcaaggattgtaaaataacctaatttgctttgagcttatgagtagtatatacttctgagaggagtcttgtcctttaaaacttcatgagcacctgagaaattcttaacagagaatggaaagcttggaatggggtaaatacagtggtttgaataacagtatttgcagaaaggaaaaagtattatttgctagggtagttttaggaagactgacagctctgaagaaatctttagggtaaatgtaggtaattttgcacctaattgccaggccaagtcactgtttagaggaagaaccagccccagcagggggcataatcacctggttcacctcttccggtgtgaagataagtgataaggtaaagaatgatgccagtaagtatagtagaaacactctattgcatttataaatgctaaaaatttccgaatgaattaaactcttattgggtggtttctttttttaaaaaaattaaataattgcattatgggagaatatgatttattttagcataaagtgaattttagtcttttatggcttcagaattatttcaaaatatactttattgaaaatcaatatttggttattttaattgttcaaaagtaatttgttctttacatttattagtaaaagtatggtgtgtgaaactatatttccatgcaacataataaaatcaataaaaggaatggattttcaagaa

SEQ ID NO: 1909 - DNA, 410691 bp, Homo sapiens
ggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggtaagggagaacctgctcgcctcacctttgcctctggtcactcctctctcacgtaccgggggagcgactgttcgcagttctttcctcttggcagctctgggagacccttctcagtttgccgggagccacctgcgaagctccccctcgcttcacctaagcgtcccatccaagaggaggaatcatgtggggttgggtggggagcgggacagccaaggctgagctcctgggaaactcagatcgaagtagaagaaccccttctagacatttttgtgcgtctgggggacttttccccttctcgccagtctctggtgcgcccgccgctccccactgctcttttcctgcttctgttttgcctccttccccagtttcttctagcttaactcccagcctggttcgagttaccgatattcgtctgcaccctctggccccgtcttttgcccagcgtggttgactatgccgggactgagacacggcatgcgttccctcggcatcttccgtacagcggagcgtgcaaggagtaggaaaagctgataccctctctcactgaggtctcaaagttaaatgattatcttgtagtttgtagtgatcagcgagattctccgtgtccaaggtgggctagtcaaagtgtgttcgtttttgaatgatggtatcttctggtacttcaaagtttctgctgttacttacaactccactcgtgcaagcttgacggaagttctgatttatgatcactcacattcttcgctcacttcttgaagtgaagtctggttattgtttttgcatagcagtgttatgcctctgcctgaagttttctgccgaaaactttactcaggaggacatttttccatttctgacagttgtgtttggaaaagagtttcccagctattgccactttacttgagattgtgcttttagtattttggggatcactttgtttgcagttgccttgagtcaccttttcatacagtggtcttttagtgcttttagagttatgagttaagtagatcatcagagttaattaagatttatttgctgatacattgacagtctttccagaccagtaatgatctggttttgctattgttacaaatggtattacaggataagaaaatgcatgtcctcacagatcatcataggaagtatctataataaagtaaatatctaattttttttaatagtgaccactgaaatgagatctggcgtgagctggggagagtggactcaaccccccttcccccctcctttttttttgaaatggagtttccctcttgttgcccaggctggactgcaatggctgccatctccgctcaccacaacctccgcctctagggttcaaatgattctccttcctcagtctccccagtagctgggattacaggcatgcaccaccacgcctggctaattttttttttttttaagtagagacggggtttctccatgtttgtcaagctggtctcgaactccccacctcaggtgatccacccacctcggcttcccaaagtactgggattacaggcatgagccaccgtgcccggcaacccccttcttttttttttttttttttcgatacagagccttactgtgttgcccagacgtgagtgcaatggcgcaatctcggctcactgcagcctccgcctccctggttcaagcaattctcccgtactcagccttccgaatagctgggattacaggtgctcgccattacgcccagctaatttttgtgtttttagtagagacggagtttcgccatgttggccaggctggtctcaaactcctgacctcaggtgattcacttgcctcgcctcccgaagtgctgggattacaggtatcagccaccatgcctgccacgcccaccgcccccacccttccttttttttttttttttttttttaaataagatagagtcttgcttgttgcccaggcaggtaactcctgggctcaagcaatcctcccacctcagcctcctgagtagttggaattacaggggtatgccatgatacctggctttcagtgattctcagtatagtaaaaactacagcacttatgttcattctaaattgcggtctaaatgaaaacagtgacaagtttcagctgtggctgttacatgaagtccccacacgttctgacatcgaaacttttggtatatatctgcctgcttatagtctttttatcttctctacttggtgaatgattgttcattcttcacacttccatttcaaactactcttctgtgaagccacccctaatgcctctgggctaagttagaccctcagccaactctaccaatgagccctttatattattttatgatcatgtgatcagggtctctttttcttactagaatgggcattcaccctgggaaaaggtgatgttttattaatttacatcctctgcacctagcacagggcctggttaattgatttttagtagatgttgttcagtgtctgtggaaagcctgagagtaaggacagtctttaagtggcgcatagcacctagtccttagtgtattttatcagtaagctattgctaagtaagaaccgcaacatcacagtggcatacaacagttagtatttattttgttggtgcatctgggggccacctgggagctgaccgacataggctgtagtcatctgggtatctctatgatgcacatgtggtccatatgtctctaatctttggactagtgggctgaagtcctcatggtgatagcagaggtataagagcaagcccaaccacagagacacattttaaacccctgctcacatcatgtgtttatttcctattggccaaagtaagatatttggcaaaggccaaattcaaggggcagggaaatacaactccttccttggaggtgacaaagaggaagtgaatatttttctattacaatttaatcgatcacatatattaaacatttacaagctcttagtaaatgtatttcaaatgaatgaaccattcctatcctatatgcatctagtactggaaaactataaggaatctaagcagtgctagagatatgtgactccttttctcgctcgtgggacatctgaagaacatctgctctgtctacttgttttttcctttaaaattctgtctttccattaccctatagagctccaaggctgtctcatggccttttactttatgttaactattcagtattttctgtgttttgtaattaacaaaacataggttttgagagaaaacctggttgacctagtgcatcatttggttccaggttacatggtaagttgccaagatttgagtcaagcgagtacttaaattagatgaggtctggaagatgatgaatcaatatcagtagaggttatggatgttgttctgttttcctctttgttgagtctcattacatgttgacgaagatggccactggcaactccgggctttcatatccatccagctagtaatccagaagaaataactcttttccccaacatccaaatcatttcctccaaaggactctgataggccaaggttagaccaattgctgtgtccagaatggggcactttggctaacctgggttatcagcctaccctgtggcaggtaaggtaacaacctcactagaattacatagagtgagagaggggcagttcctaaaaggaggcaatgtagggcagatgaaaaagtagcaatgactgttacacacgtatttacaaaccacctaccgaatgaaaaatgttgcctagaggtatgaatacttggctgaagaatctgattatggaatatttcacagttcagtttatatcaaagcaggatgctttttcctggattggctaattgaaaaagttggttaagaggtgaattgtaataacgatacatattccaagtgaagttattttctgagtgtcaaatctttctaggtatttgtaattcttcaaatgtttatagttggcttccaacacctaaactgatagtaaacttttaagcaacttacctttatctttctcaaacattcaacttggcttttagggtaacgttaactccctttcagctctatgttattagttttgtaatatttaattaatgacaagttaaatatttaattgatgacaaatttaatttgttattttgaagaataagtagaataaaaaggtttgtgaagaagcacagttaacttggcaagcatacaacttgacactggcgtcagatgcatctaagtcttgatccagtcctaggtctactaccacgtactggatgctcttcactgatctatatcaagtatttagattgttttggaatgtatttttgtttcacctttattcttgactttgttttatatgcttacttttgctttctctttttcttcataaatgttatcttgttgtattgttcatctttttaagccatcttgaatccttttggtaatagttgtcatataagtcttccataagttgttggaatttggacaactttttactttctaacctcagttttctcttcacttaatgggagtgataacacatactttggaaggttgttttgagtatttgagataatatttgtaaaatgtttagcttggaatctgccacatcatagactcaaaataaatagcagctattgttattattattattattatttgagacaaagtctcactccatcatccaggctgaagtgcagcagtgtgatctcggctcactgcaacctccatgtcctgggttcaaacgattcttgtgccttagtcttctgagtagctgggactacaggtgcacaccaccacgcctggctaatttttgtattttttttggcagggatggggttttgccatgttgcccaggcaggtctcgaactcctgagctcaagcaatctgcccacctcagcctcccaaagtgctgggattacacgtgtgagccaccatgcccggcctgttgctgtgtcttaaaaacgggaaacactatagcttccgcatgtaaaggataaggttttctggtttttacttgcatccctgagcatagattcatatataaatatagggattcagaattctgttaactgtccttttaactgtagggtaactggaattggccatttttgttgagtggatcccaaatgtcagtatctacaggtctttttttcttgttccaatatccgagaaaggaaacctggttaagtatccctaatacaaaaattaaagatcttaaatgcttcaatatccgaaactttttgagagccgacatgttgccacgaatggaaaattccatgcttgacctcatgtgacaagtcgcaattaaaatacagtcaaaactttgttttatgcataaaattattttaaaaattatataaattgccttcaggctatgtgtataaggtatatatgaaaaacaaatgaatttcatgtttagacttgggtcccatcccaagccttctctttatgttttgcaaatattcccaaatccaaacaaatccaaaatctgaacaaattcaaaatccaaaacacttctggttccattttggataaggggtactcattctatattgcactctcctctctggcaggcagatataagactagctgcctattatctggaagctaagtgaaggaaagggatattgatcagaatgaagagcctgttatactactttaagctgtactcgatgtttaagatcagaactgttactcatcttctctagaaatgtatctatcaaagtaccattgtggggaagtgtagttgcctggtgttgatgatgtaatcagggcatctagctactcttctaaaagattttcaaccaatacttttgtgtttagccttactcctctacccatctggtcttcataagtgtttctgtatagttatgatcagtttagttagttctggagtaaacaaacatttcaggttaataaatgggtctttgacttccattgtgttcagttgcatacgttgtttacctaatgggtttagggaccttaggacttgatgtcttttttttcttcttctgatacttaatcttttgacatgaacttatttggtatatagcattgatatttgactaaatagctcattgacttacttaggagaatgagaaaatgccttgactattccttcaccccagataatttcatttgaatattatttaattatataacatgggtatttgaaggaggtcttctaaaagtggtagatgataaggttataacttgatgggagatttgagcatcccttcagttcattaaactaccaatattattgatggccttaaaataactgaatcttctttttaaagcaatgtcaaaagtaatttgacttgatctcctattgcaattacttttacctaacatggattatataaatgtcttatttgttctaaatatgttgcctgttactttcattgagtattagcttgttgtcgtattgtcgatcatgtagatcacgttgtcatactgtagatcatgcagatcatactaaactatgtaagccccttccagtattatacatgtggtgacttaaattattttttacattagcggtttatggtaccattaccttgacatcagagtaccttggtgccattaccttgacatcagagtaatttagactattaaaaggtatttactgtttggagtttaattgggcaagattgaagataatttataatgtctacattttatatttttaaaaatttaatactttgttttttcctaagagtaagctctgttgagtagtttgtttttcttcctgttgcccatagttgacagactataataagaccctgtattattattattatttttaaacagaatcttgctctgttgcctgcgctggagtgcagtagtgcagtctggctcaaacaattctcatgccttctgtgccttctgcctcccaggctcaagcagttctcgtgcctcagcctctcaagaacctgggattacaggtgcatgccatgcaccacctaatttttgtatttttagtagagatggggtttcatcatgttggccaggctggtatcgaactcctggcctccagtgatctacccacctttgcctctgaaagtgctgggattacaggcatgagccaccatgcctgaacaagaccctgcttttgattaagtcttttaaacaattaaaaataaagaaaaccttcaaagagagactaccttttccgatcctccatttaaaaaactaaccttctaaaacttctacatagtatataaaatttaaacatttttcctatgaaatatattcatactgatatattttcttgattattttgatctcagtttgcccttctacacataagaattatgcatctttggaataagtgttccttttttgaaaatagaaaccactctagctactttaagcagaaatgggtttagcatagtgaattaagtgcttacaaaatcactggagaaacagtctaagagtgaatcccagaacaacagagtgccagaacagtataaagctgcaactggccagccaagtgaaatactacctctaccacaataaagaacctgaagctgtctccaggattatatcactttagctgtgatctttggtgaacaggaagctgctgtgccataactatagattctagaagcaaagtatgccataactatagattctagaagcaaccaggagaagtgatgccacttgtgctccctctcactctccattaaattagagagtcaacactggaacctctgttaaagctgcttcagaaaaaccaagtatctttacaactattctaagcagcacaagttggttgtgaattatagttaacaccatctttccttgtttcaaatctcatgttagtgcatctgattagttaaaccaaaatcacatctgaaactttggctgctacggattccaggaaatacagcttctagctttccaactctataaaatagaaaggtatcttggaagctggaatggataggtgatgccggtttatcatattctctacaagcagaggtgttaagagtttagggtctgtagtcaggcagcctggattttaaccttgggtttgactcttgtgagctctctgacgttgggcaaattgcttaactgccctgtgttctagttttttctctcacgtagtaggtatctatcccatagtgttgtttgagtatttaatgaagaatgtggtaagacttgcattaattcttactcagacatgtaatgtaattttcttgtaagcaatctgggcctggagttttctttgtggtaagttttatatttatgaattcagtttttgaaatagtttagactattcggattttccgtttcttcttgtgtcagttttagtagttgtgtttttctaggaatttgtccatttcatctaaatttttaaagttagttttcataaatatccctttattattattttttaatgtctgcaggatttatagtaacctccctgtatcacattgatagttcttccttttttcttattagtcttattaaggatttatcagttttatcaatcttttcaaagaaacaacgtttagtattatcgatcctctctcctgtgtttgttttctacttcattaacctgtactcttttagggatctattttgcttatttttcaaatttttgcaatgaatgcttattaacttttggcctttctgtatttttttctgtaagcctggatttagctgcatgtcatatgttttgaaatgtatttctattgtcattcaattcaaaatactttataattttctttgttttttcagagatagagcctcactctgttccccaatttggagtgcaatggcttcatcattgctcactacaacctcaaactcctatgctcaagcaatcctcttgcctcagcttcctgagtagctaggactacaggcagacaccaccacatcctactaattatttttattttaaaatttttttgaggcagagtctcgctgttgtcaaccaggctggagtgcaatggcacaatctcggcttactgcaacctctgcctcctgggttcaagcgattctcctgcctcagcctccccatcagctgggattacaggcccccgccaccacacctggctaatttttgtatttttagtaaggatggggtttcaccatgttggccaggctggtctcaaactcctgacctctggtgatctacccacctcagcctccccaaagtgctgggattacaggcgtgagccactgtgcccagcctatttttattttttgtagatatggggtcttgccatgttgctcaggctggtctggaattcctggcctcaagcagtcctcctgcctcagccttccaaagtgttaggattacagacatgagccactgcacctggcctatagtttttattatgtgttctttttctgtttcacaggttatttataagtacattgcctagtttccaaatatatttggcttttcaaatatctttttctttatttttgtttgcttatgagtctgaagttattttatatctaagatttttctatcatgggaaatataaaacatatataaagctagagagaacaatacaataatcattcaggtactgataagcttcaacactgttaactcatgaacagctgtgtttattctcacttctcccattgccccaccaccattattttgaagcaaatctcagatgtcattttttctttaaatatttcattatgaacttataaaaatgacattaaaaaatcacaataccacatcaacccagaataattaattgatgtcatgaaatatctgatcagttttcaaattttccccattttgtcataatttttctttataatttgattattttggaggaggatccaaataaaatccaagcattattattggttgatatgccccacacttaaaaacctggcttttagcaacaccagcaaaattattcattatgctaaaacatacataccttgcatactcaatatacctccccattcctaggtaagctttgaaattcaacttttctctcctagctccataggttgttaaagaagcagcttatcttcttggttctttcttttagaattgacacatatccccaggagaaaagtggttgcaaaagtcagagtaacctttgtaggttttctccttttaaagatataagactgcaagccaagtgctgtggctcacttctgtaatcccagcactttgggaggccagggttgaagatcacttgagcccaggagtttgaatccagcctgggtaatatagggagaccccatctctacaaaaaatttaaaaaattaaccagacgtggtggtgcatacttttagttccagctgctagggagcctgaggtaggaggatcgcctgaacccagctgggtgacaggctgggtgacagtgaggctgcgtgacaaagtaagatcctgtctcaaaaaaaaaaaaaaaagatatcagacttgtaaatcttcactgtctttgctctctgatgtcttcaagtaatgctttaaaatattttgttcatcttttatagttatcttcagtaggagatatatctgaattatctaatctgtcattattagaagggaaagtccccttaccacttaaattttgaacattttgaacactaaacttactatatgtttagataacatgactgcaatatttggctttatttcaaaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggtaaccattattctagttaagattttgtaaacactagatttctcttggataagaaaaacaatctaataagaatcatcattatttattctattgagtttacgggcaatctttttcagaacttaggttttacaacttgttttaggaaatcctgctattttaactgggtcttgctgtattatcagactaaaggaaacaagttctcacaaatatagtggcatttgaagataaggtggttgcaaatcaaagggttcatttaaacattctgtcataacatttgtttatgacaaaaagccatgtttgttctgaggcaaagaaggggctgaaagtgaaaacagaatttttccaaactacccttcaagtaataatctgaaaaatcaagctttggtattttttccatttatttatttttttattactttcagaatagaatcaatcttaagactaaaggagaaaattcaactgaaaacactgatattgtaagaagcatatggactgttctgactttaaaaatcattagaaaagagacaagagagttacagactgcaataacaagataccattttactgaattaattttctctcacagttatgttctagcatgttgcaatattactgtaggtgtttgattttataaaatctgccttttctgacagtatttcacattttgaaagggagggaggagcacatttacagtaactgtaagaagagcaaaaaacattttaagtgtaaatgtgactgaataaggtttaggtgaggctaggaataattttaagaaaaaaattttcacaaagggtatctttttatagtatatgtttctcgagctattttagtttagaatatctaagctttaaaacataatagctaaaaattgggatttggataaaaattgactaggttgggcaggaaagaacaattagaatctggttttataatactattttactgaaaatgccggctgggcgcagtggctcatgcctgtaatcctagcacttcaggaggccaaggtgggtggatcacttgaccctaggagttcaagaccagcctgggcaacatggcaaaaccccacctttacaaaaaatacaaaaattaattgggcatggtggcatgtgcctatggtcttagctactccagaggctgaggtggaaagattgattgagcccgggaggttgaggctgctgtgagctgtgccattgcattctagcctggatgacagagtaagactctgcctcaaaaaaaaaaaaaaaaaaaaaaaaaatcaaagtaaagaaaatgccaaataaaatatataaacttacagattttggggtgtacctgtacattaattatgagattctcattaggataccccaactgctttgccttttgatggagataatcagttttgtccttggttagaaaggaaagaaaggtatatgcttactctgtgtcaggtacagagctaggtgttttgatgtattccatttcaagtgatccttacaataactttgtgaagcaggaatggaaatgattaaacatttagaaggaaatgaaagacaagaaaggacagagtgatccagtaggggtctttaggtataaagttctaaaacttatcttctgcatccactggtgaaaagagacaataagtataaattatagcaagaataatttcctgacatcttcaaggccctggtaagggttagccagtgagaatgtgaaatagtctcttcttgagatctttcaaagcaagtcatggttatccacttgtagagatgatcctcatgtagtactatccagagcccaagctatagagtaaactgggactcctttccaacagcattgttctttgtgatatatcttcttgtgatatatgaaagaataaatgtatatctatacaaatatgacattgagttggaaaaaagacacgtgactgagctaaagtgttggcttcattggctgccaagattttttttttcaaactagttagtatctgtccacattagtgcaaaaataacagtactttgggaggccgaagcaagacgatcacttgaggccaggagttcaagactagccttggcaacatagggaaaccctgtctctacaaaaaattttaaaaattagccaggggtggtggtatgtgcttgtagtcccaggcactcaggaggctgaggcaggagaatccttacagcccaggatttcaaggctgcagtgagccataatcatgccactgcactccagtttgggcgatagagtgagacccctttagggattacaggcttgagccaccatgcctggccagggtttctgttttttttttgttttgttttttaatattacttggaatagcccaaagcagtggtttagaagtagttttgcaatgaagtggagtactctcatcttcctctatattttttaagtttgtttaatcagcagtaatgatgattgaaaaaaaagggatgaatagtgttaaattcaaaccaataaatatttaatagcaccttctatatatatataaaaaaacagaaataaatataaatatacaatactatgcttaaggagctgaaatagataaaagttaaataataaaaataattaaataaggaaagttaactattcagtgtaagaactctcaccaggctgtgcataagtactttcaaaatgagtggaatactcacacttaatagaagtttagaggtaggagtgagttttggaaatgatttttaaaaaaactggatctggaagtacttgaaagttctgggagaaggggatgcccagatgatggcaaagatactagaaaatacacagggtaagaaagagcaagacagaatcatcagaggctactgagaagaggccattgcagtctttagctggaggaatgattatcaatatatattatatggtggatctgctccaggttcttggttttttttttctttttagagaaggagtctcaatctgtcacccaggctggagtgcagtagcccattctcagcttactgcaacctttacctccagggttcaagtgactctcctgcctcagcctcctgagtagctgggattacaggtgtgtgccatcacacctggctaatttttttgtatatttaatagagacagggtttcaccatgttgggcaggctggttttgaactcctgaaatcaagtgatccacctgccttggcctcccaaagtgctgggattacaggtgtgagccaccacgcccagcctgctccaggttctattaaggggctaagcattggagattttgggctgggcacagtggctcatgcctgtagtttcagcactttgggaggctgagaagggtggatcacttgagcctaggagtttgagaccagcctggccaacatgctgaaaccctgtctctactaaaaatacaaaaaaaattagctggacatggtggttcatgcctgtaatcccagtatcccagttactcggtggctaacacatgagaatagcttgaacgtgggaggtggaggttgcagtcagatgagattgtgccactgaactccagcctggtgacgaagtgagactctgtatcaaaaaaaaaaaaaaaaaatagacactggggatgttacaagttcctcacaaatcataattgtaaaccccattttcactttctcagttcttatcgcctaagatcacctgccacagcttaacagagataacacacacagggtgatcagcacttgttatcaatacctattagttttgtctatcttaaacttttgctacccattcatttctgtctccttaaagttttattagagttgaagtgaatacccccaagagggttaatgcctaggtatttgtgaattcaaaatacctagttgtatcttgtttatataagcagtgaccttaaaaactttgaccattattttctgtcagccttacatgataataattaaaatgaaggaataattttcccttagtgacttttcatctgaagctaaagtttaaacaatgtaaaagttaggttacaaaactcccaaggtttgttgtcgtctttgtctacctgtggatggtgactctttgtttcaaattacgtgttgagagttatgaaatgaaaatccagggtatgactcctggattttgttccttgacaaactattcttgcctttctggtactttctttcttcctcttttttgagacggtctcactctgttgcccaggctggtatgcagtggcatgatcatagctcactgaagccttgacctcccaggcttaagcaatccgcccgccttagtctcccaagtggctaggactacagttacatgccaccatgcccagctaatttttgtatattttgtagagatggggttttgctgtgttgcccaggctggtctcaaactgctggggtcaagggatctgcctgccttgacctcccaaagtgctgggattacaggcgtaagccactatgcctggactttggtactttgtttcttagaactttgtagaagaggctcttgttattagatagatgcaagtatataagctaagagacaccaggagatgtttataccaaaattctttgattaaaatttccttttccctatctcataaactataatatattgttgtataaagcttgctgtgtagatacaagaaattgttcctatctcccatatttcaacttaattccagcacagcaggaatttgcatattctggaagctttaaattgcttccattatatatggaaccatagaagtgcctgagttattcatttataagtgtatacgtgtcttaggtatagagaaagctgagaggcctgaactgtccttctttgtttgaagaagactactgttactatggtaattgctgaattagaaggctagaactcttgacttttgccttgtcctgggaacttagaatgggcaaaaagtcaagaatgactttgtctttgactgtgttgcatctttctattataacaaatgcactacaccgagatcataccttccatttctagggaaagaaaaagacaaaccaaaccctcacctcattattttagttatatagcttgtgaatgttcagtaaataaaaactagtgattagatggtttgcttatgaaattagatgtatggcagattatttttgtatgtgtagtataacctaggtacgtatatagagcttggcgaggctggcatctaagacaaatacgaatactgcatctatatttaaaagcatagttttattgttagtagtgatattaacaacagaggtgattatagcaataaaacaacgttttttaggacctttaaaatatgatccgtagtttccagaaaactgtgaattccattgtgtcacatttttatggatcttaaatcatagatatgggctagtataacttagttttctaatttgttttaaatttcattgcaattttttatgtaacgtgcttacatataaatatactgtttcagtaaattgaaatgttcccttaaacattttccaaatcccaatatagtacatgtagaaaccatctactaatttcctaaaacccatgagactggaaaacatctctttagctatttttaaaatttgtaatttttaagcacttatttttgaaagaactccaaagcatctagaattaagtttgtttgtttgtttgtttgtttgtttgtttgtttgttttgagacagagtcttgctctgtcaccaggctggagtgcagtggtgcaatcttggctcactgcaacctccgcctcccgggttcaagcgattctcctgcctcagcctcctgattagctgggactacaggcatgtgccaccacgcccagctaatttttgtatttttagtagagacggggtttcaccatgttggccaggatggtctcgatctcttgacctcatgatccacccaccttggcctcccaaagtgctggtattacaggcgtgagccaccgcgcctggcctagaattaagtttttaaaaccttctgaaaacctctcctctttgttcttctgcagccttttaggacccactccactctctggcttactttgtatttttggatcaattttcttttactcacaatacaatttacataacaaaatttgctattttaatcactttaaagtatgcaattcagtggttttaagtatatttacaatgttgtacagccttcaccactattccagaactttttcattaccctgaaaagaaaccccatatacattggctgtaactccccattctccttcttcctctagtccctggcaaccagtacttgactttctgtctctatgtgttgtctgttctggacactttatgtaaatggaatcctacaatatgtggccctgtatgtctgtcttctttcactgagcgtaatctttttaaatttaagattcagccatattgtaccacataacagtacctcatactttttttatggcatcccactgtatggctaatgtattttgtttttttcatcagttgatgaacatttggattgtttctaattttgggctattatgaataatgccactatgaatatgcatgtacaagtttttgtgtgaacatatgcttttaattctcttgggtatgtacccaggagtggaattgctgggtcatgtggtatctctatgtttaactttttgaggaatagccaactatttttcatagggctgtaccattttatattctaggaatgtatgagtgttttagtttctccccatacttatcagtgaagcacttgttaatttttcttcttttttaaaaaatattacaacccttatagtggatatgaagtgatatctcactgtggctttgatatgcatttctctattgtctaatgatgttgagtatcttttcatgtgcttattggccatttgtattttttttcttttttttgagaaatgcctattcaagttctctgcctgctttttttttaatgttttattttctttccaatgggacttttgcactcctgtctttgtgtttttaattgagctgtctctttttattgtcagagttatttttatatattctggatattagaccctatcatacatgtgatatttgcaaatattttctcctagcctgtgcattttcttttaactttcttgatatgtagtatcttttgatgcacaaaatttttaattttgatgaggtgtaacatgtctattttttcatttgttatctataattttaatgtcatatttatccatggcttgcttttcacctctagtttcaacctcttggcatgtttaggcttcagatttttcctctagcagcttttctttttccctcttcaaataattatctgccccaatgactcgttcctcagtccttactcagcaggccatttttaggaagaaactcaaagttcctcagttctaggatagctttaggtgcttgtgaaaaaaatggtttggccctggggagaagaatctggccattgttaatggtttgggataaagctttgaagtttaggacaaagatagagtgaactttttatactctgagtatgttggcaaaaaatcgtagttgtcacataacattaattacaagtataatgctaagactgaagtttttaagaatttaagtttgagcagtttcttttgttataggcattactagcgaaccacagagatcagacaggacctaggtaaatagttgaaaaactaagactagacaagagcttgtagacttgacgcttgaataaagtagatgactcagtgaaaaagaacagtccttaagtttggaacaaatgaaatggaacttgaagtaaccaaactgaatctttgtcatactatattgatagcagttttcctataattagaactaacttcttatagttttgaaaatagtgattattaacattattctttcataagatgccatcttttagggtttttaaaccctgataacttcatggataattgatttcatttttataagtatcttagaggtataggatgaggtttactgtttctccactgcctacccccttaaaaaggtcatatggtaagcattctgtttctttaagaaataatgctttcggccgggcatggtggctcacacctgtaatcccagcactttgggaggctgaggtgggtgggtcacgaggtcaggagtttgagaccagcctggccaacatagtgaaaccccatctctactaaaaatacaaaaattagccgggagtggtggcagacacctgtaatcccagctactcgggaggctgaggcaggagaatcgcttgaacccgggagacagaggttgcagtgagctaagattgcgccattgcactccaccctgggtgacagtgcaagactccatctcaaaaaagaaataatgctttccagaatgacaagttttgcttcagtgataagttgaaatcaaattttttattttgaatagtgtttttaacttttaaaacatgtacttaacttctattatctcagtttgttttttagaaattaaaaaaaattaccattattacaaaatatgtgcatgttatttctacttgtttcagatttaattacaagtatttatttcatcctgatatatgagagacagagagggagagagacagatgcaagaagaagagaatattcttattaaaattaggccataaaacaattccacttttagcaatgtatcttaagtaaacaatcagaaatagatttgatgttttccacaagaatgttcactgcagcagtgtgcacaatagtacaaaattgggcacaatcttaaaatccaacataaagttctggttcaataaattatggtgcagacatccattgaacttggcagccattaaaatcatattatgggatattacttaatgatgtgggaaactgtttataatacatactttgttataattggtgaataacaaattgcaaaacaatatggacaagtgctttcagttctttaataaaaggaatatgtgaacatagaataagatttgaaggctgcgtaccaaaattctcatgttatctctccatgttaggattatgagcagttttttcttgaaggaaccgtatattgcttttatattaaaactttttttggatttcaatactgtattgttgataattttaatagttttatcttacacttttttttttttttttttgagatggagtttcgctcttgtcacccaggctggaatgcaatggcacgatctcggctcacagcagcctctgtctcctgggttcaagcgattctcctgcctcagcctcctgagtagttgggattacagacgcctgccactacacctggctaatttttgtatttttagtagagacagggtttcaccatgttggccaggctgatcttgaactcctgaccttaggtgattctacctgcgtcaacctcctaaagtgctgggattataggcgtgagtcatcttgcattttggaggttaaatattttgctcattttcatcttttcttagtatttactgtagttttccatattagtgtaaataacctcatctctacctagaatcttataggcccagagaagacaaagaatcattatgttattatgattgttttatttgtgattggtgactttgttttttcagattatgatactttggggcctagtgcttatttggtcagtcatattgcaaataacttttttctttttctttttctttttttttttttgagacagagtctcgctctgtcacccaggctggagtacagtggcgcgatctccactcactgcaagctccgcctcccgggttcatgccgatcttctgcctcagcttcctgagtagctgggactacaggtgcctgccaccacgcccagctaatctttttgtatttttagtagatacagggtttcactgtgttagcctggatggtctcgatctcctgacctggtgatccacccgccttggcctcccaaagtgctgggattacaggcgtgagccaccacgcccggccaacttttttcatctcatttaattaccctgtcaaaggactgggcctctgtggcagaaataaagaaaagctctatttttatggaaagggtaatacagtttacacgtattctcttactatgttttagtttgcttggctgccaaaacaaaacaccacatactggggggcttaaacaagagaaatttagtttcttgcagctctgggagctagaaatctgagatcaaggtgttggcaggtttggtttcttctgaggcctcttccctttggcttgcagatggccgccctcacactgccttttcggaggccattcctctgtgcatgcatgaccctgatgtctctctgtgtcctacctcctcttttttttttcagttgataatttattttattttattttagttttattttttgaggcagaatctcgctctgtcacccaggctggagtgcagtggcgtgatctcagctcactgcatccttcacctcccaggttcaagcaattctcctgcctcagcctcccgagaggctgggactacaggcgcatgccaccacacccggctaatttttgtatttttattagagatgaggtttcaccatactggccaagctggtctcaaactcctgatcttgtgatccgcctgcctcggcctcccaaagtgctgggattacaggcatgagccactgcacctgacccctttttttaatttgtaatttcaattttcatttttttccataagttattggggtataggtggtatttggttgcataagtaagttcttttgtggtgttctgtgagattttggttcacccatcagctgagcagtatacagtgtaccatatttgtttatcccttgtacccctcccactcttccccgcaagtccccaaagtccattgtatcattcttatgcctttgcatcctcatagcttagctcccacatatcagtgagaatatatgatgtttgattttccattcccgagttacttcatttagaataatagtctccaatcccatccaggtcactgcaaatgcccttaattcattcctttgtgtagtattccattgtatatatatatataccacagtttctttatccactcgttgattgatgggcatttgggttggttccacgattttgcaattgtgaattgtgctgctataaacatgagtgtgcaagggtctttttcgaataatgacttattttcctctgggtagataccaagtagtgggattgctggaccaaatggtagttctacttttagttctttaaggaatctccacactgtttccatagtggttgtactagttttcattcccaccagcagtgtagaggtgttccctgatcacagcatccacgccagtatctattgttttttgactttttgattatagccattcttgcaggagtaaggtggtattgcattgtgcttttgatttgcttttccctgatcactagtgatgttgagcatttttttcatatatttgttggccatttgtatatcttcttttgagaattgtctattcatgtccttagtccactttttgatgggattgtttgtttttttcttactgattcgtttgagttcgttgtggattctgaatattaggcctttgtcagatgtttagattgtgaagattttctcccactctctgggttgtctgtttactctgctgactgttccttttgctgtacaaaagctccttagtttaattagatctcagctatttatcttttttttttttttttttttgcatttgcttttgggttcttggtcatgaaatccttgcctaagacaatgtctagaagagtttttccaatgttatcttctagaattttgatagtttcaggtcttagatttaagtcctcaatccatcctaagttgattttttataaggtgatatgagtatccagtttcattctctgcatatagctagccaattattccagcaccatttgttgaaaagggtgtcctttcccccactttttgttttgtttactttgtcaaagatcagttggctgtaagtatttggatttatttctggtttctctattctgttccagtggtctctgtgcttatttttatatcagtaccacgctgttttagtgactgtggctttatagtatagttgaaatcaggtagtgtgatgcctccagatttgttctttttgcttagtcttgctttggctatgcaggttcttttttggttccatataaattttagaattgttttttctaattcggtgaagaatgatggtggtattttgatggggattgaattgaatttgtagattgcttttggcagtatggtcattttcaccatattgattctacctatccatgagcatgggatgtgtttccaattgtttgtgtcgtctgtgatttctttcagctgtgttttgtagttttccttgtagaggtcttttgacgtcttggttaggtatattcctaagtattccttttttttttgcagctgttgcaaaaagggttgagttcttgatttgattctctacttggttgccgttggtgtatagaaaaactattgatttgtgtacattaaccttgtatttggaaattttgctgaattcttttatcagttctaggagctttctggaggagtctttagggttgtcgaggtaaacaatcatatcatcagcaaacagtgacagtttgacttcctctttactgatgccctttctttctttctcttgtgattgctctggctaggacttccagtactatgttgaagagcagtggtgagagtgggcatccttgtcttgttcctgttctcagagggactgctttcagcttttccccattcagtattatgttggctgtgggtttatcatagatggcttttattacattaaggaatgtcccttgtatgccagttttgctgagagttttaatcataaagcaatgctggattttgtcgaatgctttttctgcatctattgagatgatcatgtgatttttgtttttaattctgtttatgtggtgtatcacatttattgatttgcatatgttaaggcatccctgcatccctgatatgaaacccacttgatcatggtggattatctttttgatatgttgttggattcagttaactggtattttgttaaagatttcaacatctgtgttcatcaaggatatcagtctgtagttttcttttttggttatgtctgtccctggttttggtattagagtgatgctggcttcatagaatgaattagggagggtttcttatttctttagcttgtggaatagtgttaaaaggattggtaccaattcttctttcaatgtctggtagaattctgctgtgaatccatctggtcctggacttttttttgttggtaattttaaaattaccatttcagtctcgctgcttgttattgttctgttcagggtatctaattctcatgctttactgactgggctagctgggtgcctcagggtatctaatttttcctgatttaagctaggagggttatatttttccaggaatttatccatctcttctaggttttctagtttatgtgtgtaaatatagtagccttgaatgatcttttgtgtttcagtggtgtcatttgcagtatctcctgtttcctagtgaggttatttggattttctctcttcttttcttggttaatcttgctaatggtctatcaattttatttatcttttcaaagaaccagctttttctttcatttgtcttttgtattttgttgttgttgtttcaatttcatttagttctgctctgatcttggttattttctttcttctgctgtgtttaggtttggtttgttcttgtttctctagttccttgaggtgtgaccttagactgtcagtttgtgctctttcagtcattttgatgtaggcatttagggctatgaactttcctcttagcatcacctttgctgtatcccatagattttgataggttgtgtcattattgtcattcagttcgaagaattttttaatttccaccttgatttcgtttttggcccagtgcttatttagtagcaggttatttaattttcatatatttgcatggttttgaaggttccttttggagttgatttccacttttattccaccatggtctgagagggtgcttgatataattccagttttcttaaatgtatttaggctcgttttatggcctatcatatggtctgtcttggagaaagttccatgtgctgttgaataaaaagtttattctgcagttgttggacaaaatgttctgtatgtatctgttaagtccatttgttccaaggtatagtttaaatctattgtttccttgttgactttctgtcttgatgacctgtctagtgctgtcagtggagtattgaagtcctctactattattgtgttgctgtctatctcatttcttaggcattagtaattgttttataaatttgggagctccagtgttaggtacatatatgtttaggatcgtgatattttcctgttggacaaggccttttaccattatgtaatgtccctctttgtctcttttaactgctgttgctttaaggtttgttttgtctgatataagaatagctacgcctgctagtttttggtatccatttgcatgaaatgcctttttccacccctttaagttaagtgtgagtccttatgtgttagatgagtctcttgaaggcagcagatagttggttggtgagttttgatctattttacggttctgtgtcttttaagtggagcgtttaggctatttacattcattgttagtatcgaaatgtgaggtacccttgcattaattgtactctttgttgcctgagtactttgtttttttttgtttttgctttttaacttgtatttttgttttataggtcctgtgtgatttatgctttaaagaggttctactttgatgtgtttccaggatttgcttcaatatttagagctctttttagcagttcttgtggtggtggcttggtaatggtgaattctctcagtatttgtctgaaaaagactgtaatttccttcatatatgatgcctacttatatgatgccttgtttcactggatacaaaattcttggctgacaattgttttgtttgtttgagaggccccagtcccttccgcattgtagggtttctgctgagaaatctgctgttgatctgataggattttctttataggttacctggtgcttttgcctcacagctcttaagagtctttccttcatcttaacttttgataatcgatggcagtgtgcctgggtgatgatccttttgtgatgaatttcccagagcttcttgtagttggatgtctaggtctctagcaaggccgggaaaattttccttgattattcccccaaatatgttttccaagcttcttcctcaggaacaccgattattcttcagtttggtcatttaacataatcccagacttcttggaggctttgttcatattttcttattctttttctctttgttggattgggttaatttgaagatcttgttcttgagctcggaatttctttcttctacttattcaattctattgttgagactttccagagcatttcacatttctaaaagtgtgtctgaagttttctgacattttgactgttttttcttaatgctatctatttccttgaatgtttctgccttcacttcttatattgttcttttggatttgcttgcattgggctttgcctttctctggtgcctccctgattagcttaataactaacctcctgaattctttttcaggtaaatcagggatttcttcttggtccggatccgttgctggttaactagtgtgatttttttgggggtgctaaagagccttgtttagtcacattaacagggttgtttttctggttccttctcatttgggtaggctccgtcagagggaaggtctagggctgaaggctgttgttcagattcttttgtcccactgggtgttcccttgatgtagtactctccccgttttcctatggatgtggcttcctatgagcagaactgctgtgatgtctctcctgggttctagctacccagtgagtctacctggccctgggctggtactggaggttgtctgcacagagtcctgtgatgtgaactgtctatgggtctcttagctgtggatactagtgcctgttctggtggaggtggcggggtggggggtacaatggagtccgtgagggttcttagctttggtggtttaatgctctctttttgtgctggttgacctcctgctgggaggtggtgctttccagagagcatcaactgtagtaatacggagaggaactggtggtgggcggggccctagacctcccaagagtatatgccctttgtcttcagctaccaggctgggtagggaaggaccatcatgtaggggcagggctaggcctgtctgagctcagaatctccttgggtgggtcttgctgtagctgctgtgggggatgggggtgagattcccaatacctcctcttcttataaagaaaccagtcacattgcattagggcccaccctaatgaccctattttaactaaattacctttaaaagccctattgctaaatatagtcacctttcgaggtaccagggttagggcttcagcataagaatttggggaaagtgggaggcacacttcagtccgtaattctatatatcacttatgacaagttttaaatgacaaagtgaatgttgaagtaaatttttatgaattatcaatggttattacaaacttttataacattctaaagaacttcagctgtaaattatatgggagagaatgtagaggattgtagatggattagcactaattttttttttcccctgagaaactcaaactctatgacctattgcacaattgagtctatttgtatataacaaatagtatttttcataggtattaataaaatatcagtgtcaagtcaaatatttaaaagagttgttaactgaagcgggattagaattaaaggcattagaattaagattagtgggcaaaagatacaaaaactttgctccctgacattcataactgtctgtagatggaatagcagacctgaagattggctatttctttgtgactgaagttctgaattttttgtgctgttatagagtaaatttatgtattgttgagtgtggttctggaaggtgatgatttttcagcttgattctctaagtatactgtgtgggtttttggctttaaaaaggttaagaacttccctttacataatgaaaacccaacaagtaaatattatttgttagtactttaagatgtagattaatcatttaaaaagtcattatgttaaatattctgaggaccatactgttatttctttccttctccctctagtgggcagaaaatattcttaaaatatagcatggaataatttattgctattgggtataccataatatacagtctcagtctcagcttttttgaatactaaaaatgttaacatttcagaatcattaaagcaaacgctttactcctttctaggcataatagtggatccttgaatgttgaagatgtccttaccagctttgacaatacaggaaatgtttgtaagttatacattcactctatagaaatatatttagtgttttacaaagtgaatttatagttgatgttttcttctcactaatatttattatactcactaaatgtatgcatatatgtatatataatagaaagtttgactgtctttagctgcaaaataagccttgtataaggtacaccgacaaaatgggatactgcagtttctaaacttcgcaggtgtgtgtgtgtgggggggaggtgggggagggagagagagagggagatggagagagtaggtcagaaagaacactggacactgaagtactgtcccttttatttttgtttccattttgacctcagttaattcagtagtggggctgtttcttccttctttgctttgtttcgggtgctttctttgccattccctgcttctttactttcactgtagaataaacccagaacatatttttcttgatgctactatacattaataccagagtgtttttgtttgatgcagtattacaatattacagaatatattgccttttcatcaaagcttctgattaattggtgatagatttgtccactgagaaaatcacttaaatatttcttataattcttgtaattaatttcatgtgatgaaagacatcagccaagaatacctttatgtcactgagttaaacagcataccatcataggagctatggactttttatgttttttgtataggacatttctcttaagatagtgaattgtcaatgaaatatgagcattttaaatgtaaaaatagtactcatactctttttctcaaagaaaatttcagaactgttaacttttggctgaatttaggtagtgtctttggcttaacaatgcagttttatcaaataaatagatttgcatagaattgtgttcagtaatactcagacaacacttttgttcttatgtccacattatgataagcttttgattttatagaaaaatatttgtggttcactaaggaatctataaatgtccttaaattatcctaaatacctaaaataatgtaggtttcttttttatggatagtgactgatgtgccttttagtttctttctttttttttaaattttccaaacaccaacttgaacccgaatgccttttagtttttccatgttggcatttagtgaattctctcccacttaggtgtatctcatatttttattaggtctaggcaaggactgggcaaagcataccaatgatggttgaggatacatactcttttagttctggggtaatgttaaatatcattgagtcaggcttaaacatatgtaatttcagaaaatgattctagaatgttaaatgtggaatttttgattcagtaatgtaaaagtcaagtattgttcccagttggctccgtatgaaatagggccactagctgacagcattatgtaaaataaaaataatttcctaaaggcatcaattattattttaggcatgaatgactgtcttagccttctctaacattttttcccatcaacttgttccataccccgtgttgttgttgcatgaacaaacggaaatattgcatattcagggtgttttttcactgttgtctcttgtttggtagaaaggtttaagactttggaatgatactcacctgcatttgacttctggctctgaaattcatcttgagcaatttgtatcatctctatgaacctcaactgttttcatctcttagggctggctgtgttataaagaaagtacgtacatactgcatggctgagagttgatatgcaataaaagttattaattattactggcgatgagtacctatataacctcttttggttttttcctaataaagaagataatattattaggattattctgtcttatactattttaattgaactaacagggcagaaaaattagataaaattagcaaaatagctgtttattaaaatgcctcattataaatgttgccttaaaaacctggatatattgctgagtgatagaagtggtgacaaaaataagacctcttaaaatatgttgttttgtgtaccttttatgtttactttttattttaacagaaaaatctatatagatgtttcatttaatgataaattggtaaagtcctgttccaataaagtaaatattgattatgacttttatataatcttggacgtaaagtaaccatggactgaaaaagtgatttttcacttgatgcctcaaaaatttgattttattatgccaatagtgatattgagtttgtgactagaaaacccagcagagggcgccacaatcataattctttgtcatagcccaatataattaggataaatagctcaaataataaccctaagcttttaccatgtagacatataaagatgtgtctaaacatttctatttgattcatttataatatatttaatatattcagtaattcaaaaatacaaaaaaatagatttttcctggccgattttttaatttttaaaaatatcagtttaatttttctacttctagctttaaataaagaagtacttttgatagagagtgaaagttccatacaagagtatcagttcataaatcaccaccatggtagtatgttaaaggacaattagaatgaggaaaaaagtttctaatagatgagagaaccaagagatggaattatctatttattttaagaatttgtttctaggttaataatgcttcctagtaatagaaaaaacagcttaactaaaacattttctagtcacaaaaacctgatatgtgtagatacagtaaaaaaaggtatggtcatggtttagtagaaccattaatttcaattgtaagttcattttgaatatcaggggatgattatattcattgcaaattttcagagatgaaaggatcagtcttaccttctgaattggtttatgctctaagtgaaaagacgtggaaaaatctctttaattttggaaaataaacctctagataacttatttactattagaaaagataatttttttgtatttacttttttgtatagaagttttgtggttttaaatgtatgaactgcaaagtgttttatatttttgaggtaacttttcattgcttgaatttcttcgaatgttgtgggaagaaattaagaggaatctcgtacagaatgaatcacgtctgcgtattgatttattgctgtgtgatatacgacccaaccttctttttatatatttatatttactatggtggaaaacaaaccattttgaaagtgcttacctttaactaggaataggtatgtatatttcattatttggtttctactacttgagaacctactttcttttgagatatcaaagcttcttggtcaggaggttgtgtctactattgattcattgtgcccagaaagacatgctgacaagctacctagggaagagtataggatgacatctttcacctcagatgaggtactggctgcttctgtgtctcctttgatatgtcgctcagataccttgggtaacaagggagtgctctataagcattgtagcagatttcttgcttctgctttttctgtgggcagggactcctttctagcttgtcctctgacctctggtcaaagaagctgcaccatgctgtctcttccaaaatcattttccttttctccaaagttatttcgttccactactgaaaggaatttttaaaaatgtaattctcagtgcttacttgatccaaatttggataccatagtatctaatttaactatttgttgtttataacatctcatcttatgcttgggtctgtagtagattcattggaacattttaagcacatcatcctttgttgagtagtatgaacagaagtgttagtacttcgtataatttattataaactatgtacaatataatgtatataatcctttaaaggataggaggtcagcagttaaatcatttcagtaatatcattgtgaagcaggattcctggcaaatgttgcagcttaagtctgggggatgtattggtaaaacttctctactattctttgaaaaaaattttttttcttggttgagctccatgacaggaccctgtggtagttggtgtcacattatctcctggaggaatttgtagaccctctgccatatatacttgtacatgtgacagtggtgatttttgttttccctagtgaattctaagactgaccaggattttttttttttttaatggagtttcactcttgtcccccaggctagagtgcaatggtgcaatcttggctcactgcaacctctgcctcccaggttcaagtgattctcctgcctcagcctcccgagtagctgggattacaggcgcctgctactatgtccagctaatttttgtctttttagtagagacggagtttcaccatgttggccaggctggtctcgaactgctgacctcaggtgatttacccgccacagcctcccaaagtgctgggattataggcaagagccactgtgcctgacctgaccaggatttttaatgcacacagctatagactttgcttcctagtggtctgatagcagaatctgtttgtctgtttgtgatgtatctaaaactgatctcttttggggtggtaatcagttattattgaaagcaagactcattaaaataaaagtcaggtgtggaggtatgttcctgtagtcccagctactcagaaggctaaggctggatgattgcttgagcccaagaatttgaggcaagcctgggcaatatagcaagacttttcctgtaaaaaaaagacaatcaaatatttatcttcctggtttttctagaggaaaaaaaattatatgttttcactttttacttgtatttaggaaaccaaaggtaatagtttctttggaaatatggtctaaatttttagtttttctgtttcattgttgttatgttataaagttagggtttggaatgttggtgaaattatcaaagcttcaagaatgtcagcttggattttaaaatgctattcttattcaaataaagatgtctatatatgtaatgcatatgtatgtgtatatgtatatgtagttatataatgcatatatgtagcatgtgtgtatacatatgcatatatacatatatgtagtatatgtgtatacatgtacatatgcagatatataatgcatctatgtagtgtatgtgtatacatatgcattatatatacatgtatgcattgtatatctatatttatatacagatatatacatatacacagtacagtggtttgattaaaaaatgaaaaagttgggcttttatgggtcattgctctgtttttaatttagagtggttatggaaggtacatgggatatgaagttcaggttttagctctgcgggttattagctgtgtaattgtagacgagtctttgtacaagtcttaactccttatgtaaaattgaataggaaacaataagtactttatagtgaggtgaacataatattagataatgtgaaagtaccaagtaaactgtaaatagtatttgtattttttatggttagtaatatcatctgcctcattcttgaattttttcagtacctttgttattcaaaataatacaagatagaagatatttttggtatgtgccattctgttttaatatcatacattattttgttatgtgaaaacaatgtaaagctacacaattaaaatagtgtggcattattgcagaaatacacatataaatcaatatttttagaataaagtgttcacaaagacctaaatatatgtgacttaacatatgatgaagatacaattttagtaagagaggaaaggatggattctttaataaatagtattgggaccattgcctaggaatttaggaaactaataaagctgactccctcctatatactatatgccaaaataaatttaatatgggttaagtatttaattaaaaacataacactcttagatatttcagatgaataattttaatatattgaaatcaagaaggtccttctaagtgcgagtcaaacaccatgaatttaaaggttaatagattgactaatttaagatttaaagaccctttattcaaaaagcgcatcaaaaaaattgaaatacaaattacacactggcaattattatttatgacatatattcagatgaagatgtattttctttataaagagctcttacaaatccataataaaaagacaatctgaaaacctgtaagatagagaaaaacgtagccaaaaatttaagaagaggtatttcacaagagaaatagcaatgttctgtatgtacatcaaatggttattttattaggaattgaaggaatgatttttaaaagtgagataatttttgcttatcaggttggcaaagatgaaagaagttaagcagtaatcagtaaattgtagggaactgggtattctcatacactgttggtggaggggggtaggtaaattaattctacttttccagaggcagtctgattatatctttcataattttaaatatccatatctttcaactaatgattacctttctaaaaaaaaaaaaaagaaagaaagaaagaaaggaaccaggatgggaactgtggctcacacctgtaatcccagcactttgggaagccaaggtgggcggatcacaaggtcaggagatcgagaccatcctggccaacatggtgaaaccctgtctctactaaaaatacaaaaattagctgggcgtagtggcgtgaggctgtagtctcagctactcaggaggctgaggcagtagaatcgcttgaacccaggaggcgaaggttgcagtgagccgagattgcaccactgcccttcagcccaggcgacagagtgagactccatctcaaaaaaaaaaaaaaaaagaaaaagtacacaatattttgttttaaaataatacttttcttgaaggagctcacagcatgttagatgttaatgtattagtcccccattacacttatgagataaggaatcagagatcaaatcattttaaccctttcttaggttgggaaagtacaaagaggttaaagtcagtcagtggcagaatattgagctttgggaatagaaaatttataagttgtgttacaaaataaatatttaaggtcatcaatgcattatgtggttagaacgcatgggtaatgatcagcagccctgagagtataggggacctgaaagccagtggagcactgatggtatgcagcatggcagtggattcttagtccctctttagcatcgtaatgtacatgtagtctttgattcttagtctgtgttagaatttttgaaggttggcttcggttgctagatggcaatttccctagccatgtgtctccaacttcttagctccacagttgtcaggacggttttttcttttggctcaaaatcaggtaagcgtgcccctaattcataaacagagccctacacgtttgttatcaattaccagagaaggaaaaagacacatttgttatcaattaccagagaaggaaaaagacacatttgttatcaattaccaaagaaggaaaaagaagtctctttttaatgtattttaaaaatttctatttgaaataagaaaccacagaattggaatgattctttgacagtagaacttggtgctatcatgggaactgactgaaataaaccctataatcctttgtagattcatatgccttaatcagtgcaataatatagagaggtagctcatgtctttgtcataaacctgctagtttctccctcttttaaatatctaaagggatgtttctaatttaggtacttccaagttttagcacaagatatgccaagaaagtctttttatttttcccccgagcaaatactgagtagttttcctttgtctgtcttttaaatagctaccattacttttgcatcctttacagtatttgtcaggagctttgtaagtactgtcccgtttaataatcttaacgtctttacaaggggtgaggaaactgatgtccagaacaaggtaatttgcttaaagatttagtaggtggtggcacaggaatttaactattctactttatttcttaaaggctacatttctccaaaacggcgagaaatgaattttaaaagtttgtgatgggaattgaaacagaaagtggtaacttgaagggctagaaaataactttggcaaatggaattctgtgcagcagattgtgtctcagaggagactgattaaaggtcaagaaaaatgggctctccagggtttctgcaaggtagttgacaatctaatggaatggggatttggggagtgtggataagggacaaagaatgcgttttcttttaatagtcttaaaccaaatgcgggctttgttttacttcagtttctttcttttttcttttcttttctttttttttttttttgagaagtgctgatttttgtaacgataatacaatagtaataacaagttatgttttaacatagccccttctctaaggtacttctcaagcttatggctatatattttaaaagtgcttacataaacgtaaatcacccaaagagctcaactaaaaggatgttcttgatttttaacaaagttgtttggattgtggatagcctttccacagagaattgttatatttgacatttatatgaactgtgtatattgcactgctcttgttaatgcttgataagaacaaaatatttgatgattgaatgaatttagtgtttgtgtgtatatactccatgttaaaaaaaattttctcttctctgaacttttactctccactcagccctgagtctgaatattttcattattttctgggaggtgggaacagtttgcaggaaggaataaggaaaagtttccaatcattctgtgtgtatgagattgaaaaggcgcatgttttgtgtaattatagatacgtcacatgctcacaatctgcttgtcctggtatactggatcaggtgtagtctttgctgcacatggtaaattcatagttcgtcttaagcctttgcccttccagggttttgaagatcagacttctgtatcacttaatttctgattgattttctacaaaaaagtattgtttttaattgtgtgatagtcaaacacagacaaataatattttggttaatcctggactttgtttttattttaatacttggtgacttaatcagaatttagtggggattgactgcactgccattagatacaagtaagaaatgatatgtgtgggatgaaaaccacaagttctcctctgcttgtgcctatcctctgaatttctttaaaagagaaattaatgtaacaataaatttgttgggggagggggcattgattcttattgccctctttgatctttctcttatttcccacagatttgttaccatttcccttttttccctctctcatctcctgccatctcacattgctactggttctacacctcttaaatacaaaataatcaagaaaaaaaaaaagctaagaaaaaattctaactcttgtatccatcataagaaaactcttgtcttccattttatcccctttccttctgatttcgtcatgatagaattgaggaagacggctgtcaatgtaggatttttcttgcaggaggtgagcctggggtaggtagactggaagaagaagagacagaaacagaccaggttcttttagttagggtgactgtacagcctcgtttgcctccagtggtcgcagttgttcttatcataattattaacaatgcttactttcactcccaaaagtgctctgatttggatgataaattatatgtgtatgtttagaagacaaggaaagagaaagattggaagcttaattatttatagtcatttataactctttatcccagcatagtacctttcacaaagcctgacccaagtggtattcagtaagtatgcattgattcatttgaatcccaagtcatacccaaacaaatctgttcattctacacaagtgtatttatatttgatatgttaatatgttctatataatggagaggtaaatctaagtttcaattttagaggacatataccacaagccctataaactaatagaaactgagttcagaacacatacattttttatttaggtaatacaataatttttaaaaaattacaaccaggatttaaaaatcagaaatattcacataaaaatgtcgatttttcagtttcttttagagaaaaaaaaaatgatctaatggcccgagtctgagctcacatggtaattattatatggaatgagcagggtctttattttgccttggcactcaccactctacccatggacattcagatttgcaatccctgatgcatattgtatatttggaagcatttaagatgttaaactttgtatatttagttatctacttaagatgagccaattctcattagtcatgttgtttatcaaagctatttaaatgaaatacttaaaaattcttttggtgataagcctttttaaaaaaattcaacaagttaatcattaatctttgggaaatattttttcccataccatccatgaatggcaacagctattaacaaatatttatattattttattgaataaaaaataagctaacactattttaaatatttttcaacagccagtatcttcgagaaagcgtatttttgaaacatacttatttgagttaaaattgtgaaatgcatttaaaaattgaaattgaaagtagaactactggagaagttttaaatatttgtgagtacatgtatgtgtgtatgtgcatgtatacttatgtgtgtgtatatatatatatatatatatatatatatatgtatgtacataaaatacatagttaacttgttcttcatttggttcttgtttatttatagattggaacagaaagagcaatctccacaagtgtttattaagttcctattatgtgctgtcctgcattttcaattctcaaatgatttatcaactttgaagtacaaagtagtaaaacattctttctacacatgttgaagaaactactgcaagttaaatttggataaatatctcagtatctgatgcatccaggtacttggatgatttctgtgaactatatctgacttctcaccagcaaacatgttttaaaaataatacaaagacggggcacagtggctcacgcctgtaatctcagcactttgggaggtgaggcgggtggatcacctgaggtcaggagtttgagaccagcctggccaacatggtgaaactccatctctactaaaaacagaaaaattagccaggcatggtggcggacgcctgtagtcttagctattcaagaggctgaggcaggtgaatctattgaacccgggaggcggaggttgcagtgagctgagattgtgtcactgcactccagactgggtgacagagactctgtctcaaaaaaaaaaataaaataaaatttaaaatagctacattgcttcaccaatgaagaatttaccctgctaacaatttttagaattttggcaaaaaaatggcttgaataactacattaaatatgaatttaatggcttgaacatattgtctcaggacatgattttatttgtacatttttaaggtttaatatattttcagttaaaattatctatatgtagatcaatttcttgctttcggagtcttttctgaagccttctgatgtcttccagtttgacctctacaccagcaacaagcatcttgacatcttccctcactatcatcttgaggattcatttcatttcttttgttttgtatctcgttctaaattccatggcttcctttttgtttggtctgttgttttggaggattataaactccagtagcttcctgagaaagtaaggggaagtaattttttgagaacttgtgatactttggttggatataaaatgatagaattggccgggcgcggtggctcacgcctatagtcccaggactttgggaggccaaggcgggtggatcacctgaggttgggcgttcgagaccagcctggccaacatggtgaaaccccgtctctactaaagatacaaaaaaattagccaggcctggtggcaggtgcctgtaatcatagctactcgggaggctgaggcagaagaattgcttgaacccgggaggcagagcttgcagtgagccaatatcgcaccattgcaccccagcttgggtgacacagcaagactctgtctaaaaaaaaaaaaaaaaaaaaagatagaatttaaaacaatttccccttcaaagttttacagtaatgtgtcatagcttctagagttgcatttgagtagtccaatgctattctaacttatcatttttatgaaacttgttaattctctgttgattgaatcttctgttattcccattattccaatattttatgataaaatatctttgtgtggctgtattttcaaacattgtgttggacatttcttgggcacttttcagtttagaaagtcatatttttcagtctggaaaatttttttgaattactcttttaatgactttcttccatctgttttctctgtttctttcagaaacttccattttttgaatgttgtgcatcctggacagttctctaattatcttttcatcttttgttttgctgtttttttttttttttttttactttttctttacttttaacctttctgttgagttttttatttctatttttacgctttttaatgtccaaaagttctttttctcttttcttagctttttcccccatagcattcttttcatatttcttaattgcctttcttgctttttttgaagatattactgaaagttttttttttttttctgtctttatagtctttgtttcctttaaatcgctttttctgtttcttttctttggtctctgtctgttacagtagaggctttcattacatttctgatgatccttaagagttgtgtactacaaaactgattggaagggacactgatattacagtttcctctgtgggatgatctggttgggttgattcttagggaaccctggctgtccatatggtgtttcccttgagctggccagtttatcagagaaaacacttttgagtttgctgctttgggcagtatgtataccttagcagctagcattttggaagatggataagaagagtcctcagttactcaaccccctgattcagttactccacccccaattaaaaagtattttaccttccttaccaccaccctccttgagctgcacgaatgccttccagtctggagagactagacccgaagacatctgacaggatggagcaagggtagttgcacaaatctttggaataagagatgagatttcaagatctaattgttttgtaagtagattttcaacaaattcttctgtgtttagtccatccttgtactctactcgtagacatgtaactccggttgcttcttagcttctcactactgctgatttaagattcagctttttgtgcctttatgaaccttcattttgtttctaaatgtacttacttttattttaggtggggtgtcaggaagagagggaagctaataggtagattcactctaacatctttagctgccatctttaacgcatacacacatatatgcactcatatacattaatttcacataaatgctataatcacttaaaaataaggtaataaaatttttaatacttcatttaattagactacatatggttcttgtcaaatctacactagaacagcatttccagtttacatgtattgagataaatcaccaaggctttgcataaattttagaaattctttcttccctaatttctgaattcttcagccttcaagattcaactcagatgtcacctataaagcttttcctgactctcctaagctatagtttattggtcctttctatgtttacctatagactttttaatttaatataccattaaaacatatcacattgtgttataactatgtctaaatcacttactagactgtaagcttccagaaggcaggagtgatgttttgtttgtacagtgcctggcatataatgaatacccaatatatgctttgtggattagtgaacttattatttaaaaaagcaaaccacactttaagtaaataaattaggatatgattattttagaaaatattcactatacaaaataatttacaatgcatttaaaatttcattacatggcttgttttcccctccaggaacatgttcatattagtatcatttttgcatatgtgtgtacatatgtatgcattttccattgttcttctttagtaggggtgttactcgtcttttaaaatacatacgtgttattttgttacatattggcgatattttcccctccagatatcttttgctaggagagcactaagttgctattcatctagttttttgatcagtgcaatatattttaagcaactagttcaaaaatacattcaaatagcatgccctattcctcatgaattgctatttctttgcttaaatttcccactcagaccaccagcaatcccttaagtacttttcctaccagctaatgctagcttttaaaaatctacttaatgtttctcttttctttctctttgttgcctctgtcacttaatatacctgtgtgcctgtctcgatattgttccttctcaaggtctttttatgcttttaggatgatctttcctagtttctttttctactgtcttagatgctttgattctgctgtttctccattgcagagagcttagtggaaggaggaagtgaatattaagagtgtctttttaaaaaaagatgttatgtataatattaaagagaatataaatgctggtggttactatataactagtgctccaaaaaggattttgataaacttttagagtctttcatggaggcaaaaatacgaaaatgcgttgtgtttaaatttcttagacaaggggaaaagggagcattgaaattgggcaattgtaaaaaatgaatgatagatacatgggagttcattattttctatctctatgtttttgtgtatattaaaatctatctaaatacaaggtttaaaagaggttaagtatcatttttcatttcttttgacccaataatcccacttttgggtgtcagtcctctagctcataaagacagatgagcaaggatgttaaatatagcactatttggactggaaaggaacataacttgaaaacagtctgacagctgtacttccattactaatggaattgttggataaattatagtgtgtccatacaatattatatagcaatcaaaaagaatggattgagttatatgctatattctggagggatgtccaagatgtatttttaggtgttgagtaatgcataaaatgtaatttcattttaataaaaagaagctatgaatattgcaaaaagctgtgaaggcatatataccaatttatcaaagttgcttattttaggaaatcggaacttgaaggaatggggtagaagaaaaattaactttattaatctttgtacttaatttgtttcaagtatgtgttacttttggggaaaatgtaatgaagatttgaaaaaaatttaaaaataaaatatttaaaaaatgaatgtcaattcatccaagataataataactcatttttaaagctgtaaagagacacagaaagtgatatgcataagaaactaaatgatgaattagatcataatttgcctttggaaagaaacataaatggattgatagctcatgcctatgaaatgtatattcaactctgattctattcccaaacttctaacagaaattgctgggtaataattagaaaggagactttggccttttatatattaattcagtattctcctaaaatctgtgcctaaactttaagcctttttgttatggtaactgaaccaatcaatttcatagttaaagatgtcccattttcaacagaccatatttaacttggaaccaagggtatctagttatatcagttagggttctttggttgtgagcaacagaaactgagtctagccaacttagacaaaaagaaatgtattggaaagatactaagcaggtaatagaattcatgtttcacctgacagttgggcatttctttttgtgttttagtatgcctctaattatattctctgctttcaattatagcattgctccaaaagttcctaaccaagcgcctttgtcattttgccttaagtcttttttttttaattaccattttttaaaaggggaatttatataacatctgttgttcaaattgtgccctagtaaatgttgagtttggagttataataagtttgatttattataagagatattcctattcagatacttacagatagtttcaacctacatattttattttagaattgtcacccttgagtttctctttaataccaccccagtgtctttgtgtgtgtgtgtgtttagcacatttgttttgtttatcttttttgttgttgttgttttattggtaagttttctggggagattaattgtaaaatgtttattaacattaaattattattatttttgagacaacgtctcactctgttgcccaggctggaatgcagtggcaccatcatggcctactgcatccgcaacttcctggacccaggtgatcctcccacctcagcctcccaagtagctgggactatggaagcgcactaccaggccctgcttgttttttgtatggttttgtaggaacgaggtttctccatgttgcccagccaggctggtctagaactcctgggctcaagcaatccgcccaccacaccacatcttcccaaagtgctgggattacaggcgtgagccattgcgcccagccaaattatttttttatatctatgctattctttataatttctgtctacttaactggaacagtctcttgtgctttttaattggattccagacatcgtgtgtaaaaggacagcagggactaaggtaataagattcatgcccaaaagtggtcatgcctcttctgttaggtcattagtgtaggagattaagtcaatttaggcagtagtgaaactgagtttggttttgttgttgctgtagttatctgcagttgttctggtgggctatcattatcttgtgcttagtttagagcctggggtcttagagagtttttttcaataattttgctcccttcacagctttcagcagactttgcacccctgtatgacagatctctgtgctcctgagcctctctagaagtagactgttaagttggttcaaggcttgtggtagggcctggagggctcattcttggccataccctgtgcacatgagtctcaggggttagacgttttcaatgtttgtgcttctccccagacggcaatacacttttgctttgtattagtgcaggatccttggcatgagtgggttttctcccctttcacagcagcaggtgtcttttgcctagtgtcagggcaaggtaagaatgaggtggagattgtcttggccaagttaaccttatgaacctctgcagtaaaatggaaatgatactactatctgatgtagcagtgaaacatttagtttactttatttggtactatacagatgtttgttaattaggtaatatttaatgcagaagatatgggttgagccatggctaaaaggattaggacttagatgggcagactgaaggcaagagggcatcttgggtaggttaagataaaataatgataggcagctgcaatttgatgtgaaagtattttttcttaaatcagttattctatacctcaagatgtcattcattcattcagttagtcagtcattgtctcttgctgcactttactaaaagttggggcttcagaagcatatggctcaactgtaatagtaagttgtactaatagatttcccagtatactgggaatgatcagggaaacttaattgaggcctgggttggtttagaggcagaagacaacagtagagcatgtctttttttttttttttttttgagatggagtctcactctgtccccaggctggagtgcagtgacgtgatctcggctcactgcaacctccacctcccaggttcaagcgattttcctgcctcagcctcccgagtagctgggactacaggtgcacaccaccacgtccagctaatttttgtatttttaataaagatggggtttcaccatattggctaggctggtctcgatctactaaccttgtgatccacccacctcggcctcccaaagttctgggattacaggcgtgagccaccgcgcctggccgtcttttactctttatagattgctataaagagttacttgtaagtaaagtaaagataatgacaataacagtaaaatgataatagtagctctagtttatagaaaggtttcttgttttttattgtttgtttttgtctaggcattgacctcttttattaaagccctgcaatacataaattattatttcctatttatttctttacatcttcagatgaagaaactgtatctcagaagagttaagtgagttgctcaaggccactcagctagtttaaattagagcatgactttgaataaggttagtataacttcaaagtctgaactcattttgttttattactctgcctcccaagactcagatatctagtaaggaaagctagtattcagaaacatccaatcaagaagctcctatgttaaatttaattaattaattaatttttttgagacagggtcttgctctgtcacccaggccagagtatagtggcatgatcatggctcactgcagcctcaactttctgggcccaagcaattctcccaccccagcctcctgggtagctgggactacaggtgcacaccaccacacctggctaatatttgtattttttatagagacagtgttttgccacgttgcccaggctggtcttgaactcctgagctcaagcgatttgcctgcctcggcctcccaaagagtcaggattacaggcatgagccaccgcacccagcctgcttctatatttttaatttttagttgttatttcagccgatatatatatatatatatatatatatatatatatatatatatatatatatatatatatatatatatatatatatatatatatatatatatatatatatatatgtatattgctacataaagacaactagccaaaattcaacgtagtatccagccagtgctttgttatgaatccggcattcttgcaggtatgtattatcttaatagttagttgacatttggactcctagagataatcatgacttactggtgatttctaccgtgacatttgttatgttcttcagactcagaaacatttacactttcatatcatgtggggttgtatgatttacaaattaggtattggctggttttttatctcctcttgaaatttcacatgaatcttggtttgattctaaaagtagatgttattgcgttatcacaaataagtaaatttggaattttgtcaagtttttatatacttctttggcctcaaagcatatcttaaagccattttatagtaagactagcaactcttacagtggcagatttggatggctaaatattaaaaaacatagaagacttgacattgttgtaaaaatgtgagatcatacattatgtcttaagatggtaatagaaaacattttatctttaattgtggaatactctgtaatttatagatattttaataaaataattcatatggaaaatcactgtttttttaattgtcaaaatgcagagaagcaatatgatggagatgtatgtaaggactgtgtcgtttgttcattcagtaattcagttaaccaatatttaccatgctagacaatctgttaggtcctggggtataaagagaaataatatctggtccttgttctcaaatggtttagagtttaatgaaatagacaaataatttgatgaactataatatgttttaataaaagtaggaaataactgctgtggaagtatagagaagagctgagagctgtgtatagtttttagtatgttttctttatgtagcatggtttttatatatctgtagaaaagtatgaaactggtagggggtatttttcagcagtttcttaccatgtactaccaaagaagcagaatgtgagagaccagtaatccagtagtaatacgtgtatcctgacaaacttaagtaattagtcaggtatcagtatatatatatatatatttttttttttttttttttttttttttgagacggagtcttgctctgtcgcccacgctggagtgcagtggcgcgatcttggctcactgcaggctctgcccccaggggttcacccccttctcctgcctcagcctcccgagtagctgggactacaggtgcccgccacctcgcccagctaattttttttgtatttttagtaaagatggggtttcaccttgttagccaggaagtatattttacaagactctttttgtgatttatcagcatactttcatgccaatgtaaaatgtgggagatcttaaaattgagaggtacaatcaaccctgaaattccaaatctattgaaagcccaacatagactctgatgactgtcatttcacctaaagggaacatattctaattaattcaaagcaatatgtcagttgcctgttctttaatatgctaaaagacggatatagtaatttggagaaataacttcattaacaagtgaaggattgctgaagcaaagagtaattgtctgatactaatgggatagcaatatacccagagattaaagagttttaagaggttaaaaacaaacaaattctgtttaaggattggtgaattttagctccccaccccccatctaaaaatgaagcaattactttttaaaatgaaatgtatcattatgtataaaattaatttttaaaagtaattgatagttctaaagtaataaataacttttggttaagatgttcctattgggattatataccttaataaaggaaatgtaatcttttgaatacccatcttgagtgttatcagaaatggcctttactgtcatacccattagttcctacttgtagaatttctaaaagttgaaaatttgatttagttttttaaaatacttctcttgtttgaacaaatgtaatttgcggtctttatagacaaaaccttgtacattatattcctgggcatccagatttgttagggtaggtatttttgtgagtaatattctggctagctgagcattcattcgtttactcattacatatttgagtgactattgcgtggcaagtactaggctaagcactggggatacaaaggtgaaaaaaagacattgtcttatagaaaagtgacatttggtttataaagtttctgaagatttagactccaaggaaatgtatactttatactcaattgcatgtattagaaaatttgaccttggtcatatgttatctctagattttagctccctcatttatgaagtgaatgcatctggattaggtaacctacagattctcagagagattttaatagtctgtcggtgcctcatgattctgaataagggttaaaatttagaaaaaaatcctgagtaccagactttttttcatattttattcattagtatattgaatatgcaaataaatactgccttggacaatgtaacattattgtctttctcttatgtattgtatcctttccccaagttttgtctcaagtatttttgtaaaattccattcatcaaactattttttaaatggtttccaccagttgccttagtttttttaaagtcatcattcaaggtagtctttttaattttttttaaattggcatcctgggggcttcaatttcagctaaatctttaacctctctttcattgttgattcattgcccaaagtatcattaacattattaagaaactttggctttggatacataaccaattaatatgtaacatgaacattctcttcaatttttttttttttttttttttttttttttttagcagacagtgtagatttgcactgaatcctccgtaattcttcagccaggactcttctaggataaagacattatcagagaaaacacagcatataaaagtaaccacaaggagatggaactgcttgtcacgcgcattacgtttcaatgtattgactccaatagctagtgataacccacaaagagtctgtccatttattctgtacaccccctgcgatgcctgttctactcccgtacatacaatgggggttcaaaccaaaataatggctagcatatctttgacacaaattgtttttgggccattataatgtttgtttaagttttttttgtttgtttgtttttgtttttgagacagagtctggctctgtcgcctaggctgaagtacaatggcacaatcttggctcactgcaacctctgcctcccaggttcaagcaattctcctgcctcggcttcccgagtggctgggattacaggtgcctgccaccacgcccagctaattttttgtatttttagtagagacagcttttgccatattggccaggctggtcttaaattcctgacctcaggtgatccacccatcttggcctcccaaagtgctgtgtttacaggcgtgagccactgggcccagccaggtgagtcttttgactcaatacatttcattgaattacttacaagccttctaaaactattttgacactgaataagtaaataagcagtaacttaagcaataggaaacatcctcaaaatatcctaaaaattcaatttggaatgtagtttaaaaataaagaggctgggcacggtggctcacgcctgtaatcccagcactttgggaggcggaggtgggcagattacctgaggtcaggagtttgagaccagcttgaccaacatggtgaaaccccgtctccactaaaaatacaaaaattagccaggtgtggtggcgtgcgcctgtaaacccagctattaggggggcggaggcaggagaatggcttgaacccgggaagcagaggttgcagggagctgagattgtgccaccacactccagcctgagcaacagagcaggactccatctcaaaaaaaataaaataaaataaattaaataaataaataaataaataataaactaatggtgttatctattctgtacagttctctgggggctgattacaagtgctgaatggcagtattaatctctgttgtttttcacttgagtgatcctatacattaaagtcacagtgtacattgtttctctgcttgatttctcctcatctcaaaatgtagggtcaaatgaaagaggcaggtagatatttagagaagagcattttaatctaaatataaccatcacgtactattagtaaagaaattaagaggccaggcatggtggctcatgcctgtaatcccagcactttgggaggccaaggcgggtggatcatgaggtcaggagttcaagaccagcctggacaacgtagtgaaaccccgtgtctactaaaaatacaaaaattagccgggcagggtggcatgcgcctataatcctagcttcttgggaggctgaggcaggagaatcggttgaactggggcggtagaggtcacagtgagccaagattgcgccactgcacttaagtcagggtgacagagtgagactccgtctcaaaaaaaaaaaaaagaaaagaaaaagaaatttaagaaatggatccatgggaaatatatacatttgttgaattgaaaattatttttcaacacttggcttatatctactgtgttgttcacttaaaaagcaggcaaaatgaagatgatgctttaaaaggagttatagttagaaatttggaactaccatactgttccagaagacttgatttaatatctggtcatgagttgcacaattaataaattttagacctcattcaatatattttcatgcctgatttatccttgtttgagaactcaatacaagattcatagtaatattttagctttctagacaggatatttagtagccaggctcagggtggcattgtattggtatgccagttggtaggccttttgactatacattggcaggataacttgaatgataccctctcccaaacctgtcccacatcctcatatctctggcaactctattgtagagtagttagccagaggtgattgcttgtaggggaatataatggttattttctggttgttccaaaggaaagaaaatattatctccatgtattatttattgctatatagcacattgccccaaatttagcagcttaaaacaaatatttattatctaacaaagttcctgaagatcaggaatttgggtatgaatggttcctatggttctggcccagggtgtctttatcaggttgcagttaagctgtcagctgaggttgccgttatctcagtgcttgactgggactggaaaatctttccggggtcactcacatggttgttggcaggcctcagtttcttgctaactgttgattagatgcttcagtttttcaccctgtgggccttccatgaggttcacaatatggcagcttccactagagtgtaagatcagagagacagagagtggacacccaagatgagagtcatagtcttttataacctaatttcagaagtgacataccattactgcagccatgtggtgatcatacagaccaaccctaatcccctgagagaggggactacacagggtggaaatatgaagatgcaaagatcattgaggaccatcttggaggctggccaccaaactcctcgtgatggatatcatcattggtagttctctagctggctatctgtaagtctccaaagctacacttgaactgtctagcatttagattagtacagctagaggagctaagtttgaatttttaaaaaatcggccaggcgtggtggcttatgcctgtaatcccagcatgctgggaggccgaggcgggcggatcacgaggtcaagagatggagaccatcctggccaacatggtaaaaccccatctctactaaaaatacaaacattatctgggcatggcggtgtgcctgtagtcctagctactcaggaggctgaggcaggaaatcacttgaacccgggaggcagagaatgcagtgagctgagatggcgccactgcactccagcctggtgatagagtgagactccgtctcggaaaaaagaaaaaaaattctgggtattattcttactagatatgtgtcagattatcagatcacttggtgttaggcctggtatgtacaactgagttactaaaagatttcatcaagtaggtagcagatatttaggaagagtacttaaagaaaatgacttgtttttaaattttccttctttataggtccaggtttagttcactacagaggataattttgtttgctttgcaagacagccagactagaggttaaatgttttttttgacagtatgtggttacaaatcagtcttgccagtcctatgttaattcgttatttccactgtctccagactctggtgatagtgatacaaattaagataatcacatgaataaattagtggcaataatttctttgagtctttttcttggcctttaagttggtcactttgcattacttgtataaatttctaatgtaaacagagagcaaattgtgtgtgtgtgtatgcacatgagtgaaatctataatgaaatcacagtttagagaaggaattatacgtttaaagtcttcaattttatgaaaacaatgattccacatttcttcaagtggctgccatagaatggaaattgaaatccctgggtgggaagtgtgctagaaatcatagtattccttttcaaagtattttgcatccccttatacatatattcagtacttcatttctaacccctacacactaaatcatgctgtgattcataatactctgttatgttttaaattcaaatattgtttttaaagggaaattgctactaatgttggctaagctgcacgtaatagtttagtaaatggttgtaggtttgattcttctcatgtcaatctaaatgtgaactaacattattcaaaatccttttaagatactgaataattgtttcagttaactaaatgcttcatcaagtaatatcaatttatgaagtatggttgggtttagggcatttattatttaaagaaaaaagcaataggtacatacctacgtaacaatgttaatggatatgttttgggtgccatgtgtttgaagaaagagggattttcatatcttaacagaacaagtatagatcattgaaaaaatttaaaagtaatgtatgatttagtttactcttatttaatttgttaaaatatcagctttaatgagatataatttacagaaatgcaccaattttgatgtacattttaatgagttttgaaagttttatacattcatgtaacctatggaacatttctatcaccccagaatgttttcttctgtttttcttccagtcaaatactacttctcgggtaaaaactgatctactctctgtcactattgattagattaaactcttctcgtgtttcatataaatgcattcttatatgttctcttttttttccctaatatatttcacttagcatgatttttttttttttttttttttttgagatggagtcttgctctgtcgcctaggctggagtgcaatggtgtgatcttggctcactgcaacctgtgcctcctgggttcaagtgattctccctgcctcagcctcctaagtagctgtgattacaggtgcccacaaccacacccggctaatttttgtatttttagtagggacagggtttcactatgttggccaggctggtctctaactcctaacctcaggtgatccacccgcctcagcctcccaaattgttggtattacaggtgtgagccaccgcacctggccagcatgatgtttttgagattcatccatattgtggtgtgtatctgttgttcgtttctttatttttttcactttttttagagacagggtctccctctgttgcccaggctggagtgtagtggcctgatcatggctcactgaaacctgaaaatcctgggcttaagtgatcctcctaccttagcctcctgggttgctgggattacagacatgtatcatcatgcctggctttgtttcctttttattcccgagtagtattgcgttgtataaatatggccacactttgggaggctgaggcgcggatcacgaggtcaggagttcaagaccagcctgaccaacatggtgaaaccctgtcactactaaaaatacaaaaaaaattagctgggcgtggtagtgcacacctgtaatcccagctactcaggaggctgaggcaggagaattgcttgaatccgggaggcagaggttgcagtgaggtgagattgcaccactgcactccagcctgggtgaaagaggaagactctgtctcaaaaaataaaaaataaaaatgaaaaataaatatgcccacaattcatttatgtattcatctattgatagacattcaggttgtttccggttttgggctgttttgcataaaactagtgtgaacattcatatacaagtttttgtgtgtgtggacatgtgtttttctttctcttgggtaaatacctaggagtagaattgttagattgtataagtgtacatttaactttgtaagatattaccaaactgttttcccaagtggttgtactattttacattgccactaataatgtatgagagttccagttgcttcacatttttgctaatgcttggtactgtcaattatctttaaccattctgctaggtgtgtagtgtatctcattgcggttctatgcagattcctgatgacgatgacgttgaacatcttttcatgtgcttattggtcattcatatatcttcatctgtgaagtgtatgtcaaatgttttgcccattttaaaaatcagattgtcttaatgagttgtaggccgggcattgtggctcatgcctgtaatcccagcactttgggaagccgaggcgggtagatacctgaggtcaggaatttgagaccagcctgaccaacatggcgaaaccccatctctaccaaaaatataaaaagtagtcgggcatggtggcacgtgcctataatcccaaatactctggaggctgaggcgggagaatcgattgaacctgggaggcagaggttgcagtgagccaagatcgcgccattgcactctagcctgggcgacaagagcggaactctgtctcaaaaaaaaaaaaaaaaagaattgtaagagcttattatatactctgaagacaagtcttttgtcaggcatgtactaagagtatttcctcctttgtgtatcctgtttaaaaaaatctatgaatttttttttttatgtgttcttctagaagttttatagttctggcttttatatttttagtctatggtccattttgagttaatatatacatataacatgaggtagaagttaaggttcttttgttgttgtttttgttgttgttgtttttcacgtgggtatttggttgttttggtatcattgattgaaaacactgtcatttctccattaacttactgttgcacatcctttttgaaaatcatttacccaaatacgtgttagtcttttctagagtctgtattctgtttcattgatccatcttttatgccaatggcactacattgtcatgattattatagcttcatagtgagtctggaaatgggataatgtaagtcctctgaatttgttttcgttttttcaaaattgttttgtccattctaggttcttgcatttccatacaaattttaggctaaacttatcaatgtctgctaagaagtctactacaattttgattggatggcactaaatttgtagctgaatttggggagaattgacattttaacaatatttggtcatccaatctataaacctgatatggttgtctctttatgtaggtattccttaatttctcttagtaaagttttgtatttttcattttacaggtcttgcctatattttgttaaatttattcctaaatattgcattttaaaaataatattttaaataatcttttaaacattttaatttcctggtttttgttgctagaaatcagttattgaaacaaggaaatatatttcaagctaaattattagaaaaagcccttttgatttaaagtatgtgctatttatgagatctgaagaagcaggcaaactaaaactacttttccagattccgtcgcagctaaggtgctaaatatgaattaggttgtaccacttagatgcacttagatgagatttgaaatgtggacctaagatgatgccttggccagctctttctgctggaaagcacagtgatggacatgttgaatgtttctacaaaagcattccagtgtttggtcattagcttcatgggtgaaagtggaaggtacgatggcagcttcctgatccctaaatctcaggtatgtattcttgaactcagcagttctagtggtggcctcctattcccccatctggaagaggaaagaaggcagcagtgagccaaaggatgttcgcagcttctagaagcttgtaatggcaaggaaatagattctcctctaggcctctagaacagatagtaatttgcatacatcttgattttaacccaatgttgttgttaaaagacagtctcgctctgtcacccagcctggagtgcagtggcacagtcatcaccgtaaccctgaacttctgggctcaagtaatctttctgccttaaactcccaggtagctaggacacaggcgcatgctaaaaatgttatttttccaagaggcagaggctgaggtaggaggatcacttgagcccaagaattcaaagctattgtgcacaatgatcacacctgtgaatagccactgcactctagcctgggcaatatggtgagacctcccctctttaaaaaaattttttttttcttctgtggttgctaatatcttttttaaagtgcaaagagtcgtctcacagtcattagacacaatagatgatgtaatgccattgtttctttttttagtatttagagctttttgccatctgaaaaatactcatacaagattgctgatcgcccaagtttaggtgaatactcaggagaggaaattacacaattattttagataattatatgtaaagatttattaattgtgtaaatgtaatgtgagtttaataataggatatagcttaaatctctggcttctatttgaaaaatttctaaggatcacatccaggcatatgaaataaaaaggtgacatgttaatctgtgtataatttgtatatttctgcataattatatggtcaagtctcagactgttttctaattaatatttactgttgctttcatattgtttttatctttctttaatcttagaatccaaccaatacttttctctacattgctagaggggcaatatatatgtagagataaataataaagttgactcttgaacaatgcaggggttaggagtgctgactcctccctaatcaaaaatttgcatataacttttgactattaataaacctacagttgacttttttattgatgaaaatccatgtatatgtggacctgtgcagttcaaacatgtgttgttcaagagtcaactatatatatatatatttttttctcttctttttgtgaaaactgtccaggagtcaactgtgtataaaacctgggagcagtgaggcacctcccagacaatatctgcattattactaaaccctagaagatagtgtggataatttggagctaaaataatttaattatattttttaaaatatttgttgataggtttgtacccagggctttcattcaagatagagtatcatttatttcatagcctatattccactagcagaagcttactttttttttttccccccttgggtaattttttttaattgtctaagggattaactgtcacctcattatctttgttaatcactttcagagcttttcgctattgttcatcacagtagtcaagaggatcacaaagaaagtgctaaatccttatttacaaagaaaattgattctcagctttgcttatatctgctatatatttcctttgaatatttgttagggtagcaatggttaaaattaaatatttattgagaagtgatttttaatgttgtgggaaaatattttatgtcagaaaaatattgaatttcaaaaccatggaaaatagaaaaaaatcattaagagacttgactaatgtctcctcagaatggtttacaatattctgctattcatttactttcttcatgagcagtgatcttgaaagttttgaagaaagacttttgtcttttgttaaatactttggaatttttttggcaatgtgaagaaattttatttacatgtttgataagaacatccacagacatctcttttaaagataaaaaacttcaatatgaaaattgaagttataaactaaagatcctctctcagctaagaattcctttttagaaatgtataaatacaattatcctttaataaataaacatatcttcaaattttctcagtaatgtgtcactgaaacacattaaaagatgacatcgctactcacaataacagtacaaaatgaagaaaataattgaaacatagatcaaggatgttaaagatgggtgaaaaaaattatcttgctttttataactaaagtttgtttaatattcataacaggcttatagaattcttaattgttccaggtaaaatacctaattttctttgttttgaaagcattctctttttcttactaaatcaaaaacagagaaaacttagggtacacgaatcaattatggtttttagaacaacaatggataagaatgttttaaagatttaggaatcttttaatctctgtgacgtttcatcatttccattctgtgtcgagtttttggttgcaaagtaatagaaactgatgttgaataacttgagtagaaataaattcattggatatcaagcaattctcagagtatattttgaaggctggaaaatgggacttgggaaataaagaggaaccaaggcaggctaggcccaggaacctctacacagatcaacctgcatgatacagtttggatatatgtccctgtcaaatctcacattgaaatgtaatccccagtgttggaggtggggcctggtgggaggtgtttgagtcatggaggtggagtcctcattgcttggtgccgtccttgtaatagtgagtacttacagaatctggttgtttaaaagtgtgtagctcctcgcttgcactgtctcatgagtaaaagctccctgaggcctcaccggaagctgagcagatgctggtgcaatacttatacagcctgtagaactgtgagccaattaaacttcttttctttataaattacccagtctcaggtatttctttatagcaatgcaagaatggactagcacattaatgttgactaacttatgtagaaataaatttgctgaatattgggcaattctcagaacctgggaaggctagaaaatggggcttgggaaatacagagggacccagccaggaacctctacacagatcaacgtgcaggatcagtcttgttgtatggatgctcctctcagacacacatcagtgctagcactactggattcttaatgctacttctgctgttgctgctgcaaatactttatcacctgtatctgtattttgccttactccctcaagattcaaagtccagaattggactatccaaatatattggtcattagttggaacataaatttctttttttttttttaattttcaaacatctcaacagccagatggagcataaattttatcttgtagatcagtgttttactctcacaaagttttgtctcccagttgacactctaatggagtttccagttcagcttctctaagaggtgagctgctttttgatgaagagatacatagaaccagtgaattctctgggttatcagctcatggctttatttttatcactgtaaggtgagctccttgttcagaatcaacgtggtatggtataccaaatgtccattacaccttcagtctcagattttctttctcatcttcactctgtatcttccacctgcagcagcaataaaggtatcacaaacaattattttttagaattcctcaagaggaataatatttgttctactgatcatcctggtttcagtagaattatcctaggagtgagcagtaatcatatgcacagattcagacatcaggactctattttattttattttatttatttattttgagacagagtctccctctgtcacccaggctgcagtgcaatggtgcgatctcggctcactgcaacctctacctcctgggttcaagtgattctcctgcctcagcctcctgagtagctgggattacagtcatgcaccaccactcctgtctaatttttgtatttgtagtagagacggggtgttaccatattggccacactggtctcgaactcctgacctcaagtgatccacctgcctgccttggcctcccgaagtgctggcattacaggcatgagccatcgcgctgggccaaaacccttaactcaaatagcacttcaagcatcagttctctgtctcctccctttctgttttcctgtgctgcagagatgccatcttataaataattctgtgagcctagttatcacaatgaattgtaattttgttttgtacatcatcttcctcatggactatgaactgctggagagcaggaagttttaatttgtctttgtgttttctgcacttaacactacatttgggacacagtaatggctcagtttttaaaatcaaagtaaaatatacatacagttaaaataaaatatattgaaggctttataatgaaaatcaacagtctccttttctaacctgtcctgcttcttagaggccaacatttttaacttttctaagtagtcttctggcagttatttccatatttctttaaaaatatgtttatcatggtatttcttgattcatcaattttagaaaatttattgaccacccgccaacattcctgagatatgtatgtatgtatgtgggtgtgtatgtagctgtttttgtttttatgaataattagcatgtatattatttgaactatgcaaattacattcattacagagccaagtagtgttttgtaattatattttccatcttacacagctttcttttctcgtcctcttatactatttgctattatatttcctttcttatgccacttctataccttatatattatctaatgtttctgtaccgtatgtatttcttaatttttttcaagccctcctgtagtgggagcggtcgcagacaaaacctcttggacaccggttttaggaaggaatgggctttagtcagctgggagcatcggtagacgctcatctcaaggtccaagctccccaaagtaaagattcctgtcccttttatgggcttacaactctaaggggtccatgtgaaagggccgtgatacattgcgcaagtgggggctatgtgactgagggctacatgcatcagtgatgggggctagcagaacagaacagaaggtttcacaatgtttcctcatacaatatctggaatctatagataacacaagcagttaggtcaggagttgatctttaactaccaggcctgacggaatacttctcagccataaaaaggaacgaattaatggcattcacagcaacctggatgagattggagactattattctaagtgaagcaactcaggaatggaaaaccaaacatcatatgttctcactcataagtgggagctaagctatgaggatgcaaagaatgacacagtgcactttggggacttagggggaaagggtgagacgggagtaagggataaaagactacaaattgggtgcagtgtatactgctcgggtgatgggtgtgccaaaatctcacaaaccaccactaaagaacttactcatgtaaccaaacaccacctgttccccaataacttatagaaataaaaaaattagaaaaagaacacagagtggaatggggacaaaactgtaaagtttttgggatatacatgatctagaacatgaaacaaaaaagtacccgttttgataaatagatttcatatcctcctgtaatattcacaattagaacacattcaatattgtgactcaaagttaaagaataaaatgttgcatattttcaaattgcatggactcctttagagattctgaatcagaataataaaataattaaaaataaacataaagaataatgaaaaataaagctatctaacaatagttaatggctgggtttttaaatgaataaaacattatcttatcattatcttaccaaaagacaacaatatttcaaatctacttatgaagacattaatgatatgactatctagtgtctactaaccattattataacaaccattttggtggagatttactaccttgttagaagaatatcatggctaaaagaagagaaatagcaattgcaagttatcgtagaagtataaagacaaggtcattatagactgatagttaatagagcaatagaaaaatgacatttgatatgaactgttttgattacagaaaaggctgagactcatttttacattcatatatttataagaaaattccaggtttataagattgatccttcaattatttttttcttttttgtaacatacaatgagtaattgatgttacatttttcaaagggcaaaagatttgttaaatcaaaagccgtatgtataaggtagagagtatttcagggagaccagtgtattatctctctggttctatgtagtattctatcttttttttttttttccgagacagagtttcactcttgttgcccaggctggagtgcaatagcatgatcttggctcactgcaacctccacctcccgagtttaagccattctcctgcctcagcctcccaagtagctgggattacatgcatgtgccaccatatctggctaatttttgtatttttagtagagaggtgatttcaccatgttggtcaggctggtctcgaactcctgacctcaggtgatccacccgccttggcctcccaaagtgctgggattacaggcgtgagccactgtgcccagccaggattgtatcttttaagcagaaaacttaatagctttgttcatgacttaaaaaaaataccatgagaatcattttaccaagtaatttactttatacaaataattagaaattatgctatcactaaaacatagtttaaatatttttgaaaataacttagtgttgtcataaaatagaattggaaaaggcgggtaaatcaacataattggtaactggcaaaagtttcaagcattctgcctaagaactggagcaagacaaggatgcccattcttaccactcctattcaatttagtactggaagtcttaaccagagcaatcaggcaagagaaagaaagaaaaggcatatagatgggaaaaaatgaagttaaattgtctctcttcattgaccatgtggttctgtacctagaaaaccctgaagattctgctcaaagactcctagacctgataaatgacttcagtaaggtctcaggatacaaaagcaatgtacaaaaatctgtagcatttctatgtaccaataacattcaagctgagaaccaaaacaagaatgcagtcccatttacaatacacatacctaggaatacttgtaaccaaggaggtgaaaaatctctatgaggagaacttaaaacactgctgaaagaaattatagatgacacaaacaaatggaaaaacattccatgctcatgtactggaagaatcgatatcattaaaatgcccatactgcccaaagcaatttacagattcaatgctatttctatgaaattaccaatgtcacttttcacagtattagaaaaactatctaaaattcatatggaaccaaaaaagagcccaagtagccaaagcaagcctaagcaaaaagaacaaaaccagaggcatcacattacacaattttaaactaaactacagggctacagtaaccaaaacagcatggaactggtacaaaaatagacacatagaccaatggaacagaatagagaatcctgaaataaagccatatacctacaaccaactgatgttctacaatgtcaacaatgggggaaggataccctattcaataaatggtgctgggaaaactggttaaccatatgcagaagaatgaaatgacatctacctctgaccatatacaaaaactaacttaagatggattaaagatttaaatataagatctcgaaccataaaaattctagtagaaaacctaggaaatactcttctggacattggcctaggcaaataatgtacgaccaagtcctcaaaaacaaatgcaacaaaaaaattgacaattggtcctaattagacaaaagaacttctgcacagcaaaataaactatcaacagattaaacagacaacatacagaatgggagaaaatatttgaaagctacacatttgacaaaagactagtatccagaatctataaggaatgtaaacaaatcaacaagaaaaaaaatgccattgaaaagtgggcaaaggacacgaacagatacttctcaaaagaagacatccaagtggccaacaaacatgaaaaaattctcaacttcgtgaatctagagggatgcacatcgaaaacacaatgagataccaaaccttagcaccatacaatatactcatgtcacaaaccaccacaagtatcccctgtatcttaaaatgtgtatatgtatttttttttagccttcaaatgtaaattaacatggagcccaagaggccaaaaaacagctgctacaaaatataccagatttgtattatattgaatttgtggcccaaaccagaccatatatttttctgcttggtaaaaatgtgatagtgaaatgggagagttcctttgaccccctcatgggacttgcgacagggttggctcgtttgctcagctgccgtgcccaaaccccttgtgggaaagggagcatacaggtgagggggtgcagtctctggggtgaatgtctttgggcactggcaggaacaaacctgcagcagcctctaggggttgcccacaacctctggagcccctaagggtgtgtgttacaaacaatgctcttttagcatttgccttctactgttggctaagtgttaaccagctcagtggagggtcagggtgacagctttttacaccctgccctcttggtacctaggttcttgtccagtgtccaggaagaatcagatcacacggacttgaaggatggtgaatgcggagatttcattgagtggtggaagtggctctcagcaggatggagagttggaaatggggtggagtgagaagataatcttcccctagagttcggtcgttcccagcccaactcctctttgaccatagtctctgatgttcagctgcctcttctcttctcgacgttcagacacatcttctcttctttccttctctgttgtgctgccctgctcctctgccaatggaggttgtgatttttatgggcacatgataggaagtgtggggggcaaaaaggcagcactagggtaggaaagcggagatgtgaagttctcatttagggccgcaggtccaggctcgagggtggaaccctcgccagggaccccacccttttctactcagtatttccctgcctcctgtccatatcaatagatgttggcagttcttttagttaacatagtccaaggtttttcttgaatttttgtatgtttgtgtatatgtatattttatatgtatgtatgtctgtatgtatgtatatatatcttcaattttctcagacttcataccacagcttagagttatgcagtcacgttaaccataataactcaaattccaccagatacaactccaaatgcaagtttatgatgactccatgagtttgtaaaactgttacagactttcaaggatctcaaagcacgggcagaaggcatttgtttctgggcaatgtgctctgcttgttggagtgacccagctaaacagagcaagaagttattttgccttttcctgccatttctccatgcatttgggggctttaagagtgctttgagtctaagaaatatatttgaaatataggttggaatcatctttgttccagtcatgttgaacttaaggctaaagtcaaagagcccaactcttcttacagggctccttgagccccaccagtgaaattgtttcttatctgaccagcctagacataccagaatctcacttagactcaaactgacatccctaccctacaagctgtgaagctgactttgaagcaatgtggaatgtgtttgctttggtgactcaggaggttttatatatatgtgtgtgtgtgtgtgtatgtgtgtgtgtgtgtgtgtgtgtgtgtgtgtatgtcttatggatggtgaattatactgttaattcaaactaatatttctggataatacatattatattcctactactgtttcggtttgttcaatctgaaatagccctagctggacctgtatctctttgcttctttcctggtctctatgttatcatacttacttcaacatcatttaacataatggagctactaatgactcttccaaggtttttgttgttgttgtttgagattgttactttaatgggaccaaaagaagaacgtataagacaaaagaataaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagacaaaagaataaaacctatcagagtcaggtgctaatttacccataattatgtagggtctcattatatgatcttgttaaagtttgtgatagtgattatatatatgtgtatatatatgtattgagacaaaaatctctaaatgataaaaataattagtaatccaggactctttatagagaagctctctataaagatgagagaattttggggggaaattatgacttcttgatactttcaatgggctttcggctatgaatgtttgagattctcatggtgctgcattaagtcaaagtattccatgtaaaacagtggtactcttggtggaagctaaagaataacctgccttgtagtctctgatgtttcaaaagaatctgcccaaacatatgatctccatcaactgtaaagttagggcctggaatcacacctttcattttctttttgtctcctttagcagccctgaagagttttcaccaaattgcaaactggagtcaggtaataatgtttgtttctgagctttcagaggaagctgtttattttagtaggcaattttcatgtgtgatgaagtgaaatgttgagaaggcagcctctcatcagtggacaaacaatgcctaagaatttagctaatggccccccttcagtgcagagaatagatggtaacaattggacttgcatactagacccagagctacttgtttggctgctaggtgttaatgcaaatttgttcttcagctcattcaaccctggggctcccatcctttgatttaattaaatgtaattggttacattgctcctcccaggcccccgaggtgtttttgtttattgcttactctttgcaataaaacttcaattcatggcacaaaatgctggataaataagagtctttttttcctgtgttggatttgttgggagattatttctttcaaatagtttggctttactgttaaaagtaaatgaccagtgaaataaactcattgggtggcaaatgtagcatatccagaagcaaggaattaagtagggtaaattacatgagattaggaaaagataggaagttgtaatgttaaattagtaaagatttgcaaaagtactataagagctatcaacactgtaaacaaagctttaataagtgagattatcatttttgtagcacgttattaaaaagttactttaaaatttcagttatgaaatactcaatttattttgtaatcatacataattctcttacaaatatgcaggtggcattgattcaggataaaagtgagaataatattgatttaaattaggtcagcacaattaacctattctttttaatgagagatattttccctctgaagtaagtatatatattttttctacctgaagatattataaataacattttttggtaaactgatacttttttttcccctttcaagttttaatcttaatttgagaagtggggtaaattaactttgtattaacttctgaggaataactcagaaacttaggaaaattgagaaaatattattagcacttcccaattcaattttaagtaccaaattgtataaatgacttttttccctttttgttactgtcaatgggataaaatggcctccagaagctgccatttattatagtgctaactggttagttcctttgttgctttcttctttccctggtctttatttttcccttttttactgtagaggtaacatcagtgacattttcattagtgcaatagactttctaaatcttgctgtgtcacaggcctaactcatatctcttctgatggaaaaaatgaaaaatctgtgataagaacctaggtattcccagtgcaatatgaagcttcagtttcccacaataggattgttttgcagaaatttttttctaggctcctctcacattctattgttgagatactggggttttaggcttatcatcttgtgctgtcgggttaggcctttcttctggtggatgcccctgatgaaaaccaagtggtaatagacaactagaaaacactcccattgggaaatggggaactagtctaagatgttagctcaattgtaagtgttcagagaagaaatcaagtacccaatttacttcctggaaatgagctgttaaaaaggctgtgcttcactttcagagcaagctttgttcagctcctaccagctcaggtataggcagaaaacccaactgtggtcctgggtccaaaaatcttggatggaaattacaggctttcttgacagcaaggccaggatgatttaacttcttggctggtttagtcgcatcttaaaataactcttgccccacatacagagaaataagaatgtttaaaatattataatgtagtggttactgagggtttcctttgtaaatgaatgtaatgtcatagacaaaagggagagaaatgttccagtggtcttttagataaaaccagatactcctgtacttgagtaattttcctccctgcacacgggtaataataagcccattgcccatcccctgactctcctgtgactctcctgaatccacagctttgattggaaactctcaacccctgaccagccttgggagcactgattacgaaggcaccccacatacttccttcataaacatttggcagatcaggaagtgctgaaaagcaatgcccctgggtctcagaagagaatactggtgggagaagaaatagaacattttccctcttgcagctgtcaaagagtgattatgtcaaatgggttttcaaggagccacgaagtaattacagggtaacttcttgacattattttccaatgtttgactcagcagatgatgatgaattgatgcatattattttatggctctctgaaactttgtttgatacttcagatagaggcagagctaagtcttcacttagactaacataacaaagttgccttaaattttaacatgttaactctttctttgtaatagatgatttcctaaactaactggtcttctggttgctaatagagactgtgtttgagctaacttttcatgtaaattaaaaaaaaaaaaaacatatgctttccaagtagtgtttcattcttttactaagatgttactgttaattttccgtggctattgtgagaattaaatgagttaaataatgaaaagagcttaatagttggcacatggtaaatgctcagtaaatatcagctataataaaacatgacatagtaatcattaaactcagaaacgtatttccttatattctctctcaaatgttgtccttttggcagagaggaatttgaacacccagctcattttcttgtgtagttatgttacattagagctggtctatctattggtttatatctttttacaaattttagttcaagttaaaatagttgggagtatttaaatacagtggacttgaaatacatatatatatccttttccagggtgtattttatatatgaatgtctaatattatttgattccaagcaagtaattgattcaggtaagccaagatctggacattcatgactgatgcaatagaagtgaagaaagatgaattaacatagtaagtaatacatatcgtggaacttttactgagtttgtaagctttaagtgtatttttttttcaaatccaagttgtcaatgatataagcattttgtgatcttagggttttcataagtttgtatacgaaaagatgttttgtagccagaatgtttcttataagaaaaatggaagtgtctgacattatgagaatttgtaacactttttgcttagtctaaattaaaaaaagtcttaagttttatttttgcctttgtttcatgcaaaataagttctatatgctgaccctaaactgttgattaaaaaataattatactgagcatgataatgtcatatgaatgacttggtatagcatgaaccactaatatttgattaacttttgaaaacatgcttacatatggcttatgcaagtaagtgcttttgagtagaattttttaaaaattcagttatcaatgtttattcaaagtattatttttcctcaatttaagagaaatcttttagaatcaaagatcttgctatagtgggatctcaccatgcccttttacataccaaatacattcatctgtctggtggtgtgtctgtgtgccgtggtttgtaaataaatgtgtgttttgtaaacaaatggagtaggtgagttgtttgtaagctgtgctgcttctgcctgccaactagatgtatcatcaacattccaggtacaaaagatgtttaaccagttcaactgaatagtcctcctttgtgtccacacgtatttcacaaagaaaagatgctgctttcatggtaacagaaggatggtagtctagggtttgcagtgccgtcttcattatgtgtatgctgaatgaaaagaaaccaagtattcaactgtgggctgctgtacgtttgtgagggatttttttttttttggtgttggttgaggtttccattgatagaatattttagacttttaaaaaaccatctgtttatctgaagcacaggaagtgcatccgtctgttgactttattaagtgtattgcaaataacagatggcttagtattaggtttgctcttctgtaggaatttgttgcttctaaaagtaacaaatttttgtctttcaatattaactcatttaggatatttggactgatgtttgatttcattctaaaataaagctttcattgacaatctgacctaagctctccatttatgccctaattgtaatattgtcctactgtatggtaattatctgcttacttggcaatgtccttagcaaagaaggtagtgactttgtcttattcaatattgtctccccaagatcaattaacacaagtatgttgaatgaatgaagcagctttgtgtgtgtgtgtatgtgtctgtgacaatccagaagaaacatccagagatgctgtaaattcctctgatttagggattggtgaaattcagctattttgtgaaagctctcctcccatttttagataaaggttgctaataggtttccaacaaaaaatggcagaaacctagactgctaatttactgtttatgtttgcatatattaaactaggaccctaaatgaaaatatcagagtagcatgttaatcacaatttgaggtcaagtcaattagaaaacattataagtaagtttgctgttatttccaacttcatataatggcatcattgtctctggggcacgtatgttttcaaatatgagcatcgttaggttcttttgaacaacagtacaccatctaatgaatttacatacgtaaatactactaattaacattggtttattattttgcatttcactgctatttactaacagatttcaagacaatggacaattttgtaacctcgattttataaaaaccactagtatttttggtccctagcaaccatttagtatgtaaattaggtattctcaggcttaatgtacttcatttttataaaacaaatacatcattaatctgattaagttcttgggtggaagtgctgtcctcagatcattgtggattatttattgttgggcacgcatccaaaaaaaaattcaagcatggcacttacagtctagatttaggagaattgttgaaaccccctaaatgacattttccagaagaatagaaaggcactgcttacttacaattgcaagcattacctaaaacttaatgatgttcttatccttaattacaactcagttggatgatgattcagtgcctgaaattatgccatgttttgctttgatgttataaaatgtataatgaaataaaggtgatccgagtgaatcaaaaatagattctggctttccagtagtgacttaatcactatgtttctgacttcacaacttgcttgactgtcatggctattatttggtatgtctttagcttttagtcaaatttactacttaagaagtgagaatgtttaattttaaggttaaggaaagttcatgatgttctcattcacatagcagaaggaccttttaaagaaagcttaaaattatttgaattctgcctttttagttcatagtttaccaagttgtatatcttccttttggaggtagtctttgtctaatggagcacgacataataatggttttcatttactgaatgtctcccatagtacgtcattcattttgcctagaaatcctgtgaagttcgttatgtttatacccattttacaaatgattaaacaaaggctctgtgaggttaaggagatacccaaggtcattatagatagcatgtgcttaatctaggaatcaaaccaattctttttttcttttttcttgttttttgagacagagtctccctctgtcacccaggctggagtgcagtggcgcaatctcagctcactgcaacctccacctcccaggttcaagcgattctcgtgcctcagccacctgagtaactgggactacggatgtgcgccaccatgcccagcaaatttttttgtatttttagtagagacagggtttcaccatgttggccaggctggtctcgaactcctgacctcaaatgatctgcccacctcagcctcccaaagtgctgggattataggtatgagcccctggtccggccaaactcaattctcacttcagagcctctgcctcctcagatagggcagataaagaaaggggacaccaatttccaaggcatgctaggctgggatcatttcagacaaggattgggaaactttttctgtaaaaggtcagatagtaaatattttaggttttgaggaccacacagggtttttgtcaaatattcttatttttaatttttttttttttacaaactttaaaaaatataaaaccactcttaactccagggccatacaaaaacattctgagggccagatttgaccaaaagtacttagtttgccaacctcagatttaggactgtgtcagtaagccctataggtatctattctctcaggactatgtgattacagtcaacaataaaataacttatatccataatagtgacttttaaacactaagaaaatggataaattatggttctctatgccctatttaagaaggcttgcaagtattacatcttagattttcatcaaaaaaataaaaataaggttttggtgtttataatgatattttaggtacctgaaagattcaactttttgaaacacttcatttcataacagataaaatgaaaggtattattacaagtggattttgacagttacagaatttataacataccattttagtttcatacctgagcgtttaattttatttttaaaaatcttacctccttgatatttgagtgcttactattctgtccagatttttcatattgcagactgttacttccttacccaccccccaacagtatacattttattgaagaatacaaaggagtagctgagaaaatggttctttatccttcttaagaaaaaagcattttataacaataggtatcagttatctgagatttttgctgatagattaatgtttatatacatatgaatgtttctttctccaactccttaattcattaaccatctatttttgacaggctaaagtgaatcagacttctgcttcaatccctttgcttaaagaggccccaagcagggttactggggggatagttgttctgttggggaataggggatggcaagggacctggggccgtcaaaccagtagttgaaaacgttttttatttaattcctttatgtccatgtttttctgatttctttgtttttcttcaagccataagccgttagtagtgttcttttgaaaaagtcagtattggctgatcacagtggctcacgcctgtaatcccagcactttgggaggctgaggtggttggatcatttgcactcaggagttcaagtccagtctgggcaacatggtgaaacccccgtctctacaataattataaaaatcatttgggcgtggtgcatacttgtagacccagctactcgggaggttgaggtaggaggattgcttgagcccaggagtttgaagctgcagtgattcagccactgtactttggctcaggcaacagagcaagactctgctacaaaaaaaaaaaaaaaaaaatgatcaaacaggattcagattcagagaactactaccttctctgagtcttcttttctatgtttgctcctccagagatccaccaagtaatgtgtgtttttttttcctgccacctctactggttttttaataaagtaaaaaatacagacagcttcttattccatgttctaagctctttatatgtattagtttacattatcttggcagtaactctttgagaaaggtacttatagccgcatgagaaaactaaggcaccaagaggttaagtaatttcttaactagatcaaggtcactcagctagtaaaatggggagctgggagttgaactcaggcaggctagctccagtgttcatgctcttaaccattcctctaaactctttctcaactataatactagacttgcatcttcctactattaaattcaatatgagtgaatttgtttcagtaaaacaacattattcattacattaaattgataagttaagtttgaatataattggttttgaaatttcatttgtgtttagtttataaacttgttttggtttcatggttatataaaagctataactttgaggaagttttacttgtttttgtgcataataattataattacaaaaataataagagttaaagagtagtcctcaacaactataaattttttcctattcatttacataacattgcttaagtttaggaaacactagtctgtgacgtaaagttaggctcttaatgcagtatagagttccttaaagatatgatccctacctgtcttcagtttgatttctcaccatttccacctttatactttttgacactgaactactcaggtgtgtgttttttgtttgtttgttttgttttttttgagatggagtctcactctgcagtgcaggttggagtgcagtggcacaatcacggctcgctgcagcctttgcctcccaggttcaagtgattctcctgcctcagcctcttgagtaccaggtgtgctttttgtttgcttcaactcacccttgcataggactgtctcctcttatctgcccctcctactgggaaaatggacacggcatccccttaaccccttgcctgatcttggttggtgcccttttttggtaaccgcatagtgtcctgtgcacccttctctcattttactcaccacattgtttcataatttttgtacctgttttaattaaactgatgacctgagcaaagggacaggtacagaagaaacagctatagtgaaaagtaaccatactttcctggccagttagtttcattttcttgaagccaccatcttttttttctcactgtcttttggaacccaaattgaaaccaccatcacttgttattaaaacattaagaactctcattgggacacagtttattatactacattctttctcgtataattagatccttctcttaccaccccaatgactttatcctacaattaatcctctctctctcctacatccttaattcctccttctttgtagagtcatttccatcagcaaacaaacatgtagtacttcccttcttaaaaataattctctcttgaccccatttccaatctagttgttgttccacttccctgccacccacctcctcttttgattcctttttatagaaaaactttttggtagagttagttctagttgcttcccctcacattctttctgctgatactggattcaagaaatgccaatatgggccgggcgcagtggctcacacctgtaatcccagcactttgggaggctgaagcaggtggatcacgaggtcaggagatcgagaccatcctggctaacacggtgaaaccccgtctctactaaaaatacaaaaaatcagccgggcgtcgtggcgggcgcctgtagtcccagctactcgggaggctgaggtaggagaatggcatgaacccgggagagcaagactccatctcataaaataaataaataaataaataaataaataaataaataaataagaaatgccgatatgctgggaggacttacatccatctgaaaacgtttccagggcttatgaatgctataagtcaagaaatgtcaggagccaacaacagagttactgaatgaaacccctgaagataaatattttctacttggagacaaaggtctcattggcaggctcaagcctctcatcttttctgacagtgcctccatctcatgggatatggcttcttatggcgcaggtcagaatgagaaaggagagtgcttagaggtaaagagtgttgaattagaaagggttttatttgttgttgtttgtgtttacttatacaggtcttataaaaatgtactcatttgagctggacttgggatgctgcatcctctagtcccatgattctagtgcagcccatgatttccttgagtttcctgaggttctaaaagccaacttgggctcttgatgtaacctcgggacctcagggaaatcacacaaagagtgggtcttgatagcagtaatagaaaatacggtattattttattttttggatgaagaacccaacattcagattgtccccagggcaccatgctagtaaatactagtaaatgtcaatgctggcatttgaaaaccagatcctacctcatagcatgtgctcttcccactctttcacctataaaagatacacaaacactttaagtcttaagctgcactatccaatatggtagccactaactctatggctttttaaattctaaatttaatgaattatgataaaatttaatttaataaattaaatcaaaatttcagctccccatttcacatttcaatgcacatttcaagggctcagtagccacatgtggctactatattggacaggaatgatatagagtatttctatcagaaagatgtattaagacagtgctacttcctttccaagacattaattttccacagtagtatcacatactcttagaattctgtgctattggtattgatcgtaattgtagaaccttttatcccttattttttttattatccatttttaatatcatggtattatttttcacagaatccctcttttacttggtgtagtcagaattctccattcctcctcttaacttacattttctcttttcttaaaatggcctgtttggaattagccttgccacccctactaatttgaattccacatcatgaaatgaaagttcctactttgtgcttacctggccagtacctgggggaattcacctattaaatcatattcttccccttaatatattcctttggttcctcttccttaacaatttttttctcacttatttggtgtctgttaaatatcaaaacacttttcctgtgactcaatatatgtttatatgccaagtctttttttcagtttgaggtacttgaagttcgtgccttttcatttgacttgctggaaaatagttattccttccctacatcatgagttttcaggattaaaaggttttttgacctttaaattgtaactaataatttgcctaaatcagtgttgctgggtgataacatctaggataacaagtgagttacaggttcacagtgatgactcggaattaatccttagcctgtgtcatcaagcttgcaaatagaggagtctttagaactaagactctatctgctttctctcatggcacacggcatagtaccaagcatttcatcttgtgcactcaatagatgtagatgattaactgtataaaaagactgcgctatcttagggtagggttaactatctcttgatacttctttttttttttaaacccaacacagactgaataatatagtgccttcgaatatctttcagattggtgcattgatatttgtagatataatttcaaatttagaaagtgcttggtcttctgccatatcactctgtaggtatgtattctccttatataactagttgtactgtagaaggtgatttggagccttacagctttaaatcattcttgcctttttaatatttataaggaaccacagttttctgtgcattttgacatggtagcttttatacttgaaataatataatggcaaggaaaatatcctcttttatctagacttctaaggcttaagctttgttttttgttttttcattttctttcagcacctgcggtatgcagctatatacaaggctgatggagagcaaaagaggctgcccgatagcactttaaagaaaagttattaggctggtcttcaaattggcccttgagaagcaggtagctcccttgctactaaacagatgtgctggtagcagcttgggaataaagagcagcagcagagtctggcccaaatactcatttttacccaagcaagactccagtctgagagaaaaagaactgcttagataaggtgaatgaaagagaagtatgtatgactcagttctttcatttgccttgcaaacccatctgtggctctagtggagagcaggtcagaagcccaagagcaatggttatcatttcccatagagttgtgtgtatatatatacacacatatataaagcaaaattatatacataaaaatgatatatatctctctatacatacatgttcgtatacatattttacatctgctcattttgctttgttagtctaatgccaaggtttctatgagtatggcacccttgtagtccttcacagaacagacttgaaacctatggtttctaggcactaaacgttatctcttgctactaagccatattgtattcctcacattctcaggtcaaaccttttgatgactccttgcatttcaatataatgttagctctgtcttcaagggctcctcttaattctctgaccgacttctactgatgtttctaaatacaattgaaatgctaccttcttgttaaagcctttccaaattccttcaggccagtggttctatcccttgtgctcccaaagtacttagttcatcctgctgttgcagcactaggcatctactgtaattatcactttatttgtctgtcatccctctttctgatgagctgctggagcagggattgttttcatatccttaacatctagcacagacctagacttcttaataggtgctcaataaatgagtgactgcaagaataaatgaatgaataaaatataccacctcatgtttgaaatgtacttgaattcttccaaccagccttttcttttgtgctgcttttctttatcttcttcccggcagcacgttcttctgtcctacctggtagattttagagcttaggaaatacgtgtttgaagatttaaaatatagttctttgaactccttagaggaaaagtctatgaataaataattagactcatttcacatcaaaatctaaagtgtgaaaaaatgttcgtatcatttggtgctttattcacttgtatggtaatctaatggcatacccattgttaacactgaactgtactgaaatattttactctcagggcttttcatctgacaaaggaggctttttgaaaatgaaaaatcacagctcctgtccctggtatgctatggggaaatttattagttttgtaatgcatgggttaatattaccatttttttatattgaatattacttgaaaaaattactattaatatcactgcagcatgtatgtatataagtcctgtcatctttggggtatgtaaatcaggaatgttgctgaagaactacttagcattttcttgggggtgaagtgcttagttttggaatttaattgtaggttttacatttaagctgctcagtattactcttctaaaggttctataaatttcttgctttgtagtttaacaggtttagtcaccacagttgaaaggcatcatcctcataatgaagccagagaagaataaaggttgatcatgcagggctggctggctgtgacattgaacaatagagcttgacttcttcatgtctgttaaattagactatggggtgtgcttatcttgctgcaatgatactgaattgtaacatgaaaatgttatgttgtgcagctctgcgaagggagttcatccgttctcacctcatatgtatggcaaaagctttaaaatactactgaagctgcctagtgggcttaaagtctaatggcacagaattgggcataataatgaaacaaataaagaaaaagtgcaaaggcttttaaatgtcttgtacaattttatttatagtagtcttttaagggtctaaggcagaacacaagaagggtatgctggaaaaattccatttggaagaggtctttgaaggagataagtgttacggcctgaaggaaaagtaagaagatatgttgcgtaggtgagtgatttattctaaacttttctacacgtgtacttgatacatacaactcaattctttaaatattgataaaatacctactatgttcccagcaccgtgttggataccataggagattttgaaagagcattaaattcagtcctgccttgagcaatttagtattttttgaggcgacagaaatgaaatccatgaaataatttcttagaattgtcggatatgtgaatgacagtattataagctgtcaagatcatgtaaaattttgattctgttattatatgtatcattcccagatgtgtcacatgagcttttgataggcataccttttatgttttcaagtctctgataaaaatgttaaaaagtcaaggccatggttaggttaggggcaagaaagagccttctgacacttcccatacttgttcttcacacatgctttttgtctacttttgaacctgtgttattttctaaatgtgtataagccacaaattagtaatctgttacaaaattttatcgtggatgttaagctactgttcaagttatacacacatacatgtgtgtgtaaaaatctggattaatattctagttctttcagagcaattatcctgcaaatcctgccaggtgatgggaataaatagggtgcccatcacccagaggtttccttttaggggaagtaagagcatgggagctaaccaacaccaagcaccatgtacccaaatcttagcaagcataactatagctaccagttatctgggcatgtcacaggacatccaaggaggactcaattccacagtttcacctgggcattcggcttatgaaaaggagtccatgcaaccccccaagacacatttttgtcccaaattcaattccaagctttgggtcaaagccctgggaaagaaaactggatctaagggatctagaggcagatgataatagaggttaaaaggcacagtgcaggtgagcatggctagtttctgccaattaagccaagcctcccatttcatggataaaggtcaagctaatattcatggcataaatgaggtcccgggaactccaaggctactgacagtagcagggatagagacataggtgagagcagataattcctattctctaggccctccctgcttcatggctacaaactgctttggcacccatgagtggcacctgttatggtttctaggactcagggatgcaaggatggaagagggaaagaggactcacttccttctttccctcacataccccaggtatttgctaggaagagaagggaaccagggatgcctgctcccctctttctagatgagtagccattcatcttcagtttgtatccctttcaaatgcatcccgaacccctgggattcccttgaaaaatgccctcttttttcttttctcctccttggttctctcttcacagataggtaattgtgtctccatactacgggacattcccctaagatgcaccctccaaactgggaaaagttaatttcccaaaccttaaactggttggcttaggactgggctcaggggaagtccaacatgtcggcaaaagggtagttttttttttttttttttttttttttttttttttttttttttttttttaccagttgggcttttggtcttcctctccccatgcaaactggtaaaaggcctcaggatttttgagttgtcctcagccccctcctcttgtttcattttaatacatgttttctaataacccagtttgtctcttcttactttcagaccatcaaactccaaatggtcatgcaaccaaagtcttgaagtctcggacaatgaccccttctgccaggaactcttagataggcttctgactgccattttccccaaaacaagaccctctgtcagcaggaagcagttaagatctgtcttcatccttatctttatccttattctaatgtcagttagacatacttctttagaggggggaatgtgacagccaagtataaaggggtcgctagagaacctctgggactacaggtgtgtgctaccacacccggctaattttttgtatttttagtagagatggagtttcagcatgttcgccaggctggtctcgaattcttgacctcaggtgatcggctcaccttggcctcccaaaatgctgggattacaggtgtgagccactgcgcctggcaacagatatttactgaatgccagttatgtgtcaggttcagttgcgttgattattcactctcagagcctcccagatttggtctttcccttatattatttatttatttatttatttatttgaaacacagtctcgctgtgtcacccaggctggagtgtagtgttgtgatctcagttcactgcaacctctgcctcctgggttcaagcaattctcatgcctcagtcaccgagtagcttggattacaggtgtgtgccaccatgtccagctaatttttgtatttttagtagagacggggttttgccatgttggccaggctggtcttgaactcctggcctcaagtgatccacccacctctgcctcccaaagtgctgggattacaggccgcgccactatgcccagccttttcccttatattctcattcacttcaacaacttaagttccgacctagaggcctccatctcagtcttccaccacactgtataccttgttgtgctgccacagggtttgtggtgtcaaagcaggcatctcagtccagcattgaggcctttcatcatcacagtctttctatctgaagtttatcttctgtcattcctcatcatacccacaagatttggccatacctgtgtcattacctttgttgttgttgtacatacacatgttatgatttacatttgggcttttccttattccttttccacgttagcatttatgaaggtagtctatacttgattacccaggtgttctttatttaatgtaactcgtattcctgacaagcttatctgcacaaaattttggtacattggaccatttaagacaagagtaaataatcaattttaatttatctttgtttaaagttggagttttatttagtggagatatgatgcatctgtatattgctttgtgctttgttaatgttcagataaggaaactgaggttcctagtggttaagagattggcataggacatttggctagtaaatagagagagtaggattaaaactcacattttataactcattgtcgagtatgcttttcactagaatagttgatttccttttattctcctcgttttatgtaattctgttataatatccctaaaggtaagagctgtattttgtatcatacccctcctccaaatattcataacattagtgcctaccgtagttttggataaagagatttaattgccatgttgatatatgtgaatgtatcagtcatagtgggataggttatgttgcaataataaacagcccatcccccccaacctcagtggcttacaacactaacatttctttcatgttgcatgtttatcttgggtttattgtggctatgtttcatgttgtctgcaatgtgcaacctgggatcagtaagcaacttcttgaacacttgtagtggatagaaaaagggcacagtaacccatgtactacttctcaaacagtaatgttttcacatcttattggccagagcaatttacatggtgaagcctgttgtcagtagggcataaaagtataatccttctgtaggtaggggcagcaaatatttttgaaaaataatactccgcccaaaaaatctgtgaccttacatacagagcattgagcaacttgtatttttcagtttatggcatactatcatcattggtccctgtctggccactttgttttttaattcatttgtctgtctgttttaatgtattcttataaaatgcattctattgtttgggatatgtattttaaatttataagtggtataatgctagagattgtattctgtttcttaattttttttcacttaacatttattacaagatttattcacgttgctgcacattcatccagtttgttgcatctggtgaatatagttgtcccttggtacatgtggggaactaaccagttctataccaaaatccacacacagtcacatctgaaagttgaccctgcagaaactgcatatatgaaaagcaccccaccacccactgctccttacgcacgggtttgcatctggggaatgttgtattttccatctgcctttagttgaaaaaaaatccacatataagtgtatctgcacatttcaaacctgtgttgttcaagggtcagctatctatagtattgcatgataaatatccactacactttacctgtccacttccctagagggtcttcaattctgtactacaataaatggtgctgcgtgagaatttctttgggctgtacacccaggtataagattgctgggtctttggacatacatatatttaactatttaagtattgctttcttattgtttttgctaagtcttcacagctattaagccttggtattatgagagtttagtaattgtgtattctatcttgtaagttaaccttactaattctgtaaaaaaagtccacccaactaagaacacacgtgtaagtaatgtgacatgtaattcacctctgtaaacatatttttcactaatgattatgtatatgcgtatgttataaactgttattctgaggcattattttgtatctctgtaaatcagtgagtggataaacaaaatgtagtatatttattcaatggaatatttttcagcaataaaaatgaatgaattaatgatacaacctggatgaacctcagaaacattgtgctaagtataagaatccagtcacaaaagactattttaagatagcatttatatgaacggtctaggacaggcaaatctgtagagacagtagattagtagttgcctcgtgcaggaaactagggagtatggacggaatggggtttcttttgggggtgatgaaaatgttgaaaaattgattgcgacaatgtttgcacacctgtgtaaatacacaaaaaactattaagttgtaccatttaactgggtgaactttgtggcatgtaaattatgtcttaataaacctgttaaagacaaaacaaaacttcaatcagatcgttttccaagaagcaggctagaaatgagttaaatgttgaccccttcatgtagggggaagattttctccccttgtgagaacctgaagggaaaaaattgggacagttttattcccaaactctatcctcaagttgtttgaaaataaacccatgcatgttatttcaactgactatctctgtgctgatataccctcagccctgataatttgtttaactgtttagttatcttcaggatatttttacttgtataacccaccactaattttcttcccaattatccaatttctgctgtcctttcggttttttatatctcagtagtttatatctccataaatcttggtgatctctttcttttttctcatttctagattaaccttttatcatgtcatatcatattatcttgaaattatttttcacatatgcttctttttattctttagactttactctgcccaaaaggagaaaataatttctttcttcaatgttttagaaacaatagcattggcagatgtatgctaattaatacttgcttaaaaacagcaaggaaatttcttctttcaacactattaacaagtatctgacatgaaataacactttcacaagtaaaagggattctgatattttacgttccttagtaaatctttggggagggggttagtactagaaatttttttcctttggaggactggtaaattcagttctaatttttacattgttttacatatgtccttttatgatcactataacatttgtgtttatcaaataagttaaagtatagtaatttttaagttaagtagcgaaatccatgataatccagagatgctcaagtgacttgaatgcttcaacttgagatgggtcagctttaggggtgaagttgtgaagagaaagccatcacacacacttcatcaacactgtggaatgagggaccgatgcttttactgagcagtggatttccagtgagcatataaactaattggtgggtgaacataccccaggagcaatgattttaaggtcatagcaggctcagtgaataatgctgacttacactgcgtctcactgatagctgatcttaccaatgagcagtttagaggcattcaagcctgagctgtcttccatgtgccttgaatggcatgtcagtggtcactgtttttgacatcctttatatttgtccagtcagctctaaatctttaggttcagcttcagagtactcaggaaagaaaagagagaagcaattattttcagtcattgagttttgaagatcttagcgttaattatgccaaacattgttggttcatcaacaaatacaaaccttaaaaggggttatgaagcattctgaacttgcttaaacatagtttatggtgattaagagaatcttgtatacactaatatatttttagttacactttcacccatatattttcatatacagtttcaaaaccaaatattcaaattaaagctaatttcagttttggttaataaattttgaaatgcttattcactttaattagcatttctttcgtatttgaaaaaagaggaataaaaaagtacaattcactatttctctgtggagtccagagtaattttgggtgtgaaaaatatttcaataaaacaaaaatcacaatgtcatagctctagtaatgctatttaaaaattgatttaatagtgggctttgagatttagaaattttctcccacttaaatctttaatttatcaaagattatttgagcattaaaaatgtgctttgcctattgttttccaactctctgtgctctctgacttgttgaagttttgcaggaagtgcccaatcaaaggatttgaggaagcagtactggacattctttggaagtgttcatctgagaaaatgaaagttagaggctaaactagttttcttgtttgcaactcaaattttaaatctaatttcccatgtaaataaaataagtgaaaagcacaaaggatgtaaacttcctaaatctgccagaatcttgtgtcttaattaaaaaataattttatcatagcaaaagaaacacatttagttcctaaagaaaataccatgggtggtattcttttgttgtattagaggtttgaagtagaatagttgtttctcatgtacatgtattacagtagacaaagtgttgaatagttttcatttctgatacattaatgattagaaaaatcgttaccctaatcctttttttataactcaaaaacaaactaaaaaggtttttgtttttttggaggatctgttctttccaagaggctggtgttcttctacctttactgtcctaaccttgcctttcaaattaagatataatagttagaatctactatagaattaatttagattcagttgtctctattaacagaaagtgatatggttttaaaaaatgcagatgatcatttatgagaatctggctgtaatcaaaagcagtaactactatccttagcagttctttattcagtaaagagttatcctctttttgctattctttatttcatttattcttgtgaaatatgtttacctttttaacaaaactttctattttacgtggctagatatgtgataaaacaaacacggtaaaatgttaaggatagaatctaggtggtaggtatatggtcttctctgtaaaatttgcttctctttcacatttgctgtatgtttgaaattttcatgagacaattttagagaaaaaaagctttctattttgattgtaatagccaatagccaaaaaccttattccatttttgaaaaaaaacctagatattttaagtttcttttacttatctaagcataacaatgcaaataccatataatatatattgataatatcacacatttagtgagttagaaaatataaaactggcttttaattgttaaatatgtatactatataccattcatattttagctggtggtttaaaaagctaacttaggcattatttaaactgaattagggtaattacatcaaaagtagtttcttagccagaataattttccattttgttaaaggagccatgatgaaatgaagtgtttagagagttttaggaataaaatgtgggtgtgtattctttaacatagaatgaatatgctttccagtggactttggaatgggaaaagtatcaataaataatgcttattaagcttctaactaggcatagcgccagttatctcatacttgagagagaattttttccttaaataaatgcaaccattgcattttgggggtgcttttcttactgtcttcattcaactgtttgccacatgtgtgcctgatacattattgaatcatagaaataatgtttaaatatatgtgggctccccacctacctcctttttaaagaaatagatattaaacacacaaaaaaatattactattgtttcttccctgaaatctttcatggcacacttggcttacagagtttaattttgctgaaataagagtttataagtcattttacctttgatattccaaagttggaaacctagagataatttttaagtaaaatttatctttaacctttgtattataatctgtatttacatgagtgtgcaagtagcctctctttattaatgaaaataaagactagtgaaaaaattttacaaatgattaacctagttcttgcattcattaggtatatttacaagtcatctgtgatcagtttagttaccatccctttgatatcctgcagccattattggatgcctttggggttgtgatatcatgctggggaagaatggttcggctgcaggttttatgtgtctttttatagttgttcacaatatcccatgctaaattatatggtgaattattatacatttgctagtttaaaagatgtctaattgatttactatgctaaaatatcaaagactatatgctgcaggagtgatgcttccagttaacaacttatcatgtattcatggagacgacaatgcttgctcacatattggcactattgtctaatttggtgtgccttgtgttgtaattcaatcatctattattaaaagtagatgtggctgtagggagcaaaaccacatacaaatccataaacatacatatgtgcatatttacttatactcacatatatgttcaataaggtttttgttttacctgctattaatgtttgtactagtgagtcataaatggaaaatatctattagctctaaggtaaaataaaataggttttgatttagttcaagtgaaccatctcatttaaaattagcccaggggtcttgtaaagaatgcaagtaatctaaacataataatgcacattgcccaattgcttctgtgtatgatacaggttcagtgctgtagtgctttgacagcccattactgaatgtaatgaacagctatttttaaacagaagaaattcaagttgacagcttggcaatgaaattcagctagtgggataatttttgtcatctttagtatagagaatggattcagtttggtttaagcaaatttgtatcatgtagtttatagcgcaaacatttttattaaaagataattttattgtccattttgtggagaggggcagatgttactgttaagaatatgtaatcagcttttaatgaatactttaatgaattactgaaacatcatttctagaacctaggtttaaaatgaaatttctcatttttctttcctgccatgggtgaaatagtctaataaaacgactataagattaagaggtgtttttctatgctgctttttagtctttcagagtttaaaacaagtagttttaagaaataagatagtctttggaaatggatataaagcttgaggcagtgttgtcttaatggaagtaagaattagacaaaataccattgagagagagaaggaaaatgtctgcctgactatattttagagaaattcttttactaagaataaggagacggtaacatctgattttgacaactcttaaaaaataagttggagaagcttcgtctgcaattcttaaataaaacatatatttttaactcatactatgaaaaataatagggtaagtcagagtgagttatttcattctcttctgtttacagcagaaattgtttgagaattctaattgctattttttctaagttgagctaattgccagagcttttaaaatagagacttcaggttcaacgttgtgcattgtgttaaatgtggcttgaaaaatacattactcaacgaaatctgggtgaacaaagtaagtaaactgagtactttacccaatatccaataatgtttctgaccctaccagtaaaataaactaaatatatagcagtggtgaaaattttaaaattgtcagaaatccccctctaaatgcattgccagaaagctttgttcatgggtcttcattaccccttcatgcttccagggcacctcctctgggttcccaaggcactgggaacttaaaagttagctttgcttagtaactatgccttgaagtaggataataaaacaaatcatttttaatagtcagtagattttttttccatttctgatctgtttctctattttacttatctcttggacggcataatggccccaaacctaatatagcaatgaatctgtgtagaagtcaagcatttttggagaggctttcatgttaggtcactactgtactctttagaattgtattgtatcagtgaatcaaaagaatttcttgacatgaaagaattggtacacatctataaacattttatttaaacctagagaggatattatttatctaacagaatccagcttacttctagcaacagtaccatcagtttgtagcctggtctttgaactcttgattttgttgtgaagtgaccctcttgaaatcttaatttacccatggatagaggacgttgtatgaggcagaagggcatcatcacattagccctgcttctctatggcatcatgagatgctaagataagcacttgaaaggtattttaactttcttgatctcagaataacttgagaagaaattcatggtacccacatactgggttaacaaaataattagtcgcatttggttatttgtgaggaggaaactgtgaaacgtgaaagtaggactggggattccaggacgaagcctagagatagattttttttagaaggaggcttatctctgaagatgggcaggatgaaagaagtcaccagcgattccagtggatgctttctgtgttatgtgactacatttttctttctgcttgccctttgaactttgaggtctgagcagtgcaggaagaagagaagaaattgcgttgccatgatacactgtaagggcttcaggaaaatgggatatggcagtggtttgaaagatattgagaaggtttccaacccaattgtcattcattgcagctgtaagaatttaatgggatatggtctaatgaagcatacccattgaaaaattcttaaactagtgtcttgagagtcaaaattgtttgctggttaagacacattctgtctggagcttgactgcctgggcttaagccctatcactagctgtgtaactttgaccaagttatttaaccactttgtgccattgtttctttatttgcaacaaaaatcacaactcccagggttagtataaggatcacatgggttaaacatttaaaattcttaaaaagctattttttttaatgcaaaaagagcttaatttgtgtaatctattgttgttgttttagaattcattgtagttggaatgctgtgtgtcaaaaacgttggtccttaattaaaggttaaagttatcaggaatcctaactttgaaaaaggaaagtctaaatgagaattcaattccatttggttaatatttatcattcataaatattaagtagcatgggatgggatttataaaatattgaaatcatagcttctaccctactaataaactctttgaggatagggaacatgctgtatgctaccagtcttgtaacctaaatggtgccttgtgtaattcaaatatttgttcagtaaaagtcaggtcaacatgaatccaaatatattgctagtacatattagatacttaatatgtgtaacttaagtgaaaggatttatttatgtgcgtgagtatgaaaacaagtgttcattttcactagtgatgaaggacttgaattacaacaaaagagttacaggttataaatagaagtaatctgactatagggttggtaaacatcctagttctttcctaagagaaataacagaatctatatattgtaaagaataggttatcaggtgacatttaactgtctttatttgttgtagaagaatatttaggtcttttagccctcttaccctctatttctcagaattattatataaatatgtacattcttgtgaaagaagaaacaaaaagaccttggaatgaaaagctttaactacagccaagtttaccttttctatacatgtcatcctttctcttttaggggaagcaaccaggggaaaatgaagatatcaccatcagtagtaactcttccttttttgtttaaatggtaaatatgcctggggagatgggacttataagaaaagatgttttggccaaggcatcctacctctgcttgtcttcatgatcttcattacaatcatagcagaaatcctcatgctaaatgtttttcttttccttcttttctgggagatcattaatcagctatcctattttcctattttacgatttctccttctccagcccaattatgttttctacaaagctagtgtctgggatactaactcttaactcattcaagcaagcttctcggctatatcattacaataaattctatttaaaatacttagtgaagtacagtattcataagccagttattgcattaggtgtagctgcagtgacactgattagcattcatcataaagatagttgaatatgatttatttatatttgtatgtaagtatatatattttgaatatgtactatgctcatatgattcaaagttcaaaatggcctcaagagtataaactgtgaaaagtctcctttccatctgtccttcatcaacccagtttccctctctggaaataaccacaatgactaatttcttttgtattcttccagagttattttctgcatacaaataaaaacatgtatggttgcatatatttctgtatacttaaaaaatggagatgactcttttgttttttggttaacatcactttctggaaggcaaaagatgatcataaattccttctgagagtaccaacttgccaacttaccttaagtcatatttctttctttttattttctttctctctttttttttttttttgagacagaatcttgctctgtcacccaggctggagtgcagtggcatgatcttggctcactgcaacctccaccccccgggttcaagcgattctcccacctcagcctcccgagtagctgggactacaggtgcgtgtcaccacgcccggctaatttttgtatttttagtagagatggggtttcaccatgttggccaggctggtctcaaactcctgacctcgtgatccacccgccttggcctcccaaaagtgctaggattacaggcatgagccaccgtgcccggcccttaagtcatatttcttaaaagtgcctagtgtacaagagtctttgaaactagaaataagtaagaagagaaagcaaagatagattagaaaccctcaatatttgttttcttcttttggaaattctcaacagaaattccagatgttacaaagttgaattagctagttcctccatggctgcttggtgatggataagccattcccctgcaaatgaatagtgaaccctcagattctcttggaagcatggaacagcctgcacattagtgtaaagaacatcccccattttggagtcagattaatctgggtttggagacacagatctagcattaggactttgtagctttgtgacttttttttttttttttttttttttgccagagtctcgctctgttgctcaggcttgagtgcagtggtgcattctcggctcactgcaacctctgcctccccggttcaaacgatcttcccacctcagcctcccacatagctggaattacaggcatgtgccatcatgcccggctaatttttgtatttttagtagagacagggtttcaccatgttggctaggctagtctcgaactcctgatctcaagtgatccgcccgcctcggcctcccagagtgctgggataacaggtgtgagccactgcgccctgccagctttgacttttagcaaatgactgagtcacctcgtgaaaactctgtaaatagagagtaatcaaaccaaacctgtggtatatttcacacggttaaatgagatcatgtaagtgaatactgtctggacaaaaagtaggtgctcaataaatgtcagcttctttattcgccattctgccagtacatttaagatgaaaaggtctgctttcaggggtttgtgctgttcagtcttactgtgcttctcagaattgaaaacagcatttagaaagacgtttttatataattattcatcttgtaaggatgcaagtgtcagaatctatttttaatccaacaaccagcttttctgtagtgttttaacagtttacaaatgttaactttccattctctctagggagatgagagaaatcgataaaaggcgattacaagtgaatactcctatagcaatacttgatacattaaattgtttaaaagtgttttttttcttcttcctcttctagttgcagtaatacgaggtttctaaaggccatacgtaactgtgtacataaagaggaaagctacttgggatagaaggactctcagattgggttttaacttctcaagtataaaaataagacaagtaggcaaaaatatcacattctgaagttttaagtgacagataaacaaattcaacatgcaccaccaactttttgagttttaggtacactaacttattgtgggatctgggccagctgctctacctctgtagacatttctaagtgggaaaaaaaaaaaagatttaggaatagtacccttttcagattctctcagaattatagttgtaagcactatgtaaattcatagaacatagttttgaagaccagctttagaatttcaatagttattgtatattcaaaacagctacacaagcactttattttcattttaaagatttacaattaaagtcattttatgtatacctcaaatgcctgattatacacaaacccattacagggtttatacacacattaaatcccttcttattatggggttttgtgcacattaaatgcctggttgttatagattgttgtttttcttgttaccattaaatgtaacatttccctaggtgatgaaatgtattattatttagaacatttattttagtgtgtgttctgtattttaaaagagaaaggtatttaagcagcaaagatgtaactgttatgaaatttatttttataaatagctttcagcagaaatcagaacagtgctttaaaattacagttaaaaaatcatttaatcatcacactccttgatggctaatagagtagtaagtgactcccccatatcccccgcaataggctattctcgatatgctcacttaagtggccctaagaatagtactagtatattttatgttagcaagccttgatagcaaagtgccaaaagttcagggggcatttgtctcctttctcaaaaattcatttaagtcttgctggagctttaactggggcagacagccatacaaatgacttgagataaaatgaaaataatggactgagctgggtgctggggatggtagttatgctgagcacacatcaataagcttggagtgtgattctatgctaatgcaagcctgatggatcagctttctcttttagcctggaggaccattaagctctggaagctgagtcaaactgatagagttggcaaatacagcccatcagttagcagcaatagttaactgactgtgattcctaatatgcgaaactaacattgcttaaaaaccctccatgttcaggacatagatcagaaaggagataatagattctgctttaatttgcataatcaaagcttctcattttcccaccttatagttaacagaagagggaaaaaaagccatggctaccttcattttgttgttagtcttgaatcatagcaaataattttcataaaaatgtaaataacttgtttcaaaataaaagagtatatttgaaagattctctgtgttatttctttggaattaaactgtaggcacagttacatgggttgggtagtaagtgtcttggggatatgaaaagtaacaaagtcttaaaaaattgtgagtctttttagtgattgattattttcatatataatttataaagttctatacttttacttgaggatattggctttgcaaacttatcaaaaacagttcaaattctgttgaattcatatttttgtgttgtgaggactttctgttcatttaaaaacatttgttgagcacccatttatttcaggcactgcattggacactggtgatgtggttgtcctcttggagcttacttttttttctttacaggggaggtaataaactagtaaacaaagacataatacagtttcagtgagtgatagattcttttttttttttttttttttttgagacagagtcttgctctgtcacccaggctggagtgtgcagtggcatgatctccacttactgcaacctccacttcccaggttcacacgattctccagcctcagcctcccgagtagctgagatcacaggcgcataccaccacacccagctaatttttgtacttttggtaaagatggctttttgccatgttggccaggctggtctcgaactcctggcctcaaagtgatccacccgcctcagcctcccaaagtgctgggattataggcatgagccaccatgcctgccctgagtgacagattcttaagtagagccttctccatctgagagattctactctgaccaagtttttgccaaatagactcaaacattaaatatgctgttttcaatcacaggtttccagacggtctaaaaaatttgtaaatgtaaggaaaataataaataaatttgtgttgaagaaaaattaagggcttttgtgtatacctcgttgtaatccagactgacatctctgtgaaaaccctaataaaagtctatatgcacgactttctgagtgtttaatatgtgctggctctcttctaagcagtttactcattaaatatctcattaaaaaaaacctctaaagaaggtactattattcccagatgaggaaattgagacaataaatgttaaataacttgctcaaagttatatagctagtaagtgggtgaggtgggattaaaacctaggcagtttggctccagagtaagtgttcttaatcactgttactctatggcaacctgaagaaatttgtttagctgaaaatgtattgctactttagaatgcaaggtttgagaggacagggaatgcatctgtcttgttcacctctaactctgcacttagcactgaacctgggttatagagggtggccaataagtatttcttgaataagtgagtgtaaatgactactattatatgtttaaattgaataatatttcatacaaattcttttcaaaatttattttgctacatatgtttttctggtgccctaaattagtatatgccttatatgtacattccagtgctagttagaatgataatacgatcaattcctatggatggggtaagggtagggccagaattccttgacctacatcatttctatagcctatctaccctaggtatatgggatttctcagtggatcacatcacatcgagctcatactgtgttcttgtataatacctgctacccttgactcacagaatgttttgtgtgatgtcaagtagcaaatgcttacatatttctacttccaattatgtttcctttctccttatatctttggagaagacaataacattattctgtaagtatcaaactgatattaaatgattgaatgaatggggctttctcctgtacatggtttgtttttagaatataaaaatgaaaaataatttttctaaatataatacacaggacaactcatgtagaaaattcaaataataaagaaaagggtaataaagtaaaaataaaacatattctcattactcaaaataatttatgttatcacttacatgtattaattctcagttaacattttggtaatcatcctttcagataactctatgtatacatagacacttacacatgattttaaataaatgagtttataatgtgcatatgattggataacctgcattttttcactcaataatgaaacttggaaattttttttcatgtcaatgaacattattatagtttttaatgacctactctgttgtttggatttatgattatttaattggccttataataatagatctaaattcctttttttgcttttatttttgatgttccaaacaaaactgtagtgaatatgtattcatatatctatatgaattgttgctgggtcaaaggttttattttttgggtcatgtgtaatctgacagtttaaaattatacaaaaatgtgctgaagtccttgcgttcattgcttagggagtatctgtgtgcaagaggaacattatatgaatgaatagaaatataattcaggtctcagctatttagaaaaaaaaatgcttcttaattctcttaatctaaagatttcttctttatctccttttgctttttctccttgcactttgttaaagaaactattgttctgtaggttttcctgtagagtctgagttttgctgattgcatccccatattgtcatttaacatgaactgctaccttctgtatttcctatacattgatcgttaaatctagaggcttgagccaattcaagtttgattttatttacttatttattcaaagctacttcatagggagagcttttcttctctgccagaaggccacagtatcaatcttattgtagtattgtagtacttacagccattcttgatcaatgccatggatacctatgttaatgtctttgcagtcctttaagttgttccagtttggatttgcataacacaccacttcaaaacttaatggcttacagtaatgtcagcaagaataggaagccctagaccttgttttcccacaaagacactgacttaacaatatatgacccaaaaacatttaggatagctccagaagccagttgtgaattcacagcaccctaggcaggatcaaagccatgaatagttctattgaaagagataagacaagtagttccatttgaatgatgtcagcccctctcttaagccagcatagctcataatagggaggaaaagcccaactcatggcttctgccttgagaggaaaacagaaaagtgaaatgtacatgcaatatactagctttttagggggtgaaaaagtaaggggttgggtgggagttgggctgcccagaatgttgatttcagtcttgcctgactcagagtgctagctgaaccagcataccttggatacctggggtctacagtgaacaaaagagaacttagtagctttttgcagcaccaagaaccctgccagtaccacagacaggcgcaagagggaggaagaaactataaaccgaaaaagaaactgacaaacttctctaattgggaatttacatgcagagagtgagagaagatacatctccccataaaaggattgagaggctgtcagattctctggctgtgctgtttggtgaaggtcttcccctatagaaagccagtatgtaaagattgggagaggtggctgtttttcaaatgcaaaaatcacaacaaaaaataacaaggcacacaaagaaacagggaaatcagtcaaagaaacaaaataaatctccattaactgactccgaagaaacagagatctattagttacctgaaaaagaatttatgataatcttaaagaagctcaatgtgttacaagagaatacagatagacagctaaatgaaatcaggcaaacaaagcatgaacagaatgaggatatgaacaaagatatagaaactataaaaaagaacaaactagaaattctggagctgaagaaaacaactggttaggaaaattcactgtggaagaccaacaagagacttgatcaaacaggaaagaatcagctaactcaaagacaagtcatttgaaattattgagtcagagtaacaacagcaacacaagaatgaagaaaagtaaagaaagcctgaaggacttatggtgtaccatctggctgaccaatatatacattatgggagttctagaaggagaagagagaataggacagagagcttatttgaagaaataatggtcaaaaacttccaaaatctgaggaagaaaatggacattcaaattcaaaaaactcaacagactgtagatatgatgaatcagaagaggtgcacactgtgacacattataaactgtcgaatgtcaaagacagaatctgcaaagcagcaagagaaaagcaacttgacacatacaagggagctcccataagttatcagtggatttctatcagaaatgttacaggtcagaaagagttggaagatatactaaaagtgctgaaagaaaaaaaactgccaataatactgtatctggcaaaattatcatttaaagatgaaggagaaataaagaccttcttggataaacaaaagctgagggaattcatcatttatcatcactagaccttctttacaagaaatgctaaaaggaatctttcaagttgaaacaaaaggatgctagacagcaacacaaaaacatatgaaaatgtaaagctctctagtgaaggaaaatatatagataaatacagaatcctataatctgttatgaagtgcataaatcacttaattccaaagtgattccaatttaaaattggatatttatcttttaaattggattatcttttaaattccaatttaaaagataaaagcactgaaaatagctaactataaaactatgttaatgaatataaaatataaaaagatacgtaatttgtgacactggtaacatagagggaagagatgtaaaggaatgaaatatttatatgtgatttaagttatcagtttaaaagagatcattataactatgttttatgtaatcctcatagtaaccacaaagaaaatacctacagaagctgcacaaaaaaaatgagaacagaataaaaacacatcactaaaaaaatcaatgaaacaggctggacgcagtagatcactcctgtaatcccagcactttggtaggccaaggcaggtagatcgcttgaggttaggagttcaagaccagcctgaccaatatggtgaaaccccgtctctactaaaaatacaaaaattagctgggtggtggcgcatgcctgtactcccagctactcgggaggctgaggcacgagaattgctggaacctgggaggcagaggctgcagtgagccaagtttgtgccactgtactctgtcaaaaaaaaaaaaaaaatcaatgaaacataaagggagacagcaagagagaaaaggagagacaaaataactggaaaatatagaaatagtaagttccatgggaacggtgagagcttctctatcagaagttacttcaaatgtgaatgtttactttaaactccttaatcaaagaacagagagtagctgatttaattataaaaacttcaaacaataaatgctgtttataaggcactcactgtagatatgaagacttaggctgaaagtgaaaggatggaaaaagatactccatgcaaatagcaaccaaaggaaaaaggaggttagccctacttagacaaaataaactttaagtcaaaaactcacaagagacaaagaaggacattatataatgataaaaggatcagttctccaggaactcaaaacaagtctaaatatatatgcatctaacagtagagcacccaaatatataaagcaaacactagcagaattgaaggaagaaatagtaacgcagttaacagtaggatatttaaatatttcacttttcataagggatagatcaactagacagaagatcataaggaaacaaaggacttcaataacattatagtccaattggatctaacagatatacagaacactccactcaacaacagcataacacacatttttctcaagcacatatagaacgttttccagtataaatcatgttaggccatcaaaagcggtcttaacaaatttaagtagattgaaatcactttatgtattttttctgaccacactgaaataaaactagaaatcaacatcaaaagggaaactggaaaattcataaatatgtggtgattaatcaacacactcttgaacaaccactgtgtcaaaaaaatcaccagagaaattagaaaacatctgaaggcaaatgaaaacgaatacacaacatattaaaacttacggaatgcagcaaaagcagtactcagaggaaagtttatagtggtagacacattaaaaaagaaggctctcatatcaacaaaataactttacactcaaggaaccagaaaaagaacaaactaatcccgaagctagtagaaggaaggatataataaagatttgaacagaaataaataaaaagagaataaaaatgattttaaaaaattaacaaaactaagatggcttttagaaaatatcaacaaaattgactagccattagctagacttaaataaaaaaagacaagactccaataacaaaaatcagaaatgaaagagcagacaaaacaacggatgccacagaactgaaaaggactataagagactactatgaacaattacacagcaacacatttgataacctagaaatggataaatttctagaaacatataacctaccaagactgaatcactaagaaataaaaataggccagtcacggtggctcacacctgtaatcccagcaccttgggaggccaatacaggaggattgcttgagtccaggagtttgagatcagcctgggcaacatagtgagaccctgtctatacaaaaaataaaagcaaaattagccaggcatggtggcacatagctgcagtctcagctactcaggaggctgaggtgggaggattgcttgagcctgggaggtcaaggctgcagcagtgagctgtgatcatgacactgtactcagcaagaccctgtctccaaaaacaaaaacaaacaggtggctcacgcctgtaatcccagcactttgggaggccaaggcaggcagaccacctgagatcaggagttcgagaccagcctggccaacatggtgaaaccctgtctctactaaaaatacaaaaattagccaggcatggtggtgggtgcctgtaatcccagctgctagggaggatgagacaggagaatcccttgaacatgggaggcagaggttgtagtgagctgtgagctgtgattgcaccactgcactccagcctgggtgacaagagcgaaactctgtctcagaaaaaaaaacaaaaaaaaacaaagccaaaccaacaaacaaaaactcaccaccaccaccaccaaaatatactacaaagcgacagtcagcaaaacaatatggtactggcatgaaaactaacatgtagaccaatagaatacagaaccaagaaataagtttgtgtatctatagccaactgatttttgagaaaggtattccaaaaatatgttgaggggaaggacagtctcttcagtaaatagtggtgggaaaactggatatccatatgtagaagaatgaaactagactcctagttctcaccatgcacaaaaatcatctcaagatggattacggactcaaatataagacccaaaactatgaaactaccagaagaaagtatgggagaaatgcttcagggcattggtctgggcaaagattttatggctaagacctcaaaaacataggcaacaaaagcaaaaatagacaaatagtattatataaaactaaaaagcttttgcacaacagaataaacaatcaacagagtgaaaagacaactggaagaatgggagacaatatttgcaaactatccaacaagagtttaatatccagaatatacaaggaactcaacaattcaacagcaaaaaagcaaataatctaacaaaaatgaggctataatctgaatagatatttttcagcagaagtcatattaaaggccaacaagtatatgaaacaatgttccacatcactggtcatcaggaaagtataaatcaaaaccatgatgatatatcatctctcactccaggtacaatggctgtcaacgaaaagacaaaaaataacaaatgctggtgaggatacagagaagggggagctcatacactgctggtgggaatgtagattaatacagccattatggaaaacagtatggagtttcctcagaaaactaaaaatggaactatcatatgattcaccagtatcactgctgggtatatatccaaagtaattgaaatcagtatattgaagagctatctgcactcccatgtttattgcagcactgttcatagtagccaagatatggaatcaatctgtgttcatctagagatggatagataaagaaaatataaggccaggtgtggtggcttatgcctgtaatcccagcactttgggaggctgaggagagaggattgtttgaacctagaagtttgagaccagcctgagcaacaaagcaagacccagtctctacaaaaattacaaaaattatttgggtatggtggtacatgcctataatcctaggtactcaggaggctgaggtgggaggattgcttgagctgggaggttgaggctgtggtgagccatgattgctccattgtactacagcctggatgacagagtgtgagaccctgtctcaaaaacaacaacaaaaaaacaaaggaaaagaaagaaaaatgtatgttctcactcgtgtggaagctaaaaatgttgatctcatggaagtagggaatggaaggctaggaagagtagggtgaaggaaggtattgggagaggttggttaatgtatacaatattaaagctagatgagaggaatcagttctagtgttctacagcactgtagagtgactatcgttaacaaagaaatgatatatgtttgaggtaagatatactaattaccctgatttgatcattacacattgtacatatatatcaaagtatcatactgtatccataaatgtgtacaattactatgtgttagttaaatataataataattttttaaaaattagcttattttttcattgagtgtcttaatctatttggctgttgaatcttattaaacctgattttttttttgttataaataatttggtcatgttgtctgaaaatccaaagattgtgtatttggtgtgtgccctttcaatgcgtagctttaagtatatttctttgtttataaattttagaaacattttcttggatgataattccacatttgttgtaatccattacttttctttttcaggagctcctcttacatgtatgttaaatcttcttctttgtgtttctttatatgttactttatctcatgtttataattgctttcttaatttgttttctttccaaattttttattgtgttaaaatgcacctatcacaaaatttaccatcttaaccattttttagtattcagtggtattgaatacatacataatgttgtacgcttatcatcaccatgcatctgtctcctcacattttcagtttttattttgtctttaattgtatccttttcatcttctattacttttaaggtattatcagttacgtttgtttgctctcatgttccttctggttttgttttcatttttgaaaaaaatttctttcatttctaatttttttttgcattttatcaccttatttctgggttttctaattctgatttatatatttaaatatcttctattgctttcttaatttcttctagcttgtttggacataataagttagattttctatatagatattttctgtatctatccatagatataatttttccctttatctttttttttctctctaataagaactttccatgagattcaactgtaatatttcctgcggctcattttaatgtaaaagtagttattctaaatatttaggtaggagggttgtgtcaatatagcttttgtagctttccagttctaacattctcaattctgtttttaaaactatggcctcatactgtgaagtttcctgggttttctcctctcccatttttacctgggtcatttctttgctttaattctattgccccatcctgcccaatttgcattccactaccagccacttgtcctttgtgagggcagcttcagaccctttgtactctcacctgtgagttggaatgggcagtagtgtctctcattttcagttgctgttctcaaattggccctccatgcttctcaaggaataccttggaaggagtttacaatttggaggtgtctggtttcttcccacctgtttgtattttgtcattcatggagataccttgttatagctttgttgtagattgtcaagggggttttggttattctacttaaaaagtacgtttactgtctttatttaagaagctgattattgaattttgctatacattaataaaatgatatccagacaaagtcattgctaatatatatgcatgtctgttttttccttctccaacaaccttgcgtattatctgtcttttgaaattgtcagttggcaaaaagtaataccttattgagttcttatttacatttattgattacttatgagattaaccacttttcatgtatttgaggtccacttgcatttttttctattgtaaattaattgttcttttgtcagtttatctgctatgtttatctttttcttattggattttgagagctctttgaatattaggaatattaatgttttgtttttcactattgttaatgtttcttctctctctctctcttttttttttttttttttttgagacagtttcgctctctcacccaggctggagtgcagtggtgcgatcttggctcactgcaacctccgccttccgatttcaagcaattctcctgcctcagcctcccaagtatctgggattacaggcacccgccatcacacctaagttttgtatttttagtagagacggggtttcaccatgttggccaggctggtctgaaactcctgacctcaggtggtctgcctgccttggcctcccaaagtgctggcattacaggggtgagccaccgcgcccggctctaatgtttcttctctagctgtttgcttttaatgctttaaaaacatttttttataaaattttatggaatagccaggcacagtggatcacttgagtctaggagtttgagaccagccaaggcaacatagcaaaaccccgtctctaaaaaatatatacaaaatttagctggtggtggtggtgggtgcctgtcgtcccagttactagggaggttgaggtaggtggatcgcttgagtcaaggaggtggaggctgcagagagccatgattgtgccaatacactctagcctgagtaacagagcaagaccctgtctcagaaaaaaaattaactaacaaaagaaagaacatgaccttggagtcaagtagttagatggtatagcttaagcatttactagctatgtgagttgagtcaaatcactcttctctgattcttgatgtaaagtatggagtctcactctgttgcccagactgtctgcagcctccacctcccggttcaagtaattcttgtgcctcagcctcccgtgtggctgagattagaggtgtgcaccaccacgcctgggtaatttttgtatttttagtagaaatggggtttctccacatagagaagactggtctcaaactactgacctcaagtgatccacctgcctggggctcccaaagtgctgggattacaggcgtgagccaccatgcctggcctaaagtactattttcaaatagtactttaaggggttggtatgaagattttcaaaagaactatttatgattcttcctaaaagaattaaatgggcaattattttttgctttgagatggagtctcgctctgttgccccggctggagtgcagtggtacaatctcggctaactgcaagctccgctccctgggttcacgccattcttctgcctcagcatcccgagtagctgggactacaggtgcccgccaccacacctggctaatttttttgtgtgtttttagtagagatggggtttcactctgttagccaggatattaaatgggcaattcttttttaatcagtgtatgaaatttgctttggaatttcatttgaatgattattttttattgtgaagaataaatgagataatgtatataaagtacataccatagtagtcagcgaataaattgtagctattactactgttgctgtgaggctcaatctaataacttgtctaaggttcgaacttttgcatcagcccccaaaatcctgtttgtactaaaatatactatctaaaaacattcataatacaaatattccatatatcctctttcatttttaacaaaaatttatggatgatacaatgtaagcaagaacctgaggatacaaaaaagtaagacttggtgcctgtcacctaggagcccacagttggtagagaggacgggcagatataggaaagaagaaattgcttttcctaaattatgcatcccagaaaatagcattctggagtgtggttttgaacagaattctattctgcagatagcaaaacataagttacatgttgatgagattaaatgttcaaatcaaataatgaaatatatttatttagatacatttaatgtcttcttatataagttatcaagttgcattttttctagctgcatttaaatctatgtgcatttccttcctacttctcctgagattgatatgcagccagcatttcagttaccagcgtgaggaataaaccgggagagaggaaagatagtgaagcagctgtcttccattacaacgtgtctaaatggatagttctaccatgatgtttctttcaattccttccgggtttgggtgagaggggtggaaggaatgtttccattggtgaaatggtagctgaactgccaaatggtatgacctgctatcaacactactaaaaagaaaatcagagacatggattattattggccaacatatgtttttttgtgggcatttcctttgtgtttcattttatgaaaaatgataggtatcgcattaaaaaatcaaataatttataataattggaacctcattagtagattttacattttatataccaaaatgttaacaatctatgttttaaaaattaaacctccaaccactaacaaatcagagctaaagaaataatcccattattgaagaaggatcattgtggtagattgagtgccagaattttttttaaaaacagtgctatgtttagtacattttagaaataattccataaaatggtatgttttataagcgtggatttagagataaattatcttgggaaggtaagttaacgaagacaaattctgtttaatatgtaataaccaactctggacaatgaaacctttccatccatgactttactctgtgtggaattttttagtagatacctgaagttacaaaatataaaaacaatcctctctccttggggaagttacagtttaatgtggaataagtaaactccacatttaatgtagaataagtatggtagaaacccaattgacaaaagttaaaacagtttatgcggtgagaattcaactacctagagacttgtggactttctagaatcattgtcttctgtgcctgatctttggttattactgggatacccgtcatttatctctgcccttcttttacaaacctttcaatccgtaaactgggaccagttgttctatttagagattacccatgaggcaccatccaaattgaatactactaagcagcaattacatgatttatagcagagattatttggctatttgcagcacaaggcaaaggagaaggaatataatctccattcacatatacctgtgtgcatatacatggtatatgtgcatcataataaacatcacagttcttctttggaattgtgaaatatcctctgaacttaatagaaatttagtaagcattgggccgggcgtcgtggctcacacctgtaatcccagcactttgggaggccgaggcaggcggatcacctgaggttaggagttcatgactagcctggcaaacatagtgaaaccccatctctactaaaaatacaaaaaattagccgggtgtggtggcaggtgcctataataccagctactcgggaggctgaggcaggagaattgcttgaacccaggagatggaggttgcagtgggctgagattgtgccattgcactccagcctgggtgacagagcgagactccgtctcaaaaaaaaaaaaaaaaagaaaaagaaaaaagaaatgtagtaagtatcgagaggtaagtagtgagtaagagagagataaagagggagagcgaaatgctaatttttttcaaaggaaatataaccaagtcaacatgaaaatcattctgttactatttaattcctatatgtctatcaacccaactagacctataatctctaaggcagtgactgcttcctttcagattcaaattcagcaaacaactgtgttaaatgttattcctgaccttcctcactatgccagaccaaatgctcctccctgtactccaaataacattgcttgatatctctattaattgcactaacagcactgtaaatacatggaaaccctctatgctgcaattctctatttccgtttttgctctctattctgctaaaatgtaagctcctcatactaataacttttctttattcagtgcctggtatgtagaactgagtaatatttatgacattcatcgtgaaagactggccagacacaagaatgacaagaaaagacctgagacatagtgatagatgaaactcgagaatgtattattatttgaacaaacttgattctaatatttaccaaaatgatacagttgaaaagagtcaaaatgtaatccttctatagcatgtggcttagtttaatatccatgttccattatttcttttgtatcctcttgagtatttaataaattttattaatatctgatttaaattttaaagtagataaattaggctttaataaaaacaaatggaaacttttagtaagtggttggacttgttctgaataaaggaatatagaatggaccttatttgaaaagttgaagtttttaaatagtaagaatataggttgaaattttttttttttttttgagatggagtcttgctctgtcacccaggctggagtgcagtggcgtcatcttggctcattgcaacctccgcctcctgggttctagtgattctcctgtctcagcttcctgagtagctaggattacaggtgcgtgccaccacacccagctaatttttgttgttttagtagagatggggtttcaccatgttggccaggatggtcttgatctcttcaccttgtgatccgcccgtcttggctcccaaagtgctgggattacaggcatgagccaccgcgcctggcctataagtagaaatttttgaaaggaataactggtgtggcaagtagagctggcaacattgtgtatattacaaggatggccttcaaaaggcagaggactgttggatacctcactattttaaagagaaattttatttaaaaaagaaatcttatgcatgatctcatttcagtgttgatttactagaagcatatgatggacctacgaacaggacccttcaaatcaaaatgtatcgtttaggaatattctgaaggggaaagtctgtgactgcattctctgagaaccatctgctcacctacttatgtcccttaaaactgaagctttaggatatcctttgaaacctttttgtttcttatcatataatgtatggtaccataaataccattgcatttgatttttgtgtgaaacaacactaaatcactattaaaaaggaaagaatgaggttatcttgctgacaatttaaagaaaagacttcttcataatatatttacgacatctaaaatgccttttgtcctcagggtagcactgtagttcttcggtgcttgagttgatactgcaatttaatactgtacctacaaagaaaattacagtttttaaactgtttattccaagtgctttcaaaatgaagacactactaaagtggtgaaagcatgtggttggaaaaaaaaaagtagtaggagattattaatttcttaaaggtaaagattattgcaaattcaaaagatcccactcattatcaatatgtggtccttctacagttttgcatagtataacatattcttaaaatgggatacatagtgactttgtagcatcaactatttaaattttctagctcctgagtccttttcttgctgtgaaatgtgttcattttattgtgtgatgatattaacatatatcaagaatataagtgaaatattaaatcttgtcatgttcagggttttagggttcttaaaaatgtgtaaaggtgtttttacactgtgtaaaaaaaaactttatatgtttgtgagattttgagttacctaattttataaactaaattactttgtgaaaaaaaaaatgcttagaatcatatgttccatgtagctcaatattgttttctggaattgaattaaattatatctacagttgcttaacagaaagagcacttaatttgtaatccacagacctcgtggtcttaggcaagccatgtaatttacttgtctttcaatttcctcatctgtaaaatggggataataactcaaaggattggtctaaggatcaatgcttatgaataaaaagcacctagtacatgacacatggtgggtgctatatcccagctattattattatccaaatggcttattactgaagtaatgaaagaaagcttttatacagtcatatcaatggtagttctgggttatagtctcagagacatcattactatgaggatatagagaatttaggaaaattttaaaaattatttaaacaaaatttgaaaaacattgtaggcatgtattaccacatacaattatatctgcctacctatgtatttaatcactatcttttagaaaacacacaacaaaagttcagtttgccgtagttcattatagagttaataggagcttggagatttgatctaataacatgcacttcatagtagagcaaacccatgatgttatcagaaattttggagaagtccaggattggggtgtacaggtgtacccaccctgagaaccagtggatctatataagtctggtgtattggtttcagtacaatgatatttatatacaactttgtatcaaataagtttgctaagccctattataagttaaaactatttttaaaccatatttccccaccctggtttggaaattgataaaacagtttaaagctgaaaaacataaactacagtaactcaataaacaatttaaaaataagttgtgtaggtagctggaaaaaattataaatctcaaaagtatagatttaagataaagcccagttatctagaattataaggttatagtacatttttggttgagcacatttagctttttctattcctccattttgcctagctgccatttcttaactatgaaaggaattgaagagtccatcagagcttttgttcgcactaaagaatagtcatttgaagaaaatggtgccaggccagacatgtaaagatatttaaagaaaagaaggaaggtgataggcctaaattcaggactattagcatattcacaatggtacaggtataggctaagcttggtcacaggtgaaaggcagtagtgtgagaactcatggaattaacaaagctacttcacacaaagggacggatggtacttcctccatgtccattcctttctaagatttcagtggcaaacagcgtatgtaaggctgcagtgacaatttgtttcagtggccctaaaaaatacctatatgtaccatagatttaatgtgtaaaattaaaagcaatgtatattaaatattttctaggaatctgtgattttgtgaccaaagatctgaatatacttaaaaacaaatcctaatttttttctaaagaaacatgataaatatctggatagctggctacattttgaaatattcacccaatatttctgcaatagtcagcatttcaataataattttatttgctttttcatggctttgaattgggtattattttgtttctttgttttgttctaagtctatatattttttttcttgccaccatttgctgtgattacagatataggtttagagtttagcctttgcaatatcatcagttgatggcatgtctacagcaatatggtggataatattttttattttcatagtatgagtgctacttgactctgactgaatgattttctgttacaagattttctttagtttatagacctactttaccttggcttctgaatatgctgaaatccttctgcccttggttataacaccttttatttgttaacatttaaaatgctttcaaatctttaacaataataaaggcattagttattttaattaatttgtatggatggaataaaaccaaagggaaggtgtcattttctggttgcaataaaaagatataaaagttaattgcttttcttttcttcctttttttttttttttttgagaggcgtctcgctctgtcgcccaggctggagtgcagtggcacgatctcggctcactgcaagctccaccttctgggttcaccccattctcctgcctcagcctcccgagtagccgggactacaggcgcccgccaccacgccggctaattttttgtatttttagtagagacggggtttcatcatgttagccaggatggtctcgatctcctgacctcgtgatccgcccgcctcggcctcccaaggtgctgggattacaggcgtgagccaccgcgcccggcaattgcttttcttttctaagaaaattttgctgacatccttggtacatattgctattcttaaatgtttgagtttactaatcctcaacagtaaatatctttaaaaatgtataaccttgcttaatattagttacctaagaatgccacaagaaactggcatctttatagttactttatattacagagtgtaataaattctagaaagatgggactaattatggtaacagacattttatactcaataaaaactttccttaatttcacccttatgcagggagtctcagtagagtacctctcttttgtgtcttggttggtatggcatggcactaagtgacattagattagcaactggggaacaactttgtgaaactgtttatggaagtgaattttcagagttcacggttgtgggtttttttcctatctcagatcacctagcaactttagattcaggcggaagttggagtttattttacaaaacatgaaaaagcttttaaaccaacatttttgaggtaaatctgtagcaaaagtgaggccacctgctgttaagaaaagtgcctacacattcatcacatttctgtccccagtagagggtactgctgagtaaaacactgccattgttgttcagatcctataggtggcagcagttcctacagtttcagagcataacaatggctcgatttgtgggtctaagaataaagctgtcacgaactcatggaatctttatactgtaagggctcttctttgaaatgtgatacatgagaaaattaccattaatgtttagtttcccttttaagatttaagtagcttatctttcttttaagttccattttgtatttgaaagtgtgtccccaaacaagtattgacagccgtaattttatggtgttaaattatgaagtataaatttttaggtaatctcagggaaagatatgatgtaaacttttttttcttttcctctcccaccctagccttccaccccaattacaagaatcatccattgttaatgttgactgctgctgcaatcttgagaaggaagtcctagttgctatacaagcataattttctccatgttcaggagctgagtgcttaatggttttaacattgccattcaacttttaggaggctttgaaccaaattgtagcacctatcaaagagtgattttataactctctttaagaaaaaagatttgaaacatactgtagtttctgttaggcgacacagaactgaggatgtaagtactgtactcttagagcaactcaccttttgccactcccaagcagcagagtgcttgttacttcagtgggtcacttgcacacacatacacacaccctccacacatccagaataaactccatattaggtataacaattgtaattcattcagttttaacggtcaagtgaacattaaaaaaattttccctgctaattattgtgtttagttcagagagttgcaaaatgctaaataaaactagttttttggttcaagtcaaaatagagttaagcctatctctagaaatgcctattcagaaattcagcaacccttgtcttattgctcaaattaattatccagaaactgtattatgatcgtttactcaaattaatatgaaaatctgagaattctatctttgttttaaattcaggaaagactagattctttttatttatcatttgagataacaaagtaaactaatggcaatgtatgagtatcttaacgtattttgaagggaataggttaaactgttactcttttggagctgatctctttgtatcaattaggtacatttgtaaactctatatttttgaaccatatttttggaactaatctaaagctgtgaaatgaatacattatttcaaattaaaacatacatatttatatgtattatacatatcatacatagagatgcatatatatatttattgaagataaaggaaatgtaggttttagggttgtagaacatttggatcatataaataggagatacatgcctatactttctatcatccatattatgtgtgtgtgtgtgtgtatgtatatatgaatacatttattcaatagtatgttcagaatgatgtttttcatgaagaattattagtgtcacatatgattccatttcccatttggtggatgtgaaaggaaacagaattatataagcaaaaaagtttgctgggaacctcacatgctcttagtaattattttgtgcattgtcagctactgaaaaaattatttgtttttaaaggaactactaggagcaaagtataaatcaacttatttttgaacacttgtaatattatatgttcatataaaatctatttttgatggcataatgacagtttaattatgtgcatttttttgtccttgctgttgtttttagcatatttataatagctagctgaataggaaaaaatcatcacttaaggcaaggctcttcaggtcatctgtgaacattctgtctatcctttctttaaaaatattttgaacaccaagatatgacaagataaattccatttttatttttgcaattctctttcagaagcttatgttaaaattaatttcagtttatattattttcttatgtaacttatgaacatgtaaggatgatcactttgttctaatttgtaaatttttacaaagtattttagtaaaatgatatatgtccttcagtgaattcatattgctattcaacaaaacattccctaatgataaagttgatatttatgttttgtaagtaaaatcatttcgatgaatgacaaagcttttgatgaatcagatactatcaaagcttggagttgttttcagaaattgaatgtatgctggtttaaaaaataagctaaaatatatttttaggtatcatacatatggggaaaaaatgagatatatagttaagtttgaacagcttagactcatttaaacccgggttttagaaatttcaattccttgtaattaaaaattctgttgatctatttaaaaatgaatatgtatttaactttcccatatttaacaatagtaaactttaatattagtaaaatattacctaaaagatgttcacagaaactgttgacatgtttgaaaggatagaatataattaactcatgcattttgaggggaattttagggcttagagaattgcataatagactgatagggaaagactttcaggagagggagcacagtgactgatatgcctgaatttgagaaagcagcagatacaataaatgtctgattctatgtaacaagtagtaaatggaatttttcactaattgaatttttctgtttaacctagtgtccatgtgtacgtattgtacatatgactagttttgtaagcattagaatataataaacttaatcttaaacatacacccaaaacaattacttccaaaaattcttcaggaggtctattggaatctttagtgtgaatgattatcattgtgagcatctattgctattttagagtcttgcttatggggaaaaataatttgataatgattgagctttctgattacctgggtactacataaataagagtgttaacactaatttctgtacatttaggtaaatatatttacttataaacatttaacgaaaatattattattaaacatagttctattttgagtaaataatttaaaatgctgggaccgttttctctgagtggccttcttcagacttctggaccctagaaatggccttatacttcaccctaggagggccctttttttcacaggcctgaaactctgtagaatccatgttggatattattaatgaacatgtttctttttgtagaggggagaatgatgattagaaaggtaaattagtatcataaacactccagatatttcagcatatgcgtgaaattattctctctcttcatggaatccattgtcttcatgtgcatctagtttcgtgacctacaaaagaggacttctgagccatgggcatgtacaatcaggttctgcttaaagtcaacatttcttataaaggcaccatctgtattacaaagaatcatgatgccaatgctgtggctttgagtgctgtccaatggaatcaacaagtacatatagcatgcatgttgtgggcaagacatgtgcttagcactatataaaaatacactaaaggctcctacaactgacattttcccattcaggcctgactcttcagccctctctactctcttacctgaatagatatgtcaccctcagtcagtgtggggagaataaagctgaatgtgaaatttagctgccttaacatttaaagtcaacttttcatttaactcatttttttcttctgtgctttcagaaaaacaatgatgagatcaaaattagttactcatgaattcaaccacagttattaaactttactatttttgaggtatagggatccaacagtacctgttctgaagttcattttagtctaatggactttattagccttaaagatgttatctagttaatgcaatatattacacataggcagtgtaattgctctcctctgtttagagagtgtatatgagtagtcataaattcttgatggcataacccaaactggtatcctaaatccttgacttctaattttagaccattgtacttctaaagtttgcttgtaatttgagtattaagaaattaaaggacaagaacatatgaaggccatcatgtagctcaaggtctaagggaaaataatgctgtttcagttctcaatataaaacaaaaataattatatgagtaattattcattttgaaaactgatcttcaagtaaaactgggcttaatcaaaaaaggagtaagccctgaagaccttttgcattgtaaaattctagcaaagttgtgattcccgttgattttaaagagtgataggagtggagcttctgaatatcccctgagattttagaagtatatgatactggcagttgtcacaaaaatatatttctagagaagtctgaataattgactctttaaaaattatgttttcttgcaaaatctctaaggaactgaagaagtttctaagaatcacaggcatgctcttaaagcattaccatgagcctttactctgaaatacctcatagtggtacctcataccttctttgcagaaatgagtgcctaagtcctaatggggagaaatgtactccaaaatgatctgaagccattggcagggagacagaagagatactattagcagagcagaaacaaaaataggtggatagagccaatgggttttttttttttggtagaaactgacaaacgattttaacgtttatatgaaaatgtaaagaaccaataatagtcaaaatcatctggaagaaaaggaagaaagttggaagatttacactaccagatatcaaggcttgttataaagctacagtaattaagatagcgtggtattggtgtaaggattgatgaaagtcaaataaaatgataaggagtccaaaaatatacccacatatatgtggaaacttgattttataacataggtagcactgcaaaacaatgaagatggatggtatttttaataaaatattctgattcaactggataacctcatgaaaaaaaatcatggtcctctacctcataccatatacaaatatcaatttcagatttctatttagactataagtctaaatatagagggtaaagcagtaaagcttctaacattaatgcataagaatatcttcatgaccctgagttaggtaaggatatcttaaataggacaaaaaaaaaaaaaccatacagaaaagattgataaattggtctatgttataattaggaatttctgttattgaaggacactatttagaaagtagaaatgtaagttacagagtaggaggcggtatttgaaatgcatataactaaggacttattttcagaatatataacaaattcttacaaatcaacaggaaaaaaaagaacctaatttcacaaatgtgaaaaacatgaacaggcacttcacgaacagtatatccaaatggccgataaacagaaaaagatactaaaccgaaatagtcaccaggtaaatacaaattgaaaccaaaataagataccaacatatttccaacagaatggtgaaaactaagactggcaaaaccaagtattgataataacgttgagcaattgaaactcatatacactactaatggaaaaaccattttggaaaactgcttgacagtgtctgttaaagctgaaagtatatgcatcctgtttcctggcaatttcgttctctggtatagtagaccctacaaaaatgtgtgcaccaaaagacgtatgcaagaatgttcatagtattttttaatagctgaacactggaaataactcaaatgcccatcaacattagaaaagacaaataaattgtggtttattcatataatggaatatttttaaagcaaagaaaatgaatcaactatttccacacacaatatgctgtacaaatctcacaaacataatgttgagcaaaagatgacagactcaaaataatacatacagtcatgcatcacttaacaatggcgatacgttctgagaaatgtgtccttaggcaattttgttgtgcgaacatcatagagtgtacttacacaaacctagatggtatagcctgctgcacacataggctatgtggtatagcctgccgctctgaggctacaaacctctccagcatgttactgtactggatactgtgggcaactgtaacacaatggtaagtatttatgtatctaaacataggaagggtacaataaaaaactgatattataatctgaagggaccaacatatatgtggtccttctcttaccaaaacatccttatgcaacagatgactatactatatgattccatttgtataaagtccaaaggatggcaaaaccaatctgtggtgttagaaatcaggataatgcttacctctggggaagagagaaagggaacaagggaagcttcaggagtgctactaatattccatttcttaaactgggtgatgattatgtgggtgtgttcactttttttatttttattttttgagatggagtctcactctgtcgcccaggcttgagtgcagtggtgcggtctcagcccactgcaacctctgtcccctgggttcaagcaattctcatgcctcagcctcctgagtagctgggattacaggcccgtgccaccacgcctggctaatctttgtatttttttagtagagacggagtttcaccatgttggccaggctggccttgaactcctggcctcaagtgatccacccaccttggcctcccaaagtgctgggattacaggtgtgagccaccgtctctgacctgggtgtgttcactctgtgataattctttcagccatgatcttatttttttacttttctgtatgtacattgtacttcagtaaacaagtttaataaaaaagagaggtaacagaagttgtgttttgtttgttgtttgtttgtttgttttttagcttttccaatacagagcagaggaaaagcagtctggaatgtggataagaagctctggaagctttttctgatttgaaagaggtggttcacgagataaatatttttaacttaggcacaaactcatagtgtgtactgatgttggtcatagaatgcctcaatgttgcaaggttcttcgggctgtggttctttacctacacaggatagtgtttatgaacctgaatgttgttaaaggaactttagtcagagagctgaaagccattgagcatatatgttgctcagcacagataccgcttcttccagaaagccttcccaggcccatcagtttgggccaaatgctttccttctatgttcccacaaatccttggtgtaccccccaagaaaccgtaagcttcctgagtgaagttgtctgtgttgtctgtcctgagagacattgtctgtgttgtttataatttagattccagtgcctaacattgtgcccagtactgaataaaataagtacatgaatgaatgtttgtaagtcagtcgttcataacatgaaatatgcttaactatgtgtttcactattttatagatagatttgatcattttggaacatgtaattcttatcagcactgaatattaggatgaggaatttgggacccttttgtaggcactagccttttgttactgtagttaaattttacgataaactaaaacttgaggataagtggtcaaaataaaaaaaagtttatgttaaagtagaaacttaaaaaggcctggtattcactgttagaacaaactacttttctcagagtaacattgtgctcatctttaagttactttataaaaatgtgaaatcagcttttttttttctgataacatagagcttagtgatattttgaagttgctcttaaatcatctacagcttaaaaagaactttctagcaaagtcattataggtaatgatttctcaaatgttttgagtttttagtatttgtttattatataaagttgaaatatgtactatcatgataattataatcaaatagagaggtcagacttgaattttatatttctaccactgacatgctttctgtcaaattaacaggttttttttaaataaagttttgacattggattcataaggactgatgtctgtatcatactacaaatataaactgtttaatttaatgacaatgcctaaaccaggtaaccggagtgaagacaaatgaaattcttccttttgtactggtcattgtgtgaaggcaatcatagacacaacctgtgtcctgggatgagatatgtgaaatggatgcaagtcctcaaatgttatcattttatgcattcaaatggatagtcagaagacccataaggcccctaatttagaaattcccacagttctcaataaagtggctttccactagtttgagttgtcaccttttccaaagacttgacaccacatcttcctcaatgaagtaattctgcttcaagcaggtagattttcatattcatggcctacaggccagatttcaaatgctctttagtattttctttatgtcatagcacacttggcttttgggtagtttctgcctcattttcatactagctttgtaaagatttctgtagtatgtaagagaactctaaaattgaggcttatgtaattaaatgagatatagtttagacttatgaaagaacggcatgaagtatgtgtctcataccaatatcaatgacattaaagtctccatatgtatcaagttatctatctttagggatatgaaatgtgtaagtttgccagtatataattcagtaatatttgagtgtgttggccgggcgcggtggctcacacctgtaatcccagccttttgggaggccaaggcgggtggatcacctgaggtcaggagttcgagacaccagcctgaccaacatggtgaaaccccatctctactaaaaatacaaaaaaaattagctgagtgtggtggcgcatgcctgtaatcccagctatttgggaggctgaggcaggagaatcgcttgaacccaggaggcagaggttgtggtaagccaagattgtgccattgcactccagcctgagtaacaagagcaaaactctgtcttttaaaaaaaatttgagtatgttattaataacttatttgtatacagaaattagccaggcatggtggtgtgcacctgtgatcccagctacacaggaggctgaggtgggaggatcacttgagcccaggaagtgaaggttgcagtgagccatgattgctccactgcactccagcctgggtgacaagcgagatcctctctcaaatcaaacaaaaaaaaaactcaccccaaaaaacccaaacttatttgtaaagtgatgttcagttgcattgttatgaaatatggagtcatactttttttaagcacaaggatacttattaaaaattagaaaagccttagggtatttgtgtgtgtgtgtgtgtgtgtgtgtgtgtgtgtgttttaagaaatggagtccctttccattgcccagactggagtacagtggcacagtcatagctcactgcagccttgaactcgtgggctcaagggatcctcctgtccccccgtcctgaggagctgggactgcaggtatataccactatgcctggctaagttttaaacattgttttagaaatggagtctagccatgttgtccaggctggtttcaaacttctggtctcaggcaatcctcctcctgcctcagcctcccaaagttctgggattacaggcatgacccaccaacgctggacttttaatttttgacgtttttaaaattcttcctctagtctaatggttttcatatttatttgttcatggaatactattttttttttttttttttttgagatggagtcttgctctgtcgcccaggctggagtgcaatggcgcaatcttggctcactgcaatctctgcctcccaggttcaagcaattctcctgcctaagcctcttgagtatttgggattacaggcacccgccagcatgcccagctaatttttgtatttttagtaaagacggggtttcaccatgttggtcaggctggtctcgaactcctgaactcagatgatccacctgccttggcctcccaaagtgccgggattacatgtgtgagccactgcgcctggccggaatactttttatattctgatgtcgtggaagaactccaaaatgaagtaatgaggtataatagtatattgcaatacttggattacaattgacaggaaaataaaaccttgcaaactaattgccgtgagaagtagcaattgtgattcttatgctttgaaaactttaacagaatggaaaaaataatggtaacatattagaaaaattggattattgtaaaaagaacaagaaaaacctaatttaaaatgaaattaaaaaaacactttcaatgagaacagtgtttttatgtcttatccatacccatctaatataaggagaactacttattgggttccatgttcactatttgggtgaaaggttcacttgaagcccaaacctcagtattatgcaatatacccatgtaataaacctgcacatgtacttgctgaatctaatgtatatattagattaatacacacacacgcacactcacacacacacacaaatatatgggcaatgtttcactgttggatctgcataccagatgcaacatccagttatagtattatatatatttttaatgcagacagatgcaaaaatccttttccacacagatatgttagaaataaaaggaaaaatatatagacttttacaatagttaggtactcttgaatcagaccattccaaagtgtttaattatataattttcaataatagctcatttgtcatctttctttttcttgtctttttctttctttctttctttctttttgagatggagttttgctctcgttgcccagactggagtgcaatggcgcgatcttggctcaccacaacctccgcctcccgggttcaagtgattctcctgcctcagcctcctgagtagctgggattacaggcatgcgccaccacactcggctaattttgtatttttagtagagatggggtttcaccatgttggtcaggctggtctcgaactcccgacctcaggtgatccacctgcctcggcctcccaaagtgctgggattacaggcatgagccactgcacccagccttatcgtttttctagaaactaaaatctccacatatttatcttcattttgaagtattctggatttcaagtactcatgtacttgaaagttatatgtattataacttatgttgtgagagcagtattttactagatgaacagtatgtatttctctccattccagcctaataattcaataagatctaaattcagctttactattttctttataaagtgcttaaaattgaacaaacaggaggagaaaaaggaagagaagaaaacagcaatgaagtcatttaggaatgataagcaaatgtggccaggtgaggtggctcacacctgtaattacaacactttgggagtccgaggtgggtgaatcagttgagctcaagaatttgacaccagcttgggcaaaatgatgaaaccttgtctctacaaaaaatacaaaaaaaattagctgggcatggtggcatgcctgtagtctcagctacttgggaggcggaggtgggaggatggctcaagcccaggagacagaggttgcagtgagctgagagcacgccactgcactccagcctgagcagtagagccagaccttgtctcaaaaaaaaaaaaaaaaaaaaggtaaatgcagagtattccagagattgtgacaaactcttagctatttctatgtttttgagatttccagcaaggttgtgccaatggctggaggggatagaagaggtggtccattctagggcaatgaagtgagttagataatttttcaaaaaaaataataaaattgaaagttgttctgcttttaattatcatatgtgcctaaaatttttttaaatgccagtggtaaaatacctctccctatccttattcatgtagaccactcctaccatgccgtaccttttggtacaccattggcttccaggatatttaaaaactgaagaaaataccgaaaacagggttacaaaaattttggaatattttaaatgtgttaatttaataaagtaactctttgtacaaaggcaatttaattgagctattcataggatagttgtataatatagaaatatgtaacttacactgcactatgataaatgcctgactttcggccctgtcaggttatcacttgtgactatacatctgacctttttttgattttctttatggctatgagggcagaccatacacttttcttgttgctgttcttttacctattgcacccccttaaccagaatgggccctttttaattggtaactaattgccttaaaggtatgttgagaatatagcattctttgaaggtatcaacaaatttataagaaaagtttgtagagcatgaaattcaggaaatgttttctttctttcttttttaatcaattaagtaattagatttagttctactaatattactgatttaccttaaatcgtgaatccagctgatgaactttttgaaatgtgaagcactggttaggaatttgagaactgcagatgtgagactcatctagatcttagttatgattttattgttcacttcatttgaaggacagagaaaaaaaggcaggggttgaacataaatctcagagactgtatgaggattaatgaaattatgtcccttataaaacatttgagttttttttttggtagaatgccagtatgtgagaataaaggaggatattcaccagtgtcttctaacatttaaaatgttaggagaagcagatcatatttgaaaatgaaatttagtctgtggttaatagtttatttcctcttaaaattgttatcaacttccataaatgtaaattatatatttttattttcatattttttgatagtcaatacttgtttccaacatggacaatattaaactgtaaagtttctgaagtactccaggtttctcaaatactcttatttccaggtaagaataaaaaatgtaaaaaatattttaaaagttaaaaaaataatattgcaagtaagcaatgtaggtaaggtgttttgcatctgagagtgcgtttgcccaacttaactaatagggcaaaagcactattgtgatgacatctttgacgaatctttcttggacccaatatcaccgatgatgttggtttgtgggttgggccttcttcactgcttggtttatctttggtgtcaatcagtggtaatgatacaatccatgacaaaatattttttgttgaatatttatcatcactcaaaataggacacagttctttctaaagataaaggctttctcctaaggcatttgttcctactttaaggatttactgtagcagaatatgcttcttggattttatttattagagctaagttatctgatctttgggggacatattgtatcttttttttttttttctttttttgagacacagtcttgccctgtcgcccaggctagagtgcaatggcatgatcttagctcactgcaacctccacctcctgggttcaagcgattctcctgcctcagcctcctgagtagctgggattacaggcatgtaccaccatgcccagctaatttttgtaatttttttagcagagacggggtttcaccatgctggccaggctggtctcgagctcctgacctcgtgatccacccacctcaggcttccaaagtgctgggattacaggcatgagccactgcacctggccttaatattttgctctattaagcactggtcaacaggaaaaaaacatgaatttactttgaatcctaaaaaagttatgactttagaactaaagtcacctgtgccaggtacctgaggcctcagaaacaaatatctgcctatatactgtatatttgaaaacaaagtagcaaaactttttgtttttaagttttagttctggacttctactcctgcagcccgttagaaatcattctgtctttctctgtctctctcaagtctaaacaaccccagaggatgtactgttgtttttatttgttttataaagtgctaatcaaactattgatggtttaaaaaattatttgataataatgattttgctttttgtttttattcttcttcatgagatgtgtttttcccagggcaagttgataaagacatttttgaccacctgatttttgcctgttgccattgacttttcctttttgaagtgtgactaaactttgagagctccttctttggtaatttatagaagaaaaagccttggaaaaaatatttgtacttgattttaaggggtaacaaaatttctttgttgtttgttttttggaattgtgttaaagaaaattacgaaattgtaatgactaagtgcatatttttgaagggttttactttgtttatttccttcatcaaaaaaataagcaaaccagtaactgttaaccctaatttatttttactcttcaagtgacattacttttaactggctacatttggataataaaagccatggattttaaaccacttagtaatttggtttcatttttaacacaaataacaccttttcatccattttatataaacttcaaacaacatatgttttaacttactgccaaataagaagaaatgtgttacattaaagtgcatgttgtttgcctgtgcatttggaaataccattcattttatagcaattttgagttatttttctgtcactttgtattcctattcaaagagacatacagaaaccctcgctcaaaacaactcccttagggtttactcttggatgtcagtagacatgaacgggaggtactgtatacaacaagcttaggtgatggaaatgtcaactcttgttgacttgcatttattattatcctttgaattgtgtcctcttgagattttgtgagtggtattttaatatatttcttttatgtttgaggtgggcaaaagagagagaccacctcactttttttcccccctcttccctctgtttacgtacaaaaatgagatactctcattctctagaatttgatccaaattttaaaactgttgctaagggataatggtcatgcagaatgtgaaatgttaataacataaaacactaggacataaaaatggaaacattttcagtgctaacatgcaattcaaagtgttggattgtttttaaattaatgagaaagtatttttaaagccctttttctttaggatcttaaattgtaccaagagaacatggattcttttaaagaacacaggttagagttagttaaaacctaccaattagtataggaaagagagactccattatgacagataaggtttagatagaattattattagtaaattagaaaatttaaaaacatccccaggaagctttctctgacctctcacctcctgcccttgttgggttaggtgcctgccactctgtgaagctcaagtaatcagagcactgtgcttagcacatcctcactagtctgtgagctctttcaaggcaggtactgtatcttatttggcttagttttttcatccatctcacacagtagttgctcaggaagtatctgttgaatgaacgtgagatgtagagtgatgatggatagaccctaattatgtccacatccatgtaataaaataagcagtatatttaggtttgagaataatctcactacttttttaaagaaataaatgcctctgcaatctttctaaaaataattgatttttatttttagccaggttcttgctctgtcacccaggctagaatggtagtagtgtgatcataggtcactgcagccttgaactcctaagcttaagcaatcctcctgcctacgcctcctgagtagcctggactacaggtgcatgccacctgcccagctaattttttaaatttttttggtagcggtcaggatcttgctatggtgcccaggctggtcttgaactcctggcctcaagcaatcctcctgccttggtctaccaaagtgctggaattaaagatgtgagccaccgtgcacagccaagaattgatatttattttgaggactgactagaagttttaaaattaaaaagaaaattcattgcagttttgtaatatgtgaaaaaaatcatgaaaatatattgttaaaaatgtcatcacaattctggtaatctaactttgggtttctaaaagcttttgtagtgttaatgttaatactgccctttattgtaggccaaggatgtcaattggaagcaattcttactactggttgttggcaagttgcatgagcaaggcagatttggacccagcctgaaatctctagtcagctccattctttagcagctgtcacagtgtagttccagcagtggtgtgtacctttcttgttccacattatgagcccacaaagaaagccaccagtgaacaggaccagctaaaagttttattctccttctattgggttgcttttgagtagatccaatttcatttttattagtgattcagtttcttccacgtataatcacatgtctttggcagaatctcttactttcttatgaatacctagtaactcaaagtaaagaacagtgaataatccttaaatacagagtatttagtttttttccctcctgcattcagagtaaggccatggttgcactaggccatacccaagttaataatttgtaaaatgccaaagcatttgaagcttttcagatttctattgtaaaagtcctcagtacaattttacactgtcctttatattgaccaatctaaagatttgactattaatttaaccagcattattgtacttttcctctggaataaatcagggctttttaaatgaattgatcccttactgtcttataacaataaagcatattcagcgtcatatttttccgatactattgcacaatattgtcaatacttgaatagaagaacagctgttgtctagggagtgaaggttaaaggtaaacactccctactgattcaaagaaacacgggcaccctatttattatgtatttgtaagtagagctctgcagagtattgccacatttaatgtatatttcatagagtaacaaaagcattttccacttttgactaatacagtttttagagcccatccttgtaggtgacttgtacgtatgccttacaggcacacaataaatattagctgatgatgagagatgaatatccttgcttttcacttctgaacatgagataaccaagccttttaggtagagttaattaatatctggtggtcttctacgttcctaagggaatatgactttgaattctctctcttcatcatagataaatgtgtagtcacaaatgtggtgttccagttttgggcttgggaaatgaagtttaaatgaataatggtaatccatggtaatagaaatgcttagttctactgggtatttaagtctaatatgtaggcatctggggactctgatacactgatttacttgtaggtaaaaacgtttagagctgctggcagtgttttttgttgggatcatttgttgcatttttagtgtaacagtggacttagaagttaaatgtcaacctttggccgaaataatctgctagtcaaagaccttggacatttaggggtttttaaattggaagtggaagggtatcctcatttattattcatagctacagtatgttagttattattcttttgttaaaaatgtgacaaaattaaaggcaaatgtagttttaaaggctccagagtaaattagaaaactgatttcgtacatctgcaaaaattttattagctgattattttacctcaattaatattgggaatgttgacagataactacacatcgctgtttcacaagaaatattttgtgtatgtttattctttatgatcagaaaaataaatagtgtagattggacagtgttcatttttcataaatggaaaagaacattgttcttttactagccagagttggaagaaagtacttgggataagaaataaaaatgaatgtgtacatttcagtatgtgtagtggaatggattcaggaaattcattctttcatattaatttttctaaacattttttatgtagggataacagataagagagagtaaaaaaaatcccatttagtaaaaaaacaaacatatttgtatagatgtagtaaagatacacctgaaagttacataccaaattattaactgttcttttgggggaataaacctctaaccagggaccttttctttttaagaatttttatacctccatattatttgattttattttgaggagcatgtattatacctgtaatttaaaaaaattaagcaggcaaagagagagagagagagagagagagagagagagagggatagtatatgaagggctataggcagccccagaagagcaagaaaggcaaagaccaagcaggcatcagagctggatcctgacatagcaagcaattcagacacctgccgggcatcggggcagggtgaagtcttcttaccagaagagaaatctggagcagggaagttgggggacctgtgtggggtagggagtaggtttgtaaattggaatgttgtggtagagtaagactggaaaggttaggtcattcattatggagatagtctgaaataaagacatcagggatcatggagtgtagttaggatataagcattttgtacaagagtttgatgcttgtttcctttatatttttaccctgtggagcccttgggagttcaagtatgtgtctattgagagagatccatcatagcacctttatttatttattattactatttattagaaaatgagcaatgcttaacctctctagatagctttaatacagtgacatgacttcatgttgtggagttggacaggttatatgaacatgcagaaatgtagctattcagtttctcagttttggtgatgacccatgtcaaataatttttaaattgtctaatatgagattaggctcttacactgagaaattaaagtaaaacaagctatttattaacagagtaggtggactaatcctttgctagagtaaatatgaggagctacatcaacacacatatacattctctacgtaaggttaagatgtatgtagctaaatatattcattagtattacttaggagatgctctttcttttgtcatgtttctttggcaaaagctagcagttctgttagcagtggttttgatgataaaatcctgtaattcaagaggttggcttattcaactaaacaactgctaccttgggcaatactggaccaactgcgaggggactgttttcttgagacctggaaagctgttctgtttgctaaacaaaggaattgttgatttcagtgatttaattccccttttggctaaaggctgctgaatgaaaacagtgcttgtttgggaaggaatctgttgctaaggcaactgatatctccttaattattggccaatattcccaaatgagattggtctcttttgactgttggaaataaccaaattatcctgagcactttcaagtcttgaattttgtggtaatggcgggggttgggggagggatttctctcaagtatataaacagatatctcccatttgggttggcatagtgtgagcactgtgtttatgagggtaaaaatatagatgatatttgcaaaacctcttttattgtaagagatcttattacttaagacgagttgcaattctgagatgagtgacctatgtttaatctttttttaaaaaatgaattatttgatttctgtaagaaaatagaatacatctaatcatttatcctcaagaataggcagatatatggagaaacttgtaagtattatttgaatgatgctaacaaggactgtcttcagaagcgtctgcagccatttatgtgaggttctttacttgaatgtttctagcactgcatatgctgaccttggagagtgacctcttttctgtctattactttgtaggatcatgtaaaagacctgtggtttcttgtctcttggcagtacagttgtttgatcatttaaaattaattgaagctttgaatatagtcaggctcaagttctagtgtattcatatcatactttgtaattgctctctagtgtgaaggacatactaaaacatcagtacagttcttacaaaatgggaatttgtctttataattttattgtatgtcttttaaattcttatagtgaatcatagagatcacacattattatcttatatccttacaacaaaacgggaattcactgttctttggtacttgtcctgtgacaagcctggtgagtattgatgaaattcttctaatattacttggggtatcccagatcttccagttgagtgaacatgaggttctgaagtgtgactgtttatgatttctgtgttgtagaaccatgaaaattttgtaggagtctcacatgaaaggcttttggcacaatagcactgagtaaaatctgttttgtgatacttctgaatggttatagttcttacttaggagtagtctttccatgtttcattcatagagatgacattgggtttataccttgggttgaattgaatataaaaagctttgtgtactatgtattggaagaatacttgagttggatttcatgtacatatttattatctatcctagatttatgaaatttcactcttcattttaaatagcttcaagaagtaaatacaagattcacttgatgaaaatattaaaatacatgaaaaggacaatatcctgcgaaactgttgactaaaatataagcacagaaccacagaatataagttcaaagctgtccctacatgtctctagagtatcattaatctagttctcactagggttttagagtatctaagtaggttttacactatctactgaagttcttccatatcagactataaatataagcatacagttaaatctgtgatacattttgaattagcctccctttttaggactcttttgagcttgtcttatttaaaatatgttgaagtatgaactatcagacttcaaaaacattgttctttgaaaaacatttttgtgctgtatttttaaattccttgatatttataattatttaaaagatttttgttgtagtcatctagtttataagattaattttttcctggattattgtaggaaaaaaacaagtttttaaataagataatgtaaagagaatttatatatttatgttgattagatcataaaaatttgacccaagttattatatatgttaaattctatgaatttattactttgttttgtcacatattagttgactcaattttccaacatttccagcattttgcccttttctcagatacttttttttttttttttctggagtcttgctctgttgcccaggctggagtgcagtggcacaatctcagctcactgtaacctttgcctcctggattcaaacgattctcctgcctcagcctcctgagtagctgggattataggcacgcaccatcacacccagctaatttttgtatttttagtagagatggggtttcaccatgttgaccagactggtcttgaactcctgacctcaaatgatcctcccactttggcctcccaaattgctgtgattacaggcatgagtcatcatgcccagcctcagattagttgaagatcaaagatatagagagaatattttgttagcaatttcttagctttttttttaaccttatatattttggtttttttttttcctggagacttgtacttagtactaacttcagtttgcataatatatatttatatattcaatgtgaatattttatatacatacctatgacaaatcttaatttttatatacaaatatatggcagtgttctttttctttctgcaatggtaggttttttcttcaattcaagactaattcagtattttatttacctttatttataaccacgtgtggtatctttcttttgagaaagcattgacactctattgctattaaacactttcactgggtgagatagaactgttgttgactgtacattatgtgtgtgccagagaatataaaggaacaatggagaaatgtcccatcacaattttgaaagggtctattttaaatgctacgtgtttctactagaatatagagctgtaatttggaacaggagtgaagaaagagacttgtagaatttaagttgcctatctcctatctcctaactcattgggaggctgggtcttcattgtgaagtctctcatgtatacctgttaaatgaatttgtatgccttttgtcctattaaaaaattaattaataaagggctcggacaaattgaaacactgggtctactcaggaaatatttttataggtgcagttcgaatgtttgaattaggatgtaacattagaaaacgtaaaggagctgggcatggtggctcgtgcttgtagtcccagcaggaggctgaggcaggagtttcgcttgagcccaggagttggagttgaaggttgcagtgagctataattacatcactgcattccaacctgggcaatagagtagcggggtgggttggaggcgaaacaagaataaaatgatacaacaaaaacaaaaaagcaaaacaacaaaaagagaaaatgtaaaggctatgtaaggcttgcctcaggcaaaaattatcaaataggccaggcgcagtgcctcacacatgtaatgtcagcctggccaacatggtgaaacttgtctctacaaaaaatacaaaatattagctggatatggtggcaggtacctgtaatcccaactactcaggaggctgaggcaggagaattgcttgaacccaggaggcagaggttgcggtgagccaagatcgcaccactacactccagcctggacaacagagttgaaactctgtctttaaaaaaaaaaaattaccgaataaatatacatttatctttggtgtttcccaacttagatttgaattgttgtatctctcccctaaaccctgccctgtgctcttgtgtgccctgtgactgattagtatccttgtctctgtcactccaggtctgctctctttttcttttccctttctgcacttcaagccttccttacctcccatgcccttgtacccttttaactttctttaaaaatggccagtgctttatttcagtttcactgtgtccattctctagaaattaatctgatgcactaatcaccattaaattgataatgcttgataatgtcttgccttgatctggtttgccatcttaattagaattttaacttagctttttagaggagaacatttcaagacataccaccttgattgttgaacttgggttaggtaatatttcaaggtggttcataaaggtatttattttaaaggaaaaagaacactgagagcccagcatgcatatccaccttcaagatttaataatttgagatttcaactgtcccttaaggaaagctgattttagaagagagaaggtaaaactattcaataattattatccataataaaatatattatagttcctttttcttagccaattaaaggaaaatactatgtattaataggatatgtaatttgggggtatagaaaacatttttttaactcatctaattatttttagtttttgtgatgatgactactgatttgtcctgtgctacatataattctttgtcacagttttattagcatatattatagccaagtgcttgcttggctatgaagagggcatttttattctgttccatgttatttttcttaccaaaaaatgcaacaaaaaactaaagtctattcaaaaaaagcttatttcattatttaaaaaaattctttcccatattccatatttcttttgttagtgtaataaccaatttttttttccagaaatttaacctctcccctgcttgtgtcattcaggtttggcccaaaagcaaacaatggaagtacttctgacctacctttgttagaaactttgcatatctaaatcattgcttgcaagagtgtgagggaaagtaagagtaaagaggatagaatataagagattgctctgtcctaagatattgatggtctattgggaaatcagataaccacatatgacacactctatcagcaagccagattacttttaagttctaagatatgtgaaaaagttaatagtatcagtcttcagagagaaaagagaaattacagcaggcttgagatgtcatagaagttttagactaaactttggtgataaaagggaagaggacctttgagatgaaaattttcaaatattcctatcagaattctcagcccagagatgatacatgcagcaaactgagaaaaagaggaaaaaagaatcgcttctaggcttcttcatttgtccacgtgaagtctgtccaaacccagtgtgacagagttgtagtttcaagcacgctgttcttagatcttagactgctgtgacaaaataccttagactggttggcttaaacaacagaaatctatttctcacacttctggaggctaggaaatctaagatcaaggtgcctccagattctgttcttgctgagttcgtctcctggcttgtcctagaagggctgtcttatccttatgttcttacatggcttttccttgatgaatttacttgtggagagaggtagagaaagaggaaaagagagaggggaagagcgggtggggagagagagagagagagagagagaaaacgaaacgggaagggggagagagagttgtctctttttgtaagggcccagatgctgttatgaaggccccatcttcatgacctcatctaagccttattacttcccaaaggccctatcttcaaataccatcacattagggattagggtttcaacatattaattttgagggacacaaacattcagaccataacacaacccagaactcatctgtgttatggtgagtcccacccttgccttaattccctatcttcccccagaatcctagaagataagacacactgctcaaatgacttaggacttagtttagggcactccctttagggtcatatgttgtattagttcagatttcaagtatttatagatatttttgaatttatgtttaattctttattcaaaatgagctttttgagagctcataattggcttaccttatgattccataaaagtgaatatttggctttagacaagtgtaatttgtttatttaacaaccatttaatggatgcctatgatgtgcttctttctgatttttggcctaggggtttgttcaatttcctatgcctcttacaagggcagaattgaggtggggccttttagtttttctgcgtccttgccagcctttggtgttgctgttatttttattttagccattttaatagatgtatggtgatatctcattatggctttaatttgcatttccttaatggctgatgttgtcaaagatctcttaatgtgcttattttccatctgtatatccttttttgtgaaatacctgttcagtgtcttgcccattgtgttagtctggttttttgttgctatgaaggaatatctgaagctgggtaatttgtaaagaaaagaggtttatttggctcatggttctacagcttgtacaagaagcatggcaccagcatctgcttctggtgatggcctccagctgcttccactcatggcagaaggcaaaggggagccagtgtgcacagaggtcatgtggtgaggggtgggaggagagatgccaggctctttttcacaactagctctcactgaatctaatagaccaagaactcacttattactgcaaggatgataccaagccatttgtgaatgatcccatccctgtgaaccaaacacctcacgttaggccccacctccaacactggggatcagatttcaacatgagatttggaggggtcaaacaaaccatattgaaactagagcacccactttctaattgtttttttttaataattgagttttgagaatttgtaaatatattctacatgctactctttgttggatatgcagtagtttgcaaatgttttctctcagtctgcagctactcttttcatctgcttaatagggtcttttgctgagcaaaggcttttagttttgatgaagtccaatttatttttctttgtgggttgtgcttttggcatcaattctaagaactagttttgtagctctaggtcctgaaaacttttcttctgtttttatctgaaagttttatagtcttatgttttacattaagtctgtggtccagtttgagttaattttttgtataaggtgggagtttttggtgaagattcacttttttgctgatgtccagttgctctattctttatcataaaggtcttcatcctcatcatcttaccattgaataggctgaggtgaaggaggcggaaaaggaggagtttgtcttgctgtcagaggcggaagaaaatccatgtgtaagtggacccgtgcagttcaaatccgtgttgtccaagagtcaactgtgcttcctttataaaatgtcagcttgttcctgttacattaaggagaaacaaggagtttatttactttatttatttatttatttatttatttatttatttatttatttgagacagagtctggctctgttgcccaggctgaagtgcagtggcgcgatcttggcttactgcaacctcctcctctcgggttcaagcatcctcccagctcagcctcccaagtagctgtgcatcaccatgcctggctaatttttgtatttttttatagagacaggatttcaccatgttgctcaggctggtctcgaactcctgggctcaagcagttcattccaccgtggcctcccaaagtgctagcattacaggcatgagccaccgcatcctgtgaaactaaaagtttaaatctgtgcttttttcaaggaaagaaggagcaaatggtaaatgttcctaagctaagtggtaggggtataaaagtgagaaaatgaaataaggaaagttgaaattcaaggagaatgagttgaagactacttgtatacctcatctcttctacacaatatatttatttctattggagaatttttctcatgccttaaggattttgtaaataaagggatgattctcttccttgcatgtgagacagttttcagcgattttcatttaaatatgtgagttatttttcatatttctttctgattatactgttttaaacatctggggataatagtggttggttttagtcaatatctgtataatttattctttgtttatattttgggatagatattatgttaaaatcctagttatgttctggtcggacagaaataaacgccatttctcaatgtagggggactctatgaatacagatactggtaaacccagatttttagtgctaataatgaataacaacatgagacatttcacatagtataaatatagttcaagaaatccatctccttataccaaattggatttctgtaataagtgtgctttactgactaattttctttcaaaattaactctgtttaaaccgttcttgctttttgtcatatttcaaaatgtgttagctaatattactttaaataatcaaggtatcatttttatcttgcaaatttatgctgatcaaaaaatcttcaaatctgaaatgtttataaaaatgactatgtgacggaatggcaaacatactctttaaaacgttttaattcgaaaagctcacaaggcatttagaaaggtagtgcctacaagaaaattcttatcttcaatattatttacctgttcattttggaattcataaaatttgtgcaatctttttttttttgaatatgtgtgtccttatcagaaaggaatagaaaaattgaaggcagtttggagctgaatagaagttattaatgagcttaactttgactgaaatgacagattaatggctaaattttcttctatagcaagtctgttagaacttctaccttgcttcagtaaattctttttgtcattacaaattggaggcaaaaggcaaagtaggtttaatttcaattttgaaactcagaccttaaatctttaatgaccttcactcagaaccaggattggttgtacttctttggagcacttataaaaaaaaccttatggatagtgtgcatcatggaacacatcacattttctcctttttattgactgcaaaaaagcactgaaccaaattcatggtggcctacttctaattggtgtactgtaccatgtagtatgccttttttgtaatgaccctgatttcatctcatttttttcttgtctattttctgtttgcagtgatctcctcatcattttagaagtcctgttgtgataatagtaaaagtaataattattcatatttatttagttctgtttataagcactctacatgtttcattaagtttaatgtttaacatcgctttgtgatagttactctcattatccccattttactgatgaagtagagtagtgctactcaaagcactagactgagaggagtttagcagcttgtaccagaattaaatcaacttactgcttccttcatcaagaaagtcatgctgtgaaaaaagtgtcagccgaactaaacaatgtgcttaatgatctgcattctgatgcaagaaacttacctcggcacaaactggcaacagacacttcattgtcagcctggacatcaaactttgagtagcactgttccagaacagtgtttctcaaactatctgtggtgaaggacttttatgcatgtgtttaaatgtttagcacttatgggctgagactttgataaagtaaaaacgttgtggtaatgtgaaaagtttctaagtactttaatgtaatgaccttgtcttgaacaagtaacagtgactttaaggactggcataggtagaccctgttttgagtagcactggtatagagtgaattagtgtatcaattgtgattgattctagatcctagggagaatcacagtgccttattcagcatcaacacatgagagttgcctaatttgcgtaaatgtaaacctatagccacattggtgggaaatagcagagcaaatatctaggtattaatcctgtggcatcagcaccttaggtttatctggtttgcatatagccagtcacagcaagggagtgagtaggcagtatacctataggtatagaaccagttacaggaagggagttccccactacagtgtttaaaaattccgagctttcatgcacaatgaaagcatgtttctttccttccctcacactcaaaggttgtgaacatcctacaagagaccattgtagacatccacctagaggttccagtactgtggctaaacgtttaccttatctcaaaggaatacgtatgtgtatatgtaggatgtgtagtaaaaggaaagtttggcctggatagattgaataactttctatgggattttttttcctttaggtaaataatcctatgataaatataagtaatctggttaggatatccttatcaatttctataatattatgttaaaggcagtggaaaaatatgatgtaacttgtatgtcttaaattgtatgtctcagctgggtgtggtggctcacgcctgtaatcccagcactccgggaggccaaggcaggtggatcacctgaggtcatgagttcgagaccagcctgaccaatatggtgaaaccctgtctctactaaaaatacaaaaattagccgggtgtggtggcatgtgcctgtagtcccagctactcgggaggctgagacaggagaattgcttgaacctgggaggtggaggttgcagtgagccgagatcatgccactacactccaggctggatgacagacccagaccccatgtcaaaaaaaaaaaaattatatgtcttaaattcctgtagctttaatgtgagaacactgaagcacagaaaggtgacaagagctaatgagggactgagccagggtttcagctcagccaggatttgagctcagggaactgtctccaatagcctaattatttttctttgtttttaacttttagttattttagactattacaaaaaaaaagttttttgtttttgttttttgttttgttttgttttgagtcagggtctctctttgtcacccaggctggagtgcagtcatcttggctcactgcaacctccacctcctggactcaagtgatcttcccacctcagccttctaagtagctgggactacaagcacatgccaccatgcctggccaattttttgtgttttttgtagagatggggtttcaccatgttgcccaggctggtcttgatctcttgagctcaagcaatcttcccacctcggcctcctgaataaaagttttaaaataagtataattcctgctgtggtttgagtatgtcaccagaattcatgtgttggaaatatggtccctggtatggcagtgttgggaggtggggccttaaggtggttaagagggattaatgctgctcttgcaggactcggtaattctcatgggagtgagttgtcactattgtagaactgaattggtaccatgagagcaagttgttataaagtgaggctaccctttgtgttttgctcacttcctttttgacttctgtgctatgttacaacgtgggacaagactttcaccagaaaccaaccagttgtggctgcccaatcttgggcttcccggtctccagaactgtgaatcagaataaaccttttttctttgtaaattacccaggctcaggtattctgttatagcaataaaaaatggactatgacagttctcaaatacttttcccctggcttccctgaatgttaacatcttacattaccatagaataattattgaaatctcaaaattgacattgatactgttaactgctctacagagcttattcaaatttcaccagaattttagtttttctattaatatcctttttctggtccatgatccaatccaagagcacatactgcatttagctgtcattttattttagtctctttaaatctgtggtaattccttagtctttctctgtctttcacggccttgatactttaaagagtactagtcaattattttgtagaatgtctgttaatttgagttcatctgatgtcttctcatgattacattgagattttaaagtttaaactagaatattacagaagtgatgtgctccttctcagtgaatcatactggggctacatgattctaacatgactcaattactggtaatgttcaccttgatcacttggctgaagtggtggatcctaggatcctccattacaacactactattttcccctttgtaattaatattaataaatatcttgttgagacatactttgagactatacaaatatcccatttctcattatactttccctctcagattttacattccactgattccatcgcctacattctttttaaaaaacttcatttcaatagttttcggggtacagatggtttttggtcacatggataagttctttagtggtgatttctgagattttagtgcacccatcacctgaacggtatacactgtacccagtatgtagtcttttatccctcacctccctgtcaaccttcctcctcgagtccccaaagtccattatatcactttttttttttgaggtggagtcttgctgtgttgcccaggctggagtttcgtggcatgatcttggctcactgcatgctccacctcttgggttcaagtgattctcctgcctcagcctcccaagtagctgggattacaggaatgtgccactgtgctcagctcatttttgtatttttagtagagacggggtttcaccatattggccaggttggtcttgggctcctcacctcaagtgatctgcccgcctcagcctcccaaagtgctgggattacaggcgtgagccactgtgcctggcccattatatcaatcttatgccttttcatccccatagcttagctcccacttttaagtgacaacatacgatatttagttttccattcctgagttgcttcacttagaataatggcctgtggctccatccaagttgctgcaaaggacattatttcattccttttattttttaagacggagtcttgctctgtcacgcaggctggcgtacaatggcgccatctcggctcactgcaacctccgcctactaggttcaagcaattctcatgcctcagctacctgagtagctgggactacaggtgtgcactaacacgcctggctaatttttgtatttttggtagagacagggtatcaccatgttagccaggctggtctcaaactcctgacctcaggcaatccgcctgcctcagcctcccaaagtgttgggattacagatatgagccaccacgcctggcctatttcattcctttttatggctgactagtatttcacgtcctacattcttaatcgttacattggacttttgtaaattatctgaaagtaaaaaggtacttcaactgagggctgagagatctgcctcctaaaaccatctggggctcttgctccctccagctgttccctcctcctggactgttcttccctcagattttatcttttggttgggtccctcacttcaagtgtttacacaaatttgaccttgttagtgagacctccttgaccaccctatttaataatactgcaaaccaatctgtccaacctgcttactctgcccaccccccatcttctaatagtactgtactttgtgcttacctaggctgtccctcttgtagctccttgtaatttcagactttagaacaggtatgaatgaaaacgttctgagaactttctctgcttgtgggtggaggaaggagtgcacagtgaaattgttcttccgattgcgtcttccttacgtcagccatgacacttgtagtcactgctgctaccacttaccaaggaactcagactccaggctgccactaccttgcaggacaatattagctgatgcttgaccatgtctatgtaattttgtacacaagacaaaaaaggggcaaaaagttactagctcctccccttagccaacattttgactttggacaaataagttcacctttctgtttctcattttctttataaactgaggctaataaatcataggtttgctgtagggatgaaataagaaaacatataaagcacttagcatagcacctggcatgttgtaagcattaaatgagtggcagccattattattattttctagcttttatggatgtattttacacatggcacaaaattgtactttcatttatctcattttgacagtatacctcttcttctgacctacaggtacctaaatttaaagaacagtttttcctaccctttcattgttgctagcctttcaagagtctcctactttttttgtgctttctcaattcctgtatgatgtttctaaactacaataaattaaagctagtatttcttctctattggaaggccagctggttaaagacaacatcaaaatatctatacctaaatctgtatgaaattttgaaagacatgatgtatagtcaacttacaatgggcttcattatacttgcttaaaattatatttttatttgatttatattttcaatgtttttttcttaagataaatgcaaaccaacttccattctcaaagcaaataaaataaatgtcagtattcctaggatctcctgaagagcttggaatgatatgatgtatgctgtcccccatctgtatggatgaagccagttcaggaaaacaaaaacaaaatatctatttaattacatttggtgttaatcttttcacaagcagtcctgcattttcatggaattaaaaaacattctgatgagagctttggtaataaaacattctgatgagtgctttggtaatttgctgtatgtgtttattttcacatctatgctagctattgatcacaatttccaagccatttagagggagaaatgccctcaggccgctcttctgtgtggcctactgcagacagccaaattaccccactgacaggccccttcctgcacccacccccacccacccaataccttattcttcacacagaatgcgacaagggccaaaggagagggggactggaacataggagtgtgactagtacatagtagtagctcgataactgttgttgaattaatgaattaacaaatgaacaaattatgtttctagtacactatgactgctagtaaggtcagagctcaatttgctattccattgcatcagctaggatagtgtctgatataccttatctctattcctacttgtttttgaatttttattatcctgcttatggatgctttaatatcataagctccttcccatgtttggactgtgaaacttaagaaagatgtttcaagttcttggtacacaagaaaggagagctcctctcgggaccataggccagttccaaatgcgccttcttctaatcatagcccacagaacttacttctctttcccttcttgggtaggagcactggaaaggacatcttcaatcactatggatgttgacttattctgacagtgcagagcagtgtgccgtaaaatctggggcagacatttcccccaacttccaatatagaagagaaaaaattactaagaaaatcctggccaggaatggtggctcacacctgtaatcacagcactttggaaggctgaggtgggcagatcgcttgagcccaggagttcaagaccagcctgggcaacatgatgaaaccccgtctctacaaaaaaatgtaaaacttagccaggcatggtagtgcatgcctgtagtttcagctatttgggagtctgaggtgggagaatcacctgggttcgggaggtggagtttgcaatgagttgagattgcgccactacactctagcctgggtgacagagcgagaccctgtctcaaaaaaaaaaaaaaaagaaaatccttcagtgcttagagaaatcagagggtgaatggttatatagaagccagcaggaaaagcatcattagaggaggtgaagaatctgaattaattgtccggggctaggacctatatccaagaagggcaaatgtgtttaggagtaacataaaacttaatgtttatgccagatgatgtaggaaaaataacttctgccagaccttggtgactgactagatagagaggctgataaagaggtgagcctattgaatgaagcatttttagtatggcatgatataggtggcccagagtgtctcgagtttgcccaagctttttcctctctaagaactaaccaagcctagtgcttctttgctctgagagcaggcggacattggtttatggtggctagtttgtactaggtagaaaggcaaaagagggaatgctacatggattaatcaaggatgtccaattctaaaacaaaggatgctgagatgacaagaaaggccaaggaagaactattgagattgtaaatgccctgagagcagggaccttttctgtcttgttcactgctctgtttccagctcctagactagggcctgacacatggcagatagagtaagtaagtttgaatgactacattaataggagaaacttttgaaagataaaatgcaaggtcaattatatgcaacggttgttgctatagcaatgatattcgtgcctagattcttccccatatccttcctgaatattttaagataagtatatataaaaggaatatgatggatactcataaatcataggatatggctgctatgacttatgggatgggacagatgagaacttggtatatttacgagaaagggaactgcatagcctctgagaagttgggtagtcctgtgtagaccactcacttatttctaccaggccaagaggcaaataaagctgacctgatatacttttgtgtcttaatctctatgttttaactctaaggggtgggagaagccagtggctagggaaagacagaggttttaggattaacatcacaatattagctacagagattttacctagaagtaactggagcctcatttgtgttttgaatttccataagggagggtttgatatactgccagatcagtactggctttggtgtctgaaagctttttgggagagtggctctggtcactagtagaggcttttcagtgggactgggaggagttaggtagaactttggatttgggtataaagggacttgtaaaactcagtcaaaatgcttacaatctggcaaaggtagctcttcaggctctggtaagggatatctataatctctgtggaatatcttagaacacatgggattaggggagttacatgatcaatggaataggcaattcattcacctgtcagtcacagagatcttacttctagggaaaatctgaaattggaggacttactctgttacatgaatcaaagatatgaccttgaaaaatgggagtaaccatggcaccagtgagtgagtcagtgatttgggaggggaaactggtttgggaagaaggattatcatttcggttttagaaattctgagtttaaagctacagcacatgttgaaatttgtagtagacagctgggaggaactaatggaagcttaggtgagaagacaagttaggggttgttagctctgtcttcttctttgtccaactcctctgagaaagcagaaagtaaagatgccagctttagtctgtggctacttagtttttaggccctttacctatttttagtctaagacattgctgggatacatcaaatggggagagcacaagcagttgcatctatttatgagaaagaacaagtctaaagaatgagagtcacggagaagcaattttctttgcattttatttttatttttattttttgagaacttctcattattaccaagcttctgtcaggaaatatgtactagaagccaaacaaaattatttcattgcttacggtgaaatgtaccaggggtgctgatgggcaaaaaagagcgcctcatatgaaacaccaaatgttccagtaatcctgttccaaaccatgcccgtttacttaaaatttctttcacagttcacgttagactcatgcagtaaataaattaagtacctttcccactgcgagttttttagaaacacttaatgaagtaaatgccacagtgttaggccagggggaagccatgcagttaaattatttttagcatgcattttctagtttaatttttgttggtttcttttgatctgggcttgagtcttagccagatagtgtgattcaggggacagaggacatggatgaaagagaggtttgtctttactgcctagtgaatataactaagggaagcttcttttttttcccaaatgttaaaaaattttgtccctctctaaatatatttaggattgcctctctaaatatcaaaataattctatttgggatagctataaagagatatactattaactcattacccttgaatatttagaaaagctctgtatgtttaattttaattatatggcctttcaataaaagtattatatatgctatttttaaaatacttaaaaacataagattattttaaatatagtttaatctttctaattaaggatgtttcttgagattttttttttttttttttttgagacggagtctcactctgtcacccaggttggagtacaatggcacaatctcagctcattgcaacacccgcctcctggtttcaagcgattctcctgcctcagcctcccgagtagcagggattacaggcatgtgccaccacgcccagctaatttttgtacttttagtggagatggggtttcaccatgttggtcaggctggattcaaactcctgacctcaaatgatccacctgtctcagcctcccaaagtgctgggattacaggcatgagccaccctgcccggccttgtggttttgaagagcttgaatcatcattttgagaattaaatgattattatattataaatgtgcataagtgtttgttaatgaaatttctgattaatatttccttttaaaaaaacaggaactataaccacattcttttaatagctaaaagcatttgttaaagtgaccaaaaataattgtttcaaaaatttttttttgaatgaagacaacgcaaaaatgtatcagagaagatacactgtgtctggaaacaatctgtgtctagaaagaagtcttcaattttgattaatatgttttatgagcaacttaagaattaatgcaatatgttaggtaaaatacagcaataatttttcattgctaaattgttcagcagactctcctaattttcaaggggtgtgctgttgtgagtatgggattttattctgaaggaacaaaaaccaaagtcaaaaagatggtttcctttttgcacagaactctctaatacctctgtcactatctcaacagggagtggtgcttcttattttaacttgaagagtatagtgaggactgtccagcctttctgcaatctccaagtaatcagaaagtattgaaaggtgtaataggaacaaagtggaaaacggcagtatcctcaagttacaggccaaattggtaaccctaagagaaagattttgacagccataaatatttcatctctcaaggccctgatgctactgtgtgagagcaatttagttagaaagatcatcaacaattagttgacatctctatcacacctattactgagttgaaatttcactgacatgaataataaggggtcttgtttgacatttagcagtttaattaatttgtttcctaaagtgaatgatgttttacactgtgatttttcaataccccgtctccatacacttgaatttttttattttgcttttcttggggaaaccagttaattttccttttcacttaacaaactacctacccatcttggctctggtgccagccagtgttttgtggggcttagggggcggggatagtgtggggaaattgaggaagtgctgcagatcatcctctactattcaattttggaggagagataatgtaggagtatggaaaaggaaaacaaaaacacttttttttttcaagaaaatttagtactttttggcattattgttagacaaaaatacaagtcttgtctctctggttattctagtcatcgagaatcaacaaggaaggggccgttatgggtagtcattgcctgccatgtggcataactatttgcattattctttatatattactggctttattggtttctgtacaccttcaagatatgttgtatattaatgtgatttctgtaatgctatttttgaaaataaaaaacataatgtttgctaaaggtcacttctaaaacagctgatgtgaaagtaggaggaataatccaatgtaacaatagaacacatgaatctactgtatattcttacagataaaaatagacttttgaaaaattagtcaactcaattaaattatttactctaattacctctatacaaacccctaaatacctaccttaagctgcttccctttgcagagttttttaaaaaccgaagatatgtggaaaagctatttctctcccactctaaactgtaggtcatgaaggtaaatgatattctgtattcgccagagtgcaagtgtccttaactacctgatgatgatgtatatttctgatggatggggcttagctaggtagacgtacccagatgaaatcaagtgagtgcatattcatgacacatgtgagtgggaagaatgtcttagaacatgtcatgctgaagagacaatgctgaagtgttgaaggttgaatgttaaaaggggaagataggctccagcttttggaggaaaggcagtccagtatatacctaccataatgatacttctttccgtgttgtcggttcttattttataatggtgtctaaaaaataaacaggtaccactactttactaacctgcttttagaccaaatgtaatgaaagtgatacggaactgatttttaactattgaacctctaggatagatgaactcttaatgctatcacaaaccaccatgagatacttcagcataatagagtgctagcaaagttgaaattgctgctattgtgtatctcagacttgttaaagctgttccagactcatggtgaaatagattgctttcttctactggtggacattgaactttttccctctatacatgtgtttataaacaaacagtgacataaacttttccattggaacatattttgaagcagagatatgtgtttgtagagagcattatatatatcatttaaatgtattttttttccaaaacaagtttccaggtcataattttgaacctgtataattttcattatgattttcctgtctgaactgaaaggccatgcaataagtgaaaatattttatgtttatttttgttaagtacctctccctctctgccttagtacgaggcatagcaaggaaggattaaggataatttcataaagataattaaacataagccttgagtgacttctttctatcagaaagacttcagaaaggaaagagttgaattagcatggtatgtttaaaaacgaaacaaaacaaaaaagtgtgacttaggacacaggagatgtacgttactaaaaagttttactatgtgccgggcactgtgcttcaaactcaacatgcactatttcatttggtcccaacaacccagtgaggtagttgtattatcttaattttgtacatggtggcatgatcatagctgagaattcctgggctcaagtgatccttctgcctcagcctcctgagtagctgggactacaggtgcacagcatcatttccagatagtttttaaattttagttgagatggccgggcgcggtggctcatgcctgtaatcccagcactttgggaggctgaggcgggcggatcacgaggtcaggagatcgaaaccatcctggctaacacggtgaaaccctgtctcaactaaaaatacaaaaaaaaaaaaaattagccaggcgtggtggtgggcacctgtggtcccagctattcgggaggctgaggcaggagaatggcgtgaacctgggaggcggagcttgcagtgagccaagatcacgccactgcactccagcctgggcgacagagcgagactctgtctcaaaaaataaatacataaataaatttattttagttgagatggggtctcgctatgttgcccagactatgttgcccagttctagactagtctagaactactaccctcgagggagatcctcttatctatctcagcctcccgatccgcctgccgtggactcccaagttgctaggattacaggagtgagccactgcatccagccctcaaagcattttaaattactatgcaatacttctactcatcaaccctctatcattaagtggttatatcatcatgagtgaattacttaggctttgagagaggtaatttctttccctattaagtgatggtcatggtacctgctcctcttatttcaaatgcaacatgatacaatggaaaaggcaatggacttagagtcagagaatatgaattcaaagactgactctattagttattagttgtattatcctgaattatgcacctaatctctctgatgtggtttggctttgtgtccccactcaaatctcaccttgaattgtaatccccataatccccaagtgtcaaggtagggacaggtggaggtaattggatcatgggggcagttcccccatgctattctcgtgataatgagtgagtcttatgagatctgatgggtttatacatgtctggcatttcccttgcttgcattcattctttctcctgccgctctgtgaagaggtggcttctgtcatgactgtaagtttcctgaggtttccccagccatgtggaactgtgagccaattaaacctcttttctttataaattacccagtcgtgggcatttcttcatagcagagtgagaacagactaatacactctgtaaacttggtatcttcagcatgtaccatgggaataatatcagcacaacctatctccacaaggttgatactgaagttgaaagtgacataatgtaggtgaatatggcttgtggtaaatggtatggatttacgtttattagatgctctgctcatggtaatactgttttcaacagcattttacaatttatctcttttattttgaatgactttatgttgtaggcactattatcccaatattttttttttaatagacagagtcttgctctgttgccaggctggagtgcagtggcacaatctccactcactgcaacctctgcctcccaggttcaagcgattcctgtgcctcagcttcccgagtagctgggactgcaggtgtgcaccaccacacctggccaatgttttgtattttttagtagagatggggtttcaccatgttggccaggatggtctcaatcccctgacctcgtgattcacccgccttggcctcccaaagtgctgggattacaggcctgagccatcacgcccgtctagtatcccaattttatagttgagaacactgaggcataacgaggttaggcaacttgcctagaattatgtagctaataagtggcagagccactcagtttgaatgtagtaatctccctgcagatcccatgctctcagccttccataaagacaggttataatgtcagctactgggctgactgagatgggagtatcccttgaactcaggaatttgaggctgcagaatttgagggttgtaccattgctctccagcctgggcaatagagcaagattctgtctctaaaaataaaaataaaaataaaataagatagaattgtggtaaaatacatgtaacataaaatttactaatgtaaccatttttaagtgtacagttcggtagtattattaagtacattcacagttatgcaacctctgttttctcttcttttctttctttctttttttttttttgacagactctcactctgtcaccaggctggagtgcagtggcacaatctcagctcactgcagcctgcccctcccaggttcaagcaattctcctgcctcagcctgccgagtagctgggactacaggcacatgccaccactcctggctaattttttgtatttttttagtagagatggggtttcactgtattagccgggatggtcttgatctcctgacctcgtgatatgctcgcctcggcctctcaaattgctgggattacaggcatgagccaccgagcccggcccctcttttcatttcatattctatctgtctctttctgtctaaactgatacaattcctttaaaaattttgtaggtttactgtgtatgttacaatctatcacattagacaaaagccacactcactaataagcacttctctctcttgggctccttgtaaacctgctgtggggcaatccccttaagatacttagaacccctattgttatcacaggaggtcttctacacatagccttaagatcttcagaagttcttttgtctgtctgaaagggtttataatgcattaccttaaatcattctggggtcattgagggttttacagccacactctgagatgctttcttgataggacctgggattttatttttaccttgaaggcatttcttaatttgagaagtatttcctgtctgaagagtctgggaatgagaaacaaatttagttttttaacgcagcaagtcctggatcctttacattacctctaaattttgtttgagaatggaatagttcattcttcagttcatctttctcctctgacattttattatggggagcaagaataagccaggtagcacttccagtgttccacctgcagaattccttagctagatcacaaatttattaagtacatttccttttttcatactaccaaatttcaagctgttacacaaggatcttctttctcctaagttccagtaacatctttgttacattttttatttatgcttcagtgttagcctctagagtactgttccaaaactaatgccatgtgttttagattttgttacaacagcaccaaacttttagtaatgaaatttgttctggttagctttgctgcattaaaaaaaaagcctaccaatattaattgtgtaaagtcacaactttttaactttgctcatagattctgtaggtcaagaatttgggatagtcacagcaggcatgtctcttctctgctacatgatgtcttgggcttctgctggggtcaaggggacccactttttttttttttttttggagacagagtctcactctgtcgcccagggtatagtgcaatggtgcaatcttggctcactgcaatctctgcctcccaggttcaagcaattctcctgactcagcctcctgagtagctgggattacaggtgcctgccaccacacccagctaattttttgcatttttttgtagagaaagagtttcaccatgttggccaggctggtcttgaactcctgaccgcaggtgatccacccacctcggcctcccaaagtgttggcattacaggcatgagtcaccacacctgtccaaggggacccacttataagatgatttctttgctcacatgtctggtaactgagctaggatgacctaaaggcttaactgggaccatagactatagagtacctgtatatgacctctatggggcttggacttcttgcatgattgtgctgggttcagagaagagcctccagagagcgagcatttttttttttttttttttttttttgagatggagtctcgccctgtcacccaggctggagtgcagtggcgtgatctcggctcactgcaacctttgcctccccggttcaagtgattctcctgcctcagcctcttgagtagctggaattacaggcatgcaccaccatgcccagctaattttgtatttttagtagagatggggtttcatcatgttggccaggctggtctcaaactcctgacctcaggtgatccgctcgcctcggcctcccaaagtgctgggattacaggcgtgagccaccgtgtcgaacacagagagcaagtattctaagaagatcaagtacaagttgtgtaaccttttctgacctagcctcagaagtcacagagcatcacttccactgaactctattggtcaaagcagtcacaagtctgcctagatttaagggatggggacatagaatataaaaaaattgggggctcatgttttaaaaccaccacaggggtggtaaaattcaaggataatacagtccatcttcgtagccagtaacattactccccaatccccccatcccataaccaggagttgcttttttccaggactaacgttggatgcttggagataattattttattaagaatgggaacatttctacccaaaggtgcattattattattgttttccattttgctaatggtcttctcctttttatttttcttctcttcttcctctttcttcttttttccttctcctcctcctttcttttttttcttcctcctcttctttcctttaccattcttcttccttcctcttccctcatcttcatcatcaagcagtgtacactggacatcccttagcatctgttttcatttagttttgcagttagctatgccttacttcatgctccagaaatactttttatatccctctgttagcctttatctcattctgttggaattatttgtgtatttacctgtatgtcacaataactgggactcctgatgggcaaaggccatgtcctgttcatcattaatccaccaggccttggcacagtacttggaatccagcaaatgtttttggaatggttaaatcattgaatggcttttttctgcctatcttctatgcaatagatattatgcctcctaagatcttttgtttttactttgagcagtttaagagcctctccataagtgcaaatttcataaaaaaaaaaaaaaaacttagcttgttaatcatcccttttgtattattttcattaaatattcatttaaagccttttattttatatgaggataagtgagattaagatagcacacgttagtagttatagtagtagtaatactggaaatttttcaggcatttatataaattttataggttagatgacacaaaatatatagtaaattagattattattttagaactgttcatgtttagcttgttgatgactgaaatccaacagtaactattataaaattgtcctaaaattactaaagagatattttttttttgagatggagtcttgctctattgcccaggctggagtgcagtggtgtgatctcagctcactgcaacctctgcctcccggattcaagcaattctcctgcctcagcctccgagtagctgggactacaggtgcttgccaccatacccagataattttttgtatttttagtagagacagagtttcaccatattagccaggatggtctcgatctcctgacctcgtgatccaccctcctcggcctcccaaagtgctgggattacaggcgtgagccaccatgctgggctgagatattcttttcttttgaaaatattactatacattttcacagaataaattttaattgtttctagttttttgagtataagctggtttataccatcgtatgtcatgcagttcttttcatcatcttattaggtgggaattagtgtacttattttatagatgagaaactgaggctggaagagggtaattcatttgtatgaggtcaacagctaataagtagctgagctaagattcaaatctggatctatcagacccaaaagcctcttaagcaatatgcctctttcccaagaattcttttcttttcttttcttttattattattatactttaagttttagggtacatgtgcacaatgtgcaggttagttacatatgtatacatgtgccatgctggtgtgctgcacccattaactcgtcatttagcattaggtatatctcctaatgctatccctcccctctctggattaagaaaatgtggcacatatacaccatggaatactaggcagccataaaaaatgatgagttcatgtcctttgtagggacatggatgaaattggaaatcatcattctcaggaaactatcacaaggacaaaaaacctctttcccaagatttcttaagcaatatgcctctttcccaagatttcaaagtgaaattttgtcccaataaattgaacataatctgaataattttatgaaattaatattgtctgcctagaaaatgtataatgctaagagcattcactagtaatttcctatttttatacatgtagatataaaatttctattagggttctacagagaaatagaaccagtagagtatatatagatggatatacagagagagatttattatgaagacttggctcaggcagttatgcaggcagagaaggcacaatcgattgtctgcaagctggaggcccagaaaagctggtcatatagttccagtccaggccctagggaccaagaaccaggtggccagcagtgcaagtctgtaagtcctggtctgagtccgaaggtccaagaactgggagtcctgtttgagggcaagaggacggatgccccagctcaggtagagagagagcaaattcacccatcctttgtcttttccctctgtttgggccctcaactgattggatgatgcccacctacactggcaagggcgattttttttacagtctactgattcaaatgctaaccttttctggagggttcccaggcacaccccaaaatagtattttatcagctatctgggaatcccttagtttatgcataaaattaactattacaaaagcccccaaatattttcttttttataaggacttcagtaagatatagttcatacacataccatacaattaatccctttagggtgtataatttagtggtttttagtatgttcctaaggttgtgcaaccagttttaaaacaattttacaaccaattatagagcattttcatcacccaaaaagaaaccctatacccattagcagtcactgcccatttcctccagcccccttattccttgacaaccacccccagttttttttttttttttctttctaagacagggtcttgctctgtcacccaagctggagtgcagtggtatgatcacagctgactgcagccttgacctcccaggctccagtgatcctcccatctcagcctccctagtagtagctgggactacaggtgaacgccaccatatctggcaatatatatatgttatatatattatatatatataatatacatatattattatatattatacatatatacatatataatacatatatacatatataatatatatacgtatatacatacatataatatataatatatatgtatatacgtatatatattatatatatatatatatttttttttttggtagagatgaggtctctctctgttgcccaggctggtcttgaactcctgggctcaagacatccagctttggcttcccagtgggattatagacacaagctaccactcttgtttaatgtcaaatctttaatatcctacaatattttaaagatttactcactgagacaataatagagctttaagaagcagcagtgttctgattttgtgcaacatgttcatgagtgttttacagttcctttttttctttttaaaatacttcattttttagaacagtgttaggttcacaggaaaattaaacacaaagtacagagcatcctcatgaccccctcctcccacatgtgtacagcccccccccccattatcaatatactcaatgtttgttacatttgttacaattgatgaacctaccttgacacattatcacccaaagtctatagtttacattagggattactcttcctcttttgacattctgagttttgacaaatgtataaatgacatgtatttgccatgactgtatcatagagaatagtttcagtgtcctaaaaatcttctgtgcttcacctattcgttccttgtagttcttttaaaaactacagaattacagaaattcgtcgtgggaaggtattgagagattatttggtgcagcaaaccagttgggaaggatgtagtcaaaattcccagtctcttcagctgaatttgtccctttctttcttttgttgattgtcataaatataagcattttttttctttttttgtagtttcccctttcttaccacaaagggtcatttcctaacttagaatgagccaggcaacaaattttagaatttaacaagaaaacagttatttccttagttcttgttttatgaaaaataagttatttatattagaaaaatttaaaaatatacaaatagtagagagcacaaaaatagttatccattccccagttaccaacacttggccaatctcttttcatttgtccttccactcattgccacccccttaactgcattatttcaaaatgatttatagatatatcattttatttgtatgtattttaaaagatacactttaagagaaaaaaattatcacaaccattatactgtaatactgctaattccttaataccaccagattggtaatcattatttaaattcccccaataattcataactttttctttattgtcagtttgtttgaatcacatccaaacagtatccacacattgcatttgtctctttcaatctatagcttccctcccttgtttgcttcttctcccttgcttcttctttgttgaagaaactggactattcatcttgtttcttgcacacaggatttgcttattgcatctctgtggtatttaatgcatttttctcctgtgaactggcaggttacttaagaagtttgatctgattccagggtgtttttttgttctgttttgttttggtaagaatacttcattgatggtacactgcattttaatttctactaagtttctgtttgtctattttatgatgttagtggccattatttcgttaggggtttgcaaagtggtgatattctaatgtgtttatctttcttcatttattagttggactatttctataaagagaaacttatcaataacctgaggtatagtttgtatagaaaaggcagattaaatgcttgatttctttccctttaaccgctagttttcagaataatgaattggttcactagcatcctccaaaggagaccaatcaggttttgtttggtttgtttctttaatatcattatgaactcctagattttttaacctatttcatgtgtttcaatcaaatacagttattattctactgatactcaaacttgaaaatcaccataaaatttaaaaattgtatcacttaaaggtggttttattataaattatttccccctagaatttatgaaaatgaaaagcttccctgtgtagttacacatgaatgttcaggagtatacctaccatgtaaagtgggttgaactttcacaggggtttatttatgcatatacactgaaataaatgtgttagtgtggttatctaagacagtctatgatactctaaggaatgaatacatgttcacctttatacaagaaatctggagtcatgtactttgggctagggttgcttctgaggtggcagccattctgcagcagcccttctgtaccttaaaaaccagcacagtctccttggaacacattcttcagctctgaccacaggagaccagctgggctaacactcagtgatttgtcagatttacctgcattttcatagtatttctatcaaagaaatttgtcctaagtgtcaaattgctgatttttccagtaactaaaaggtttcatgtggacttctgttgttatttacatgtatatggagaaaattgcaatctgtgagtaatttgagaaatttcaacactttcagcagtagtgatctagaaattaaatgggtttcaaatacaatgttccagtgcagtgccgcatatataatgtatgtgcagcatatgctgaggtctttttcaaaacatttacattaaacctgtcaggtatttatgaatagcaaaaattaatttcccctagttctgtcatcagttagagaaatggatttcagcatggaagactgtcaatatttcctgcatactagaacagctcacttcaatgtcatagtattacaccaggtggccttctaagagtcagcttaatgtgatttcaaatgatagggtagtgaatgtgagggaaattaaaatagtatcatacttatgatttaaaagcaagttaattacaagggcttgttaataaacaaagaaaaattctgaatgtattatctgttatatagcatatcaataacaagtgtgatgctttgaaaacaaaaaactctaccactatgtgactttgagatgacttaaaaatatttaattaaattgttgacaaatgtgttaatctactaatggccttatagcatttgaaagaatttttagatattcatttagctcttaaggcacttctaaaagcattgtttaactgaaaagattagctacattgttggcattttatctagaaaatcactgatgtgtttgctgtgaatgatcctaacagcactgtactttgtcaatgttcagtcaatgcatttttcccaatcgggtacttttaaggttcttatagggccaaagcatgtgcaatatcactattactaaaatgagagacattttatttgatgaattatttagtattttttgatggttttgggtgatgtgcctccaccctgcccctatcttatatattagggggaggaaaagggaggatatctgatgcattttaagaaattattaacgttctgatttttaaaaatattgtgaaattttaattttagaaggtattaaaaatgtccactatttatgaacctgtgaaaatttcataatatttttaaatctagaggtttagaaacaattattattaataatttcatagtgtggtagccttagaaggaacaagatatgatgacaaagatcttccccattgtgcatatgaacttgctgggagtctgatatatatatacatatatgtattaataattaatatgaggaacacaggctgattttttaaatatatggcttatgaaaatctcattttctagtcacaagacaaactgaggataattcttcccttcctggattatactgttatgtagttaataaacctattcttttaaagattatttcaaggaattttaatagtttttgttctgcgcggtttttaagattaaaaattaagcccaattcttaagaggttgccttttaaataatgggtctaatacaccagggtcacatagagttcaaatcctggaaatatatggctctacttacacaacgttttatgtggtttttcttttaaaaattgtcctctttaatatactgtggaataatgtgagtctgtacaatcccattttaaggacttctttgtaaaatccagctgttttaaggttctttaaatatcctggctgacaaccacaactgacactgctgtgctgatgtggatataagaaatttcatttgaatgagaaggacagctgacattatattcatagttttatcagcggccatagggttattagtcatgggagccaatactttgttctggtcatgtatcccttttttcatagggctttccactttatgattattgtttgttaacattttatcttttaagtaaataaacagtgatactgcaaatctctgtggtacaaatctgcatctgttttacttgaggattgtctatgttattgcaattttgataaacctttgaatctcatgatattacacttgtatttccttggttatatacagattccttttaagaaaactaaggcaaatattttaaaatacatttaaaaagaacataatttttgcatgttttgtcttatcacagttttaaagtgctataattctgaggcttcttctagaggaggttaagcattacaaaataaaaggcaggaaaggacaattttaggaactgtgcaactaagttaaaacaaatattatatcctagtaattgaggattaggactcttgattccattccttgtagtgctctcctatagacctctgtacagaatgtgtatatgtaggtatgtacatgtattttctgaatacggctacttgctggtatagtgtcattttaatcaacattttaatctagtcgttattaaaatgctacttacaatgtagagagaggctggctatttgcttttaaagtgtcaacaaaaatgctggaacagtcacatgtttttgttgatcaaagaatgtacaaatgtctaggagatcacaatcactattaccatatatggattatgttgacaaaatacctgggtgtgtgaattcaaaagggaataaatctgatgatctgttaatttgcaaacagaaaattattataagaactgtgcagctggagtgaattcaaaagttaaggaaagtttgaatatctgcttgcatgctatagcacttgaaatacatttagacctgtgtcacagacattgagttcctactatagtcagcttctgtatttggtgtattagatgagtatgacaatttgcctcccctcaaacagcttaaaccatactggggaaaaatggcatggaaataaacagtgacaatgcataatagctgtaataggatgcatactttccaatgggaaagcaaaagggggcaaatttatttttatgtggaagccagaaaagacttcaccagtaaggcacatttgtaagggaggcacaaaatggaaataatgaagctgaaaaaatttatgaggacttcataagatcatgttaaacaattttacttttatcatgaaggtaactgtatgccattaaagtttttttttttttttgagacagagtctcgctgtcacccaggctggagtacagtggtgtgatcacagctcactgcaacctccgtctcccaggttcaagcgattctcctgcctcagcctcctgagtagctgggattacaggcatgcaccaccacacccggctaatttttgtattttttagtagagacggggtttcgtcatgttggccaggctggcctcgaactcctgacttcaggtgattcacccacttccacctcccaaagtgctgggattacaggcatgagccaccgctcctgacctaaagatttttaaacggagtaatagatcacatatctgtgttagaaatacaactttaagatggcagataactgcatcttttttctgaggggcaaatccagtaatctcattaaaaaataattaataacagatttttttttttttgagacagagtttctcttttgtcgcccaggctggagtgcaatggtgtgatcttggctcactgcaacctctgcctccttggttcaagcaattctcctgcctcagcctcctaagtagctgggattacaggtgcccaccaccacacccagctgatttttgtatttttagtagagacagggtttcaccatgttggccaggctggtcttgaactcctgacctcaaatgatccatctgccttggcctcccaaagtgttgggattacaggcatgagccactccatccagccaagaatattatatctggcaaaattattcttcataaatgaaggagaaataaattctttcccaggcatgcaaaagctgacagaattcattaccactaggccctagaagaaatacttaagggtgtcctaaacctggaagtgaaaggttatctaccattgtgaaaacatgtggaagtataaagctcactggtaaagcaaacacacaaatgaggaagaggaaggactcaaatgttaccgctaaagaaaaacactaaaccacaatgataaacaataagagatgaagaaaggaacaaagaatatataaaacattcagaacacaattaacagtataacaggagcatatcaataataccctcaaatgtaagtggattaaattttccacttaaaacatagaggctggctgaatgaattacaaaacattacctaactatatgctgcctacaagaaactcacttcacctgtaaagacatgtatagactgtaagtaaagggatggaaaaatatattccatgcaaacagaaaccaaaagcaagcaagaatagctatacttacataaaacagactttaagtcaaaacagtaaaaagacacaaagaaaagttatataatgacaaaggaatcacttcagcaagaggatataacaattcttaatatatatgcacccaacactggagcacccagattataaagcagatattactagacctaaataaagagatagacttcctatacaataatagttgggaattcagtattccactcatcgtctaatgcaactagcattagacagatcatccaaacagaaaatcaacaacgagacattgggtttaaactggactttataccaaatgggctttatagacatttatacaacattttacccaacagctccagagtgcacattcttctcatcattatattgaacattctgcaggatagaacatatgttaggccagaaaacaaatctcaataaatttttaagaatagcaatcctatcagtatcttctcagatcacaattaaactagaaatcaatagaaatcaacaataatttgaaaactatacaaatatatggaaattaaacaacgtgctcctgaatgaccattgactaaatgaagaaattaacatgaaaatcaaaaaatatcttaaatgaaaatggaaacacaacataacaaaatcctcaggatacagcaaaagcagtgctaagagaagtttatagcattcaatgcctacatcaaaaaagtagaaagatttcaaataaataatctagcaatgcacctcaaggaacttgaaaagcaagaacaaaccgaacctaaaattactaaaaggaaagaaacaataaagatcaaatcagaactaaagaatatagagattatcaaagaaaacaataaaaaggatcagtgaaatgaaaagttggcttttttaacatataaagttgataaatggctataaccaaaaattgctataaccaaaggggagagggggagagagagagagagagagacccaaataaaatcagaaatgagaaaggagatattacaactgataccacagaaatacaaaagatatcagaggctattatgaacaactgtattcgaacaaactttaaaaccttaaggaaatgcataaattctggggcatacaacctaccaagattgaatcaggaagaaatagaaaacctgaatagaccaataacaagtaatgagattgaatcagtaataaaaagtctcccaacaaagaaaagcccaggattaatggcttcactgcctaattctaccaaatgtataaagaaggactcactcctcaaaccattccaaaaaatgcaagaggagggaatactccccgacttgttctatgaggccagcattaccctgataacaaaaccagtcaagaacaaaacaacagcaacaaaaactacaggccaatatttctgatgaacataggtgcaaaggttctcaacaaaattctaacaaactgaattctacagcacatcaaaatgataatacaccatgatcaagtgggatttaaaacagggatgcaaagattgctcaatatatgcaaatcaacaaacgtgattcatcacaccaacagaatgaaggacaaaaatcatatgaccatttcaataggcacagaaaaagcattagataaaattcagcacccattcataataaaaactctcagcaaacttgctctagaagcaacatacatcaacataataaaggccatatatgacaagcccatgtaacatcatactgagtgggggcaaagctgaaatcctttcctgtaagaactagaataagacaaggttgcctactttcaccactcctattcaacataggaacaatcaggcaagaggaagaattaaaagcatccagattggaaaagagaaagttacattgttctttgcagacaaaaataattttatatttagaaaaaccaaaagactccaccaaaaaactcattaaactgttaaattcagtaaagttgcaggatacaaaatcaacatacaaaatcagtagcatttctatacaccaataatgaactagctgaaagagaaatcaaataagtaatctcatttgcaatagctgcaaagaaaatatctagacataaatttaacaaaggaagtgaaagacctgtattagaaaaagtataaagtactgatgaaagaaattgaacagaacacaaacaaatggaaagatattccatgtttgtgggtcagaagaattaatattgttaaaatgaccatactacccaaagaaatctgtagattcaatgcagtccctattaaaataccaactttttttttttttttaaggtggagtctcactctgttgccccggctggagtgcagtggtgtgatcttggctcattgcaacttctgcctcctgggttccagtgattctcctacctcagcctcccaagtagctgggattataggtgcccgccaccgtgcccagctaattttttttgtatttttagtagagatggggtttcaccatgttggccaggctggtttcatactcctgacctcaagtgatccacccgcctcagcctcccaaagtgctaggattacaggtgtgagccactacacctggcctccaacgttatttttcgtagaaatagaaaaaataatccccaaatttgtatggaaccaaaaaagagcctgaataggcaaaccaatcctgagcaaaaagaacaaagctggaggcatcatactacctgactttaaagtatattacaaggatatagtaacccaaacagcatggtatcagtataaaaattgacgtatagaccaatggaacagaatagagaacccagaagtaaatgcacatatttacagccaactgatttttgacaaaggcaacaagaatatacattagtaggacagtctcctcaataaatggtactgggaaagctggatatttatatgcagaagaatgaaactggacccatatctctctccacgtaccaaaaagccaactccagatggattaaggacttaaatatcagatcccaaactatggaactattagatgaaaacataggggaaacagtttaggacactggtctaggcaaagattttatagttaagacctccaaagcatagacaacaaaaacaaaaatgtacaaatgggacaatattaaactaaaaagcctctgcacagcaaaggaaacaatcaacagaataaaggcataaccttctgaataggagaaaatatttgcaaactatttatctgacaagggactaatatccagaatatacaaggaattcaaacaactcaacagtaaaacaaacaaacaaacagttccattaaaaagtgagaagggacatgaatatacatttatcagtagaagacatacaaatggccagtaggtatatgaacaaatgtttcacatgactaatcatcagggaaatgcaaatgaaaaccacaatgagatattgttgtatcttacgtcagttagaatggctgttattaaaaagacaaaaaataacagatgctggtgaggatggagagaaaagggaactcttttttttttctttctttctttctgagacaggatctcatttctgtcactcaggctgagtgcaatggtgcaattatggctcactgcagcctcgaccccagggctcaagtgatcctcccacctcagcctcccaagtagctggtactacgggcatgtgccaacacggtcagctaattttttatattttgtagaaacagagtcttgcaatgttgtcctggctgttcttgaactactggactccagtgattctcctgccttggtctcccaaagtgttgggatcacaggcgtgaaccactgtgctgtgtaaattagtacaacctctatggaaaacagtatggaggttccttaaagaactaaaagtagatctaccattcaatccagcagtcccactactgggtatctacccaacggaaaagaaatcatatgaaaaaggcacatgcacacatgtgtttatagcagcacagttccaaattgcaaagatatggaaccaatctaagtgcccaccaatcaatgagcagataaagaaaatgtggccgggcgtggtcgctcacacctgtaatcccagcactttgggagaccgaggcgggtggatcacgaggtcaggtgttcaagaccaccctggccaagatggtgaaaccctgtctctactaaaaatacaaaaatttagccaggtgtggttgtgggcacctgtaatcccagctactcgggaagctgaggcagagaattgcttgaacccgggaggtggaggttgcagtgagccaagattgtgccactgcactccagcctgggcgacagagcgagacgccatctcaaaaacaaaaaaaaaaaagaaaagaaaagaaaaaagaaaatgtagtatatatacaccatggcatactactcagccataaaaaggaatgaaataatgttttttgcagcaacttggattgagttggaggccattttttaagtgaactaactcaggaatggaaaaccaaatatggtttattctcacttataagtgggaactaaactatgagaatgcaaagatacagagtgatataatggacttcagggactcaggaggagaggttggggtgggggtgatagataaaagactgcatattggccacaatatatactgctagggtgatgggtgtgctaaaatctcagagttcaccactgtggaattcaaccatgtaaccaaaaaccacttgtacccccaaagctattcaaataatcatttaaaaaaagttttttagcttcaaacccaaggaaaagttgcataccatttacttacacttgtatgccctttataataataccaattattacatctgtcccatttattatataccaaataattggtataccaattatttgcatctacacttttctttctctctctttctgtgtgtgtgtctgtgtgtgtgtgtgtgtgtgtgtgtgtgtgtgtgtgtgtgtgtgtatgtatataatacttctcggctaggcgcagtggctcacgcctgtaatcctagcactttgggaggccgaggtgggtggattgcctgagctcaggagttcgaaaccagcctgggcaacatagtgaaaccccatctctactgaaaatacaaaaacttagcctggcatggtggcggatgcctgtaatcccagctactcaggaggctgaggccagagaatcacttgaacccaggaggtggagtttgcagtgagccaagattgtgccactgtactccagaagtctcaaaaaaaaaaaaaaaaaacccaaaaaacttctctatatctctttatatcttttaaatctattttaatctgtctatattgtttttctgaaccatttgcaagtaagttgcagacatgatatccctttacttaaaagtatttcagtgtgaattttctaagaacaagaatttcctcttatgtaaccacagtacaattatcaaaatcaggaaatttgatgttggtgcaaaactgtgatctaatccttaaaccatattcagatttcatcaattgcctcaatgatagtctttatagctatttttcttatgctagtgtccagttcacaatcatgcctttcctttgcttgttgtgtctatttactctcttttaactttgaacagttcctcagcctttctttggtctcttttgccattgacagttttgaggaggccagttattttgttgaatgtccttcattctgggtttgtcttctgttttctcatgaccatatgcgggttaggcacttttggcaagcatattaccagaaatgatgatgcactttattggcatgtcatatcagggaatgacattgatgtgtctcattattggtgatcttgactgtgatcaattggtgatgacaaaggtgatggcttccaggttttccagtgtaaagttactgtttttctttttataactaataagcaatcatgaggcgatactttgaaactattgaaacatattgttcctcattaaactttcagttttagcatacattgacaaataatcatgcccaaatcaattattaatataattgttgccaaattgtcccttctacattcattaattggcattctgttataaggagaggcttcccattttccctctcttatatatgtatatacatatatatatatgtacatatgttttagtatggattaattgattcctgtgttattcagtggattaaaatctttgctttcattatttattttgatgttcaaattgtcccagattttgtctgtgagaaccccttcaagctggtccctttgtccttttatcttaccattctttgtgtactttttaactttctaatacaacagtgtgttccaggatcatcttgtactttctctgacatagccatggaaccagtgagtcctccagggaacattgattctttttagtggaaagtgttatttaaaaactcagatacgaggccaggccagtggctcatgcctgtaatcccagcactttgggaggccgaggtgtgcggatcccttgagttcaggcgttcaagaccagcctgggcaacatggcaaaacctcatctctaaacaaaacacaaaaattagccggacatggtggtacatgcctgtagtcccagctacttgggaggctgaggtgggaggaacgctggaccctggaagggcaaggctgcagtgagctgtcattgtgccactgcactccagcctgggcaacacagcaagaccctatctcaaaaaagaaactcagatatgggttctagatatactcattgttactgagatgtaattgcttttaggcccccagaggggacaaagctaaaaaaatttatatttatatatgtggatctgtgatccatttgaagtttattcttatgcatgatgtaagatatgtgtctaattacattttttccaaatggctcagcaattatcctagcatcatttaccaaaaagttcatctttgtctcaatgatttgacatgtcattttattatatactaatttctatatgtacatgggtatatttctgtaccttttgttctattctattggtcagtctatttgtgtgccagtatcacaatgttttagttatagaagcttaatgttttaatgacagtatggctagtcccatctcataggttttcattatcagtattttcctgactaaacttgcatgttgttgtttcatatgaactttagtaccaacttagttccattttaaaaaaagtgatatttttattgagattgcattgaatttataaattagcttagagagaatagacatctttatgctgttgagtcattctgtcttatagtaggagatgtctttccatttgttcaagtctactcttggggctttcagaagtctttaaaaattttcctcacttaggttttgccatttctttttatgtttatctatattttattatctttgttgctattaaaaggaagttttccggttattatgtatgtacagtatttgaaggctatcagtttctgaatataattttatatcctgctacctcactgaatttttactgttgaaggatacatatatatatgcctgggtaacatggtgaaatcccatcttgacaaaaaatacaaaaattagctgcgcatagtggtgcatccttgtagtcccagctgcttgggaggctgaggtaagaggatcactgggtcccaggaggttgaggctgcagtgagccatgagtgtgccactgaacaccagcttgggtggcagagtgaaactctgtctcaaaaaaaaaaaaaaaaggatacatatatatttttactaagactattacttcagaaaagctgtaaaaacagccatatcggccgggcacgatggctcacgcctataatctcagcatttgggaggctgaggcaggcagatcacctgcagtcaggagtttgagaccaacttgaccaacatggagaaaccctgtctctactaaaaatacaaattaaaccgggcatggtggcacgcgcctgtaaatcccagctacttgggaggctgaggcaggagaatcgcttgaaaccgggaggcggaggttgcggtgagccgagatcgtgccattgcactccagcctgggcaacaagagtgaaactctgtctcaaaaaaaaaaaaaaaaggccatatctttgtctctaacagtatagtcagctcaaatctaagtcttcccctgtgaacataaattattttcagatactgtttggtgcttaaggaggcacataatttctttcaagtcatttggagtttatgcagcaagcatagagttgtcattgtacaaataaatgttttccatatagggcccccaaaaatcaactggaaaattctcaaaccagtacttactgagatatttccatgcataaacactgctaggcatttgggtgttgcaacaaaaaaaatagaagatgctgacagcaaagacctccactcaagttgcttagagtctaactcaggaggtaagacacatacacatacacacacacacacacacacacacacacacacacacacacactctctctctctctctctctttctctctccatatatgtatatatttctatacatgtgtaaagaaacttggctggcaattcaaggcattatatagaaagatctaaatgagttagttgcaagataagaagaggtcagagaaagaaggaagagggagaggggaggtttcctggaagaggcagaaccactgtcaggcctagaagcagggacagtattccgagaaactggggtctcaggatagcagttatggggtacttaagacagagaccagataaaagatcatcccagaatggcttcatctggtgagctgtgtgtgggagataaaactggaaacctagactaatttaggtcagatggcgggagatcctgggtgtcaggttagagagcttagactttacttcccttcatcctccattcctcactattattaagcttttaacagttatacttacttattaaaatagagaaccgagtttaagtatcatatagcttcttagatgcaaattatcgtttactagtatctttaactaggggaataaagtaggaataacctggaaattatgttcatttatatgtgattttcctgctttttaaattaatgctttgaagcaactggggcacactttctcccaattaaagagaaatctcattacttactgaagaccttaagagaaaagctgagaatctacagaagtgccttcttttagtgtaaatagtggctcatttagtgccttttagagcctctatttcttccagtatgatttctgccgtgtaagtgtagccaccagcacaaatgaaaaggatgcaaagacatttccctgtattaaagcaatgaattaataaagagagctctgttctggattagttatgcttttaattttaatataaaatagtctctttagaatcaaatgccctgtgggacctatatctagaaggaggaagaatgagcccccaggattaaggctacaaagaactgactgtggtgctgaatgtaaacatcagctgagattaactatgctagtatttttattagtattgttattatttttctttatgtgccgggtagagttttgagtggtccaacccaaccctatttttcttataagccatattattattttttggtgcataatttttgagaatgcaaggattttcaggaaagctaggtggttggttttacaagatagaaaattagaaaataccaaatttttacacaacatagttgatgtaatgtagtaatcatgtattttatttctctggaaattgtatcctcacttatgaaagccagaatactattttagtagcatttatctatttaactttcattgtctgttgacagatgtatttagaaaatcaaagttaatgtaggataacctggtcgagttagcatttattttagtttctgttcagaaggtagcaaatattggtttaaccaaagctcaggggctaagataggtcaaatgaagtttatgagattccatacactttctggacaaaaatctactatactactcttggaaaaataatttgaaaaagacgtttttgagtaggcttaatgttcttaatttagtgctccccaaaagaggagtatgagaaaaacatttaaattttggtattatgttaaatacatcccatgtttatacctaaaatagtcaatgaaattcttttcctgtgtcaatgattatttcagtgattacctggacatttgggaaagttagcaattaatgccaagggttatttattttgtcactggttcagaaatgcctgtttatacaaatcaagacttccagcagcttgagccttctttttctttttgagctggtagagtcaatggttaaaggacaaaaattctacaattgattgagttacaaatgaatacagtgttaattaagccaggccattgtctttaaagtggagtcagtacattggaagtcagatttctcttgctgtttagtcaaactgcctaaggctgcaactgcttccttattaggttactagctttggggagatgtcattgtttgctgctgtagctaggctttctgttaaaaatcacagcatgaggcttaaactgctgcaaccattatccagtgctaacatgtcactaaaggtctgctaatagaacaagaggaaaaatatcaatctttaattttagatcagccaagtaatctgtagcacctgttcattttctctcatcaacccatttaaaacaagactagagtgattctttgatgggcaggctataagattctaatattttttgccttttcttatcagaggaaaatttagactttaagactaaagaatagaaaaaataaactgtaagtacatttcctttaaaaattttatttaagaggtagaattatctgatgtaatccaatgatgactaggttattataaataattttttaaagaataattttgtttaattttctgaaatttactttttagataaaagctaatcaatgaggacataatacactggtccaaacagcaaattttccatagagagcagaaactctttcaagctttagatgacaaccaacttacatttacctattcagatataataaacagaattagaacttagcagctgctagctttcccttacatagacctcaaggctctgtcacggtatggggcaaaattaaagaaaacattgtgtcctgctcttaggagaggtgaaaggattgcttctgcaaaccaccattagcaatgcgagttccaaaacattcccagtgatgctagaccaagtactacacttagcaaataaacatataataagagaaacataaaacttagtaaacctttacagtccccaagtatatccatcttttatttaaattaaaaaatcagttactactctgagcctgtctctttactaggcattgagaacatcaaaatgagtcataatacatgtaccctgctcttcctcgtggaacttatggtctattattgatcctctgtataaaacctttctcagagctagtacacatgcagtttttgttttgttttgttttgtttttgtttttgttttttttgctggtgaggaagttgagatacagggaggttgtgacttgtctatggtcacaagataagtggcagagtaaggattagaagaatccggtgttctaacttctagactcggtctttttttttttttttttaactatatcaagatgaagataccggaggggagaaggggattatgaaggcacagttttaatggacaccttgtagaataatacaagagtggagtgacagtatgggagcctttgattaaaaaattaattctaatgatgaaaatctagaagccagatataatttaagtatcttcaaaaggagggatcatcaactcatttaaaacaagtctacagtgatcctttgatgaacaagctataagattctaatattttttgccttctcttatcagaggaaaatttagactttaagtaagactaaagaatagaaaaaataaactgtaagtaaatttctcttaaaaattttatgtaagaggtaagattagcaaattgcatcttttatatagagagttatcttttgtctataacattcatcagtatctgatcatattcttttggatctggctatcttagactgctaggacacacacacacacacacacacacacacacacacacacacacacacacatacatgcacatacccctatacctatgaccaatttcacatctaagttctgacatttagccctaaaatctccttcttagcccaaagccgctgttggccttgtcctggaaattccaacttttagcattttcttcagtggtcacttgtgtgatgcatctctcctgaggtctacatcagagcaggctcagcctcattctgccacgaccatttccatcatcacaagtacttgatctgtttcacgttttatggaatcgataaatctcatccctaaagagtccagcaggcctttgattcctgacctgacatttgctaatgctattcctgatgacctgccactacggatctgcagcactgcactcttgtgtttgacaacactcataatatgaatcaatattcagcattcagtaagtgagctggggagtcatttcactgctgcaaaaggctgcgttgcccctgggcagctgtcagaaatgggtagttattaatagccctctcttttcacttagcatagtcagtaggggtcaggcatgaaatgatttaatcagtttatgatatctgtgacagagagcacttaaaatgtaatcacaaaatttaggtagaagtgtccctgggctgttgtaatgtttttctcacttaattttccctaatgctgatacagtgtagtgcacactgagagactgaccatacaacaaaatgacatatgagttggtgttggtttcatttctctctcagtaaagttgcctttttagtgggggtttttacttcacaacatagaccacaaatcctaagggtaagtgagtataaatcccttgggttggcttgcttggctctgcaaaatgtgtccaaaatgtgttgaggggtcctgagggtggggaagaacttgattgagcagaaaaatatcaagcttaggttttttgttattgttattttctgtatcctcaaagaaaatgttaatgtgctaggattcagaggacattttccaggtacacaaacctagttgaacaatatcagtagtcttattgggtcctctagcagtcacttggaaataagctcagcagaagtaaaagtaaaaactgttctatgctgatagttggaaagacagtacctcagcagggattggtcaagctgggaattcagggttcaagtaagaagagtggctctaaaaaatgttagatgatgctgacgtggtggtgcatgcctgtggggctactccgaaggccgaggcaggaggatcacctgagaccgggaacttgaggctgtagtgcaccatgatcatgtctgtgaatagtcactgcactccagcctgggcaacatagtaagacctcatctctaaaaaacaagaaagatatgataggtgaaagatgaccctaaacttaaaaggcagtgaaaaaaatcatcacaggtgtaaaagttagcaatgcatggaacaagattagtacaatgtttaggtcttggggtctggaatacccaggttcaaatgccatctctgtactatcatttcctcatttgaaataatacccatttcatagggttactatgagaattaaatacgagcttatgtaatatatctgacacataggagaagttcaaataacattacttctctctttccttatctctaacggcctaaatttggttaattataatgcaaaagggagggcaagttttgagctgaagctgcagtggaaagggatcatcaagacagctgtccttgagtgtccctcctgcagtactgtctctcattggctgcttgcccatcagaggcacactgatcactctaaatatcctggtagagagtggggaaaaacttggccctggacatcttcctgcagatttagggagacagaagaaagaaaaaagcacagaatatgctgagttcagatttgtgattctaatgttaattaatgcttgccttcaaatgggcttagttcttttattcaacaagtatttacttagcatcctactatgtgctttctatgtgctggcaaaatttatgggaacaaccagctcgaagtcccctcctgcctcattcctgactctgttgggtatcataggatgaacattagacaaagacatacgccttctgtgtttctctgtgaatccagagccttaaaagctctggcattgtctaagacccacttatctctaagtgctttggtttgtactggttctttatctttctaagctagaaagccatggtctcacatgaaaccacaagccctgataacaggtgtctcctgtggtaggcagaattctaaaatggcccccaagattcccggccctgctgtacacacaccctctcccaggtatttagccatacgttatctagatactgctgtggaaggattttgcagatgtagttaaggtcccaaatcagttgaccataaagcagtgacattatctgagtggatctgacctaatgacataacccctttaaatctgggtctagaggtcagagacgggaagtcagagacgaagcaggagaaggatttgctggcttgaagatggaggcagctacgtagcaaggaatttttttagctgagagtggcccttgtttgccagccagagaggaaatggggacctcaattctacagctacaaggagctgaattttgccaggaagaatgaggttggaagcagaacttttttagagcctccagatgagaactcaatctggttgccactgttatttcagccttgtgattccctgagcagaaaactcaaccatgccataccagacttctgacctaaagagttgtgaactgataaatgagtgatggtttaagctgctaaatttctggtgatttgttatgcaccgataaaaaactaatacatcttgtttacatcttgcctgttccacatttgtttcctccgagatcagatggaaacatgatcccctttttctgttttcaaatcttatgtctctttctggtacatcggctaagctcttctttctgttggagaaaaatgttctatattcatttgccaaaagagatgattgcaatcttctgaatctggtgaatgcctgaggctctctcaccagtttaccagctctgtccacttctttgggctctctttggtgactaatcactcaagcatcctccttcccaacccctatgggaattctctgccagattactatgattatagttttataatcctaaaaaaaaagacctgaaaatgtacagagtgacaaacataattcaccccaagggaagagaagaacctctctcacacagcaggaagactcagtttttcctgtccagtcacttgccacaatgtcttgaactgaaaaccacaattacttttgcaccaacctaaaatgtatatataattttttttctttttttcttagacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagtaagtaagcctatgtcctacatgatgtctgtaaactccactccctcttagacttacatcctagaacaaagacatagggggcttcttcaactgtggccatacatttttgtcccagacccagcttcattgtgttaaaagtcttggtgttatgtgaagagtgtctttatccatccttccgtcattcagtgtagagttctaggatttttgaaataggatagattcattctgacctgcctgaattgaaagtcatattaaaatgtgggcagggaatcgggaagggaaatgtggagaaaaggaatgtgtgtgtagtcatattcacaaaaataccttgataaagagccaataccagcacaaagaacatcagcatatatgtttttaagactgacagccactgggcgtggtgattcacatttataatcccatcactctgggaggctgaggtgggtggattgcttgagcccaggagtttgagaccaaccagggcaacatagggagaccccgtttctacaaatcattaaaaaaattaggcaggtctggtgacacatgactgtagtcccagctactctagaggctgaggcttaagcctgagaggttgaggattcagtgacctatggtagtgccactgcactccagcctgggtgacagagtgagactctgtctcaaaaaaagaaaaaaaaaaagaaagaaaaaagactgacagtcatgtaagatcacatttacatataaaatgcatatatgtaacatttcttatatgaagatgaatagtaaaggaattaaatcaatttaatttctactagtatagaattaaatgtctactataaagttatcactaagctgagctcttagggagacactgaacccaaggaatttataggctccgtctatcttttttctattccatgtggtgtgagagaagtcagttaccaagatctattgaccatctatccactcttttctgaaccaaaggcatactctaaaagcttgcagtgactggatgagtcaaattctgtcacttcctctttacaagttgttttgtaatgattaaaccagtgatacattgtatcatacattgattgaggaggcatttaatacttaaagtgagaactgttgcaagttatcaaaggaactgtgggtgttctgtatattctctgtatatcttcatagagactgccgagaatggggcttgagactaaagttttaaacaactcattcatgaatgtccatctacctaaacttctgtacacaatatatgacaacttgcaagacctggaaaccagatgtttttaaaattgttttcttcagtgttttattgtaaaaagtctcatctattctacctagccacataattccaggtggtgttctagggttcagggtagagtacgtggcagtaatgtagtcacaagattatgtagtcctgtttaatggggcagaaacccacatctgcaagatctttattctctcagattgctgagacaaagaactggatacggggctttacacagtgtcatgcagtgcgtgggcatgccttctatgtcacattaattgtatttataaatttactccagaaacctgagcatgaagactctaaattctcactgttcaggtgactctaagcagatggcttatgcataagattggaaggattggaagttctaaagggaattgtgcgtgttgccctttgtgttccataggccattaccactgggccttgaaactccctggagttttatgcataagaaagaaagatgtcaaatttgccttcttgagtagttttatcaaggtcacctatgatctgtatttaacatttggttgcaagggagagttcccaacaaaaagatgctggaacacagccagtccattagcattgaggccatgctttcttcaaaacatcctgggctctataccaaagtatgctttttaaatggcagcagtggaaaagatttgtcgaaaactcatgtcactgtagatgaatttgctctgaagaatagagatcattatcagcccagtaaattttgagacatcagagtgaagcactgtactaagtgcttttgtacatgtcacttcacttcatcttcataatagtcctgagaatcacataattattattctcattttacagaagagaaaactgagtcctatatatgacataccttgtatacctatggagagctttcctttgttggcaatattataccagaaacagtttagcttactcagggcgaagtgtaatatgggtttctaacatatagatttttttttagttttcattttttaatagatttagagggggacaagtgcagttttgttacatggacatattgtgtagtagtgaaatctgggcgttgaatgtaagcatcacttgaatagtgtacattgttttacccattaggtgatttctcatctctcatcctcccctccgagtctccagtgtctattattccactctatgcccataggtatgcattatttagctcccgtttgtgagtgagaacactaacctacagtttgaatgtatgttcacagtgatacacaatgatatttcgattgtactcattattacttttgagtcttttaaataaaattcagaagagaattttatttaaaagactgtggctttctcattaacaagacaggcaaactgaaccaattcatttacctatctagtgcttgacatggaggatttaagaaatcctagaaaagatttctaaaatggaagattttacttggtgatctttacagtcaataacaactccaaaatcctggaatcttatgcagatagagtcctttcatacaaaatactgtggcagtgctcagaatctggtgtgaggtctgaggcaaccactcacctccatattttccatttattgagcacttacgtttcaggaaccatgctaagcgatttacatacatcatctcatttaattcttacaactgttctgctaatattatttccattttacatatgaggaaactgagatacagagaggcttaagtaatttgtccaaagtcatatggtatgtgatggtagagctgagatgtgaaaaccagcctgtttgaccatcaagctagcctcttaccattgggctatttactttatttatttattcagccttagggacaggataagtttatgtcatttagtcaggaccctttcccctgataatctttggacaaatcagcaataattttaaaagaaagagacaaatattttagaggaagggaataggataattggaaagaaactaagagggtgctgtgaaagtatacataaggcgaaaggaggcttagccaaagagttcaaagtcagaatgctcccttgtcacagaaattaagtactagatgtgtgctatgatttaaattttcatggcacattaaagtcttttgttgaaaaacctgtaacatcttcagcaagtagtagacactatttaagtacctgtaattgaccaatacgatactatactactggtgttctgttcactgttgacccagaaggccacatgtgtagatagcatatgaaccgtcttcattttatactctgttctctcatacaagtgctctaaagtgacttttaatctctgttatatatagttttatccattaagaggatatgacatcttttcattcagagtgagacacttttttttttttttttgggacagtctcgctctgtcacccaggctggagtgcagtagcgcaatcttggcttactgtaacctccacctcctgggttcaggtgattcttgtgtctaagactcctgagtagctgcgactataggcatgggccaccacaccccactaatttttgtgcttttaatagagatggggttttgccatattggccaggctgatctcgaattcctggcctcaagccatctacccaactcagcttcccaaagtgctagaattacagttgtgagacaccgtacttggccacgtttttgttgttgttgttagaaatgtgctctgagactggcatttcctctctgtgactaatcagcattagatgggaagatagtcaactgttgcattctttttctattctaattattgtcatggctctggtagtatttctaactataattttacactaaaataaaaagaataatttatcaaatgaagctattttagtgaatttaaaatgtatgacatccctctcataaggtagctttgcttggttacttttattgttttgttgagtattctgattctataaaacataacatttaaaaaagaggttgtaggcattaatataatattaagtgacttgcaaataaagaagtatggagactcttaggaggtgggtgcctatttatctctttaaagaacacagttttagaaatgtttgctttatccattatgaccttttgctaactcattcattcattcagtagacatttagtgtctgtatgttcagtcggagttcctggggtaagaattagacattcaaagacaactaagatagagtttatacctttgagaagctgactgttttgtgagggagatagacaagggaggaggaaaatccagtagttagttaaacattatgatagaggtatgcactggatggtgtgtgagcacagaaatcttcctagtaacccagattgcctaggttcaaatcctggctttgccacttgttgactatgggtcttggacaagttacttgacctttctgtgcctcatttttcatacagcccttagaacagtacttgatacacaataaatattcgccgggcacagtggctcatgcctgtaatcctgacagttcaggaggccaagacagaaggattgtgtgaaacctggagttcaagaccagcctgggcagcatagtgagaccctgttcctacaaaaatttaaaaaattacttgagcatagtagtacatgcctatagtcccagttacttgggagtctgaggtgggaggatcacttgagcccaggaagtcaagatcagccttggcaacatagttagaccttgtctctataaaataaaaaataaaaaaattacccaggtgtggtggcatatgtctgtaggcccagctatttgggaggctgaggtgggagaatcgcttgagcccaggaggtcaaggctgcagtgaaccatgatcataccctgcactccggcccgagtgacagagtgagactgtcctcaaaataaaatgaaatgaaaacacaataaatactgcattaggatctgttaaataagatatttaaagcagaatggatgaataggaattaaccagatgaagggcgttctggttggggtgggagtagggaagataggatggttttgaggaaactgcatatatggaaggccttggcaagagggatctcggaactgttgaaaagggtggaaagggggcagcagcaaaagaataaactggagaagtaagcagaaaccatattacacagtcgtgtctgaaaacatggcaataatttacattattcattcaggttcatatttttaccatattttcatggaggatggattggagtagggaaaccagtcagaggctgttgacatggttcagataaaaactgattgagaccttaaactaggggtattggtggtagggatagagaagaagtgaattgattagaaagctgttgaaagtgtgggataagggacaagggacaggtgggagtcagacacatctgacggtttctggcttgtttgacatattgctgaagcagggactacaggaagaacagattagggtgaggatggggagggaggatgggttccattttagatatttttgagtgagtggagcctgtgggacagttagaagagctttcccaataggcctttggctgttgagaaggtctaggcatcaggagagtggtctcatctgtagaaattgatttgggagtcatcttcaaatgaatgtgggttgaagccgtgagagtgggtgagattaagaaaaggaataaagaaagaatataatagaatttaggatagattcctggtgatcactaatttgaggactgggtatatagactgaaacagactgaaaggtaatgcccaaagaggaggaaaaccaggagttgtcatagaaaccaagggaggagaaactttcaagggcaagagagtggccaaccatgtcaaatcctgcagagcttttggttaggatggggacagaaaagtgtccattgaatttagcaacaaagaggtcattattgattttggccagagaggcttccagcagggaagaaggagtggcagccagattgcagtgggctaaggggtgagtgaatgggaggagcagaagtatagcttgtctaaaggaaaatcaagacatggggcagcagaaaggggaatgcagggttatacctgtctgtgttataggtagcatcttcattgcaaagtgaaaggctatttaaaaatacctacaattttttttattttttatttttatttatttacttattttgagatggagtcttgctctgtcacccaggctggagtgcagtggcgccatctcagctcactgcaacttccgcctcccaggttcaagtgattctcctgcctcagcctcccaagcagctgggattacaggtggctgccaccacacctggctaatttttgtatttttagtagagacagggtttcaccatgttgtccaggctgttcttgaactcctgacctctggtgatccacctgcctcggcctctcaaagtgctgggattacaggcatgagccaccgtgtccagccaatttttctttcttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagccaccgcgcccggccctcttttttttttttaaaggattaatccgctaggcacagtggctcacgcctgtaatcctagcactttgggaggccgaagcaggaggatcccttgaacccagaaatttgagaccagcctggcaagataatgagaccccgtctctacaaaaaaaatttacaaaatgatacaagtgaggatgatgtaagtttatttcagggagaaaatgcacaggaactacccactccctgctggaatgcaacagcatgcaaaagttttatcttttttactttcacctatgtggtttgctttaactcttttcactgaggaaatgccttgtttattaacttttctagacataggattcattcatcattaatgataatgtggtttccaagtattatttgtcagagaaatgtccactagaaatgataatggtactaactgtgtcctctttctgccatcactttaatcttactcatatctctgtgggaggatggagctgaaagataaacctttggtacattttctagttttgtttctggcttttttttttcctatttaaaagtgttagtacattctcttatttgaggaaataaaactaacacatgaaacaaataggaagcaaaaataaacggtgcttaagaaggtagttaattttatggtacaataagggcaggccattggttggtttctttgtttagagggcagtccttttttgaggaaggggaatattagtggaatggtctggtgatgttgctcctcatcttgacctgagggaatgtcttgaacaagtcaattaacttatttcttccttctttcctccctccttcccttctttccttcctcccttcttctatgtgtaaaatagaaacagtaacaacagtaataatctctttagagaagcttgagaaaaaaaggtttctaaataaatagaagaatggttagcaccatatttctgagtccttgtccattttcttgttaccgggaggtgatcactttttgtggagaaagtatttttaagtcacttttttttattttctacatttttctaatttcatgttgctgtttttaaaatataaggaatagacaaagaaggaagtttaagattaaccattgctctctgctctgtatcaatttaggttggtctccactccccactgcgcatgtcagtcagtttaaaatatctgttatcaggaccctgattggcattaaaggaaaacttacataatgagtttcacccagggatgatcaactgcaatactattgtgagttttatttatttatttattcattcattcattcattcattcattcattcattcattcgatgagatcttgctctgtcatccaggctggagtgcagtgatgtcaatatagctcactgcagcctcgaactcctgggctcaagtgatccttctgcctcagcctcctgagtacccaccaccacactcagctaattttttaaattttttgtagagatggcatcttgcaatgttgcccaggctgatcttgaactcctgagctcaagtgagcctcctgccttggcctcccaaagttgtaagattacgagagtgagccactgtgcctggataattgtcggttttctaagagctctattgcattgccccagtttccttggtacttgctaagtttagacctcgggtggaccaatttacatatatgggaatatgcaggaaatgcttttatcatctgttgtatcctcaaaagatagttcctaaggcagaagtctatcttcaatagatagagttcagagagacaaattaattaattctcagaggtggattggataaggaaattgtggtacatatgccccatggactactacacaggcataaaaaagaaggaaatcatgtcctttacagcaacatggatgcagtgggaggccattatcctaagcaaattaatgccagaacagaaaatcaaatgtcacatgttctcacgtataactgggagctaaacgttgagtacacacagactcaaagatgagaacaatagacacttgggactcctggggtgggatgtggaagagaggtgagggttcaaaaactaactattgggtattatgttcactaccttggtgatgggattattcgtacaccaaaccttagtgacacttgaattactcatgtaacaaacttgaatacataccccctgaacctaaaataaaagtctggaaaatgtgtctctgtgtgtgtgtgtgtgtatgtatgtatggatagatagatagatagatagataaacagacagacattatctgtctatctaactatctatctatcatctatctagaatccaaaataaaattaattctcagtttctacaacagatggttcttcaaaggcttagatccactaaagctatccaacttgaacacttttggattagggatgcaacttagtggtggtgctgttttaattaggacacactatttgcagaatcatgaaatgatggtgttggaagggactgtatagtcctctattgcagcttccccttcagttgaggaactcctccgagagcatctgtcacagacttgtgagcatcttcactaataggaagtgcattccttttgaggtggtacacagttaaactgttgcaggtgtgaagaaatgttcttcatcaagagcctatgtgttcctctctgtgataatgtacattctttgctctgctctctagagcaccaccttattttcatgacagtccttcaagtatttcatgacaactctcatggcttttgtaaacctttatttcttcaaactaagaatttctattttacataaccactttttttttaatgtggtcttcagatttttcaccctcttctctaccaaatctgttatccctttgaaagatgtgtcttacacagggtctagttgagcagactagtatgtctgtagagctgaaccctctatctacttactggaggataattatggaggaggggaaagagtctagctcaatgcctgaaacagttattgatttaaatttacataaatggttcatgataaagcattttatgactattcagaatcaagttttttatttgaactgctagcaaactaggtcttgtccaatttgtacatgggacctaattttttgtttaagataaaaaagcttctctatgtttttgcctgcaaaatttcatttgactttgaataatattggtttttaaactcatttttatattgactttgaataatattggtttttaaactcattttatgccaatcaaagtcaattcaagtttttattcatcatctgtattattaactagccctcttgctttggctattgggaaatgtgtaagtttgcctttgaagtcgcttttcaagttgtcagtaaaatatttgaataggctagagctaaacacaacacactgggagtttctgttaggaaaaattgacatccatcaactgacttggccagtttttcttagtcttgtccataagaatctatctgaggcttagttaaatgtcttcttggaactaagagatactctaacatacttgttttttaaaatttattttcttttagagataaggtctcactctgttgctcaggctggagtgcagtggcatgatcatagctcactcctgggctcaagcgatcctcccactcagccacctaagtagctaggactacaggagcataccactatgcccagctaattttttaattttttttttctggagacagtgtcttgctatattgcccaggcaggtctcgaacttctggcctcaaacaatcttcctgccttggccttccaaagtgctgggattataggcgtgagccacggtgcccagcaggtggcatccttctaatgatagactgattgaccagtctaaaaagaaaaaagcatgctctcatttattaatatctaatattatatagtttgaggtggtatatttaagctctttggacaatagttaacctaatctaattttatccttcaaaatcatctgaacaaagcctacctatgcccatctccatttccctggcagctcccccattctttgggatgtctcaaagttactaatattgattttgcacacttgccctcaagttgtttcagaaccctggagtgtaatttgtctaagcttgaaaagttgaattcacttgaagtgacttcatgctgttttcctactatcttacaccttagatgggggctttgagtctttctttttgattcttgttctaccattttcagagagaaaattaaatctaagcaaaacaggaattgataagtatagctgccttcctgtcaccctttattattatgtcatatggcctgaccactggttttgtaacattcttgtttgtcttcttattccaaacaaccttcttataatctttatcatttttttttctttcttcttgcatgcctcagcattctggaatttagcctttctgatactgtgttttgtaagttcctaccaacttggcagcatactcctggtgaggtgaagctcctcaacattactacgtcttaccaaaatcatggttttgtatctagacttagaaatagattatctgaattctccatctagctggtggtttatagtatgtgtacttccacaagactaccattactgttttcctttcttaatctccactttttctttccttctttgtgtttgatttttacatagataaatatattctgaacatacagtttacttattattcatcactatgaattgataaataagcatgtgactttcttttcctcgttgctttcacttgggataacctggtgacatttcccaatataattcttctaagtcatacctgtaggcctttttattaatattcccatttactctcaatcaattcagctagttttttgtcaaacatgttctgctcccttttcaggaggtgaatgatatctcttattaggagtttttcaatctgccagcttaagctatagatagacaacaatattatggggtttagagcaagttgcacttaagacattgatgagggaccttaagatctggtcacattggatcccctcactcatttctgataaagaaaataaagtagatctgatactgctaaatgaacaaggaagtggaattgtctgtaagagtctttgaggacatggatgggtcaggaaaagtcaaggaaatcactaggcgatggccaggtagggaagtgagccatggacagggctggagaatataagagggagaaaaaagtgagcctccattccaagtgatggtgatggtgtgaagcagttgtggtggtggacttgcttgtgacaggtggtgaacttgtgtgaaatgaaaatagaagatcaagctgatgcttggaaactgggtaggaggtttattggggtattctgccaagggctttgtaacttgccacccagctgctgtctttgagtagaaagtcctctagtggtgagccagtgagaggggctaagagccatgtcccccttcccattccactctgtgttctacatcagaatttcaggtccagagcagtttttacaacaaacgaattctatttttcttggcactatccacagtctctgtttacccttctttcttttctaatccatttgcttattataattattattacaacagaagcataaccattaacaacaataatagctagcactttatgagctttcattatatgccgaatataagtattaactcatttaattcacacaacatccctgggaggtgagtattattatttctatttcacaaatgatgaaaccaaggcttagagaggttgggtaacttgcctaaggtcacacagctagtaagccgtgacttcaaagccatgctctcttttttttgagacagaatctcactctgtcacctaggctggagtgcaatgacacaatctcagttcactgcaacatccatctcctgggttcaagcaattcttctgcctcagcctcccgagtagctaggattacagatgcctgccaccacacccagctaattcttgtatttttagtagagacggggtttcaacatgttggccaggctggtctcaaactcctgacctcaagtaatctgcccgcctgggtcttccaaggtgctgggattacaggcgtgagccacagtgcccggcccaaagcagtgctcctaatatcatattcccatctgcctcccctgctcaagaggaccttactctctcagtactggtggtatttgtggtaagatatggagaaaatgataactaagtatgtatttcacaatatgtaaaggttttttcttttttaacagacattacattatttgatctaaccaactcctatgccataactagtgttattcctattttatggaagagaaaaataaggccgagagattaaattaaaacttacaaggtttacttttattgaattaatttttaaattattgttataaaaataatcctacaatcccacaacttagaggtatctactcttatctcttcgggatgtatttcccataggtgtatatacaaatttttgtttctttcttaaaaaaaggattatactacctgtactgttttataacctgactttttttacttcaaaatgtactatgaatattttcagtgtgattaaattttcttctacaatattattttaatagtattattgttttgccttatgtagatattaccatttgtgctcctgacacagtaaaacagtaaagatgataatatcaagggagagtatagtcattagtttctttttttttattattatcccccatactttaagttctagggtacatgtgcacaacgtgcaggtttgttacatatgtatacatgtgccatgttggtttgctgcacccattaactcatcatttacgttaggtatatctcctaatgctatccctcccccttccccccaccccatgacaggccctggtgtgtgatgttccccaccctgtgtccaagtgttctcattgttcagttcccacctatgagtgagaacatgcggtgtttggttttctgtctttggcgatagtttgctcagaatgatggtttccagcttcatccatgtccctacaaaggacacgaactcatcctttttttatggctgcatagtattccgtggtgtatatgtgccacattttcttaatccagtctgtcattgatggacatttgggttggttccaagtctttgctattgtgaatagtgccgcaatgaacatacatgtgcatatgtctttatagccgcatgatttataatcctttgggtatatacccagtaatgggatggctgggtcaaatggtatttctagttctagatccttgaggaatcgccaaactgtcttccacaatgattgaactagtttacagtcccaccaatagtgtaaaagtgttcctatttagagtcattagtttcatattatttatacagttggggttcaaagcatactagttgatcagaactttttttttttttttttgagacggaatctcactctcttgcccaggctggagtgcagtggctcaatttcatttcactgtaacctccgccttccgggttcaagcgattctcctgcctcagcctcccaagtagctggattacaggagcgcgccactatgcccggctaatttttgtatttttaatagaaacggggtttcaccaccttggccaggttagtctcaaactcctgacctcaactgatccacctgcctcggcctcccaaagtgctgttattacaggcgtgagccaccacacatggcctagaacttttctcagagtgaataaaggcctgcattgctattatttgccaagctgataacacattttgtttgtttgtttgtttgtttttaggcagagttttgctcttgtcacccaggaagctggagtgcagtgtggcacgatctcagctcagtctcccaggttcaagcgattctctcctgcctcagcctcccgagtagctgagattacaagcatgtgccaccatgcccagctaattttatatttttaatagagatggggttttaccatgttggccaggctggtcttgaacttctgacctcaggtgatccacctgctttggccccccaaagaactgggattacaggcgtgagctaccacacccggcccaagctgataacactttaaaccttggttggacttggtagtgtcattacatatatgcaggtatccactcttgtctgtaagtgaatttcatgaactaagccaccctgttagggttgtgcaagatgaaaccatagtccaaagagatttccagggctatccactgtttcctcacttggtctgcctggcgttgctgtcatgtgtattcgtgtcctaatttttttctactgggttgagggttcttcggagaaggcatctttctcatctttgtctctcacatttcctagcatagtgctggccaaagggaccccccaagtggtttaactttatattcacttaactatggcaagggtggcttgatggcaacaccttcaaacatttttatccatatacatttgatctataaattggatcaagaatgctcagaaaaagaaataaacattaaaaaaataataaagtaggcaatgtggtgtcctggaaagaacactgaattgcagcaagaagatgtagctgtaaagctttggcactaacttctggagagaacttggtaaagtcacttgacttctctggttctccatctctccttttgaaaaatgaaggagagatgagatacttttttagatccttcccattagtgatgtgtgaggattacgtaatttaatattgccagagtttgtgcttactttacaaaaagcaagaaaaaacttcaggaataaacagattctaaagcagttcttctaaaatttggctacacattggaagcacatagtgagctacaaaacaaaacaaaacaaaaaaacgatgcctggatcctactcagagaatcggatctaagtaacctggagagtggtctgagtctggaattaaaaaaacaaaaaaaaaaacaaaactccccaggtgattttatgtggagccaaaaccactgttttaaaagttttccccattgtcttattcacaagtgatcaattactgggcagggcacaggtattactattttgaccctaaaaataaataggaaggctgactgttctaaagttgatgatgctatttcagatcttttcacacagatgtcacttgccctacaatattgttttgtcatgccacaacatgtgtttgtgtaaccgcacatgcatgtgtacgtggcttgtaaatctgtggggtaaattagatggcgctaaaaagtaattgaggattacaaattatctctaccggctgttgaatattttatgtcaattaaacatttgtaaaaaccaagtatagtattatgatctactcataactattagaagactggcacatctccatacagcaagagccattgctaaggctactgtactactctggcatgaatcataataaattgggatccccctggacataatgaacagtaatataattttgtagttatcctcctagcatgatgaagcagcaagccaaattgagtttctagataaattttgacatatgggtcttattcctaaagaaaaagagctattgttgctttggctttgttccagaattctgcagaaatccacatggtagcttattgttgtattacaaaaaggtactacaagtatttttttatgaaaaagaataaattgctaagttcaattagtcctttggggcagaatttggaatttcttttcagtcaggctgctgggtcgtatgtgaactattgtttgactcacacaggggctgtcctaaaggcctgtgagccataaggccaccgtgggggcttctagttgatggtggaaggatcaagcagccctctttgccacagcagcaaaaaatgatgttgacatcatttaaaaaaaaaattagccataggaaggaggttaagaagttgtggcagaattgaaacaaatctaggcctctcaactgacaagctgagaaccctgcttgacatttatgagtggatgcgtttgaggaattatgtaagaatagtaagttaaaggatgcttttaatttaaaaaattaagataacctgaaaacatacctgtaaaaacatttcagttgacacagtctcttatgcttataacaaggattactgttaatgtgtttttgcggagttgggctctgatctgtaaatatttctcagggagataagagtctatggttaaacagtcgtagtagtagtagcagaatttgggtgtcattgtatagccaaattcagaagcttgggggaaaagaatagctaccataggaaccagtatttcagaagcaagttctgcttgtgagagttatcagttgaccaagggattcctgtgtaggtttgtaaagagtgtcagatctggcattctcagtatggaattactggcatgatgcaatggaggaacaggaatttttctgcagctctttcagtagtattggtttggtgttgggttatccaaataatgctcagattgtcctaattaacattaattcatcccctctgttgggctcatgtgacatatgcaacccgaccatcagtcagtggcgtattaaaatgctctccacaggaccacagagcagtgggtgatctctgcatggacgtgatctttgttgagcaggaatactcatatttctgccctaagcacagagcaaccggctatcaactgggatagaaaaattatgttcattcaggagactactgaaacatcttgcttctctcccatgtcaatcctttgtaatagagtaagggaaaagtacatacacttttgagtaacagtttccatacaaatgctctgatgaaagtagggtcccatttggaggaagctcagttcagggctcagcttgttttctggaagcaaaagactgctattagacagagacagacatgggaaggatgagaattgaaataagataaaaagagaggattttccttgtcaggtttcttctgcagttatgtcttgtcctgtcacgtcctgctagcacaacttttggcagaatccaaaatttgggagccaaactagacattaacaatgtttcttcaacagctcagccatagaagctgatttcaaagttaacagtaactgctctctttggatcgagagtcattcattcattcagcagttatttatcgagtgcttacttagcactggggaaactggtgaatgaggtaaaatgctactcctgttcttatttacaagtaagtactggggaccaaggttaattgtttacttgcagttatgataagggtcgctcttagagcttataataaggagctctaactttgccaggggccagggtgggggtgggtgatcaaagcatgcaaccttgaggaagtaacagttgagcataaatctgaaggatgcactggagagcgagatgaaggagtagggcaaagtgttctaaacaatgggaagagcataggcaaagtcctgaaatgagcaaaacgagcaaaacaagctgagcctgaattgagcttcctccaaatgggaccctactttcatcagtgcatttgcttggaaactgttactcaaaagtttatgtgtgttgtgtcttttgccttagtctattacaagaacttacataggagagaagcaagatgtttccagaccctcctgaatgaacataatttttcaatcacagttggtagctgttgctctgagcttagggcagaaatatgagtattcctgctcagcaaacatcatgtccatgcagaggtcacccacagctctgtggtcctgtggagagcattttaatatgccactgactgatggctggactggatatgtcacataagcctgacaggtagcaaggagattggttttagaggaactgaaggtctaaaaaggccaccctggctgaagcaggtcagcataacaggagaggaaggagaaggggccagactgtgggtccatgagggcacctcatggacatggcaggggtttttgcctttatcctaaaaccaataggaagacattgaaagtacaaagctggggaagtgacatgtgcagcccctgcttacagagggcacaaaagactaaggttagaatagggtgtgggttctgagaggccctgtggaggctagtgcggaagcccagaccacagaacaggaacgagggagatggcagtggaagagaagtggaagcatgcaagctacatttccaagttacaagggtcaagtcttggcttagaagcaatggtggtggttgaaatgtcagtctctagggcagtgtcagaattccacctgatggctctggccatcacatctcagtttctggattgttcgggttaatgctagacaggtagagccccaaactaagtatgtgctctgagagactctgcctcatgaataaaaatcatgctgtcctgtgatttttattcatggaacaattgtacctagagacaactcaataggaaaactattaataactggtgataatatcatctcacttcttcaaaataaatgtttttcattttcaaaagttctaagttcagttacttgcaatatttctgcttacatggtaaaggtctataaatcaagatgcaaatatcatcggcttcttacagggtattatacgaatggcgattttctaggagttatttcactaaatttgcatatgtaatccaatggaatatattcattgcaaatgattctgaaaatcattttctttttttattttaaaaatgagtttttgtttaataaccttacattcccaatctgtgtactgttactattgtcattctccttcagtagtgctgtgaaatctcttccaactctcagattccatgattttcctttgtccctgcctctcttattatctttcattgcatctcttctctcagtgtcctgtctttctctctttgtggaggtagtagctggcatgatagatggaagttagaatgctgaggaagggtagttatcaagggaagcttgggccctagtcatcgccaatcctctttcctctatttcctctgtgcattagcttcaagtgcagtcattactcatttagtcctcaaataaaatgctctttgttgcaatgacaatttttttctagtataaggcaaaatggcatatcagtctgatgatgtggattttatagcaaccggcagattttatttgtgtaaggagtttttatagttgttggttaccttttttttaagttgccatttggatcaaggaggattttatttcttaactaggattattcctttatcggatattaacttagccttttttctctaaataccaaattcatagagatgctacatagttaatttttttctttgtaactagattatccccatatcaggtatttcataaagccaggataaatgtatttaacagaaaatatccatcttataagtaatgtttcccccaaatacaatgaggtccatttaaatgaatgtctgaaataaaaataatcctaatgatagatctaatgcactttgtatcagacccattgagtttctttaaactctattcaataaatgcctgattaataaataatcctgttaaatgaataaaaccccagtgtgccaaacggagacatacaaagcaatcatgatcagacttgttatgggagaatgatagatgaataaatctactgtgcaattaatttatgactgaactatgatgaaatcccagtggcaatactaaatctgttagaggaatagatttatcatcttctttcaaacaattacattccaggaactttacaaaaatactattatctgaatcttatcataatagagatatctgttcatttacatggggaagaattccttctgtgccgtcagagctaaattagtgtttattatttttgatgctaaccaaaacagaaacaatataggacagaaactactaatgtggttagctattcttatctgcttctgtttcttcaaacttgattaaaattgcctaatttttagacagtttttttgtttgaataattttactttttaaaagatgaaaagcaaacgaataaaaaacaggttataggctattttgaaagcaatctgtgttacttcataatgtggttacatgtaggttatgaaggcacaaatttggggaccatgttttaagaagatcattggggattggtagtatttcaggttattgttacatattttagcttcaaaagacagtcgactgtattttagtgctgtcgttcttttagacaggcacttattgataccaaaaaacaccacgaaaagtaaaaaggaaaacccaaaccacaagaaacattttgatttaaaggttagatagtctgaattcatgagaacttagattcagagcatggcaaggttaaaagaaattttattaggatcaagacacaaaccatgtttaatgcagtctttttgttttgggggaactagagctgatattttaaatctagtcgtttttaccaatgtaagggaatttaagagataaaatttgaatagaaaggtaagatttgtatagtgattacaaagatgtgacctttaacagagggttttgttgtgtttgttttccacataaaagaatgaagaatttgtgagggtgaggtaaaagagaaggggtctccttaaaacttgagagaaggaaagaatttgtcccattgtagcaatatttgaaaacaggttttattaaggttttaatatgtgttgaagtaaataattatgcaaattgaactagaaacttcttagtttaaatctagtctgctatttacagtgttagtagctggacatcatacttttttaaattaatgtaatattgataaatagcaatcctgtgtattctcttatttctcagacttaataacaaagactttataaatccacatatgtagtgggtttcagttgtttgcacgttattcatgaccaatattatgtacatagcattgttctaaggccttctttgatctgatcttgggtataaagaaacaaaaacaagccgggtgaggtggcctatgtttgtagtcccgggtgccctggagactgaggcaggaggattgcatgaactagggagttcgagaccagcctggtggcaacacagtgagaccctgtctctaaaaaataaaaattaaaaactaaaaaagagacaaaacaaataacagttattacttgcagagcttatacttgagatgatattaacatatgaaataacaaattcgaacactgacacatcactcatttgtgaactaccttcatgaattattaccaaaaatcctattttaaaatattttttatcatggtaaaacatatataatcttttacgtatcttaagtatacaattcagtggcactaagtatatttatgttgttgtgcaaccatcaccaccatccatctctagaactttttcatctccccagactgagactgtacccattaagcagtaattctacaatctccccttctcccagtccctggcagccaccattctacttttgtctctgtgaatttcttttttaaaaaatttaattcttttgtagagacaggttctccctgtgttgcccaggctggtcttaaactcctgggctcaagcaatcttcccatcatggcctcccaaagtgctgggattacaggcgtgagctgccatgcctaggctctatgaatttcatataagacgaatcatacagggtttgtcctttagtgaatgacttaattcacttgagataatggcatcaagattcatctgtgttgtaacgtgtcagaatttcattcctttttgaggctgaatattattctattgcatgtatatattaatactatattttgtcagtccatttattcattgatggacatttaggttatttccgtctgttggctgttacgagtaatgctgctgtggacacaggtgtacacatgtctgttggagtccctgctttaattttttggggtctatctctggaagtggaattggctgttatgagtaatgctgctatgttggctcttatgagtaatgctgctgtgttggctgttatgagtaacgctgctatggacacaggtgtacacatgtctactggagtccctgctttaattttttggggtctatctctggaagtggaattgctggatcatatggtaattttatgtttcattatttttaggaaccaccatagtgttttccacggtggctacatcgttttacattcccaccagcagagcacaagggttccaattgtatctcttgtggtttttgatttgcatttccctaatgattaggaatgttaatcttttcatgtgctgtttggccgtctatatcttagtaatagtaatcttttcgtgtgctgctattactgttagtaatagtaatcttttcatgtgctgctattagtaaaagtaatcttttcatgtgctgtttggccgtctatatcttagtaatagtaatcttttcatgtgctgctattactgttagtaatagtaatcttttcatatgctgctattagtaatagtaatcttttcatgtgctgtttggccatctgtatattttctttggagatatgtctatccaagttctttgtccagttttcaatcaggttttttgttgttgagttgtaggagttctttataatattatgagtagtaatgtcttgttagatatatgatttgcaaatattttctcccttcctataggttgctttttcactctgtttttttttagtgtatattatcttttatttacctatgtagtgactttaatcagtgctcattatttctttgtgtggattccattcattctgttgataatgtcttctgatggacaaaagtttttaattttgatgaagtttgattttttaattttcttactgcctgtgcttttggtgtcatatatagttttcattttgtagtttcctttaagtcttctggcttttgtgttttgttagggaggccatctacatcataagattataaaaatattctctgaaattttcttcaaatactattgtaatttttttaaacatttggttctataatctcatctggaatttagttttgtgtatgatgtgaggtaaaattccaaatttattttttctatgtggatattcatttgttcaaaccaaatgtattagtttattttttcttcactgttctgaaatacaacctctaccatatactgtatccacatatgtaagtatgtctatttctgaatactctattatgtctcactgatttgtgagtttctgctttaattattttatagttatgttttgatttctgatagggcaggtcccttctgattattctctgtaaattttttcttgagtgtttttatttattcttccagatgaacgtttgaatctacatattggatttttagaaatacagtagtatattacagtttacccaggatttgttttaatcaggtttggtaagacatgcagacgtggacataattatcatgaaggaaatgtttagacttatatatccctagaaacggctattatacaatgccactcagagccacatggggaagaccaagattgggcaagaggcagaaccagggagcatggcccagtgcctttattggggttttcacaggatcgaatgggtgaggtagggtaggtatgttgaataagtttaggattggagagtttgagtaattttggtgggctctgggttatagctgcggcccctaattatctgatatctagccctaggcagatttaggctggcaggaatattggcttggtgtgtgagagttagttacaggagatggttggggatgtgtggtctggattggttgacttaaatatcaaaggtgcacttgcaaagaaatcctttgtcttctctaggaattagctagccctgagaggggcaatctaagatgaagactccaaaatgccagagtatcaagaatacagggggaaaaaaaagtcaaaacaagctatgattttttttttttgactgaggttgcgttgacttatagagtaatttgataatgaaatgacatcattactacagagtgctcccatctaggaaaatgatatgtcttattaattaattaattaattaattgagatggagtctagctctgtctgccaggctagagtgcagtggcgcggtctcggctcacagcaacctccatctcccaggttcaagcaattctcctgcctcagccttccaagtagctgggactacaggcatgagccaccacgcccagctaactggctattttttcgtttttgtatttttagtagagaccaggttttaccctgttggccacactggtctcgaactcctgacctcaaatgatccacccaccttagcctcccaaagtgctgggattacattgtgagccaccatgcctggccatgtttctccttttatttattttttattttattttattttttgagacagagtctcactctgtcacccaggctggggtgcagtggcgcaatctcggctcactgcaacctccgtctcccggtttcaagtgattctcctgcctcggtctcctgagtagctggaattacaggcacataccaccactctcggctaatttttgtatttttagtagagatggggttttgtcatgttggccaggctgatcttgaactcccgacctcaagtcatcctcccacctcggtatcccaaaatgctgagattacaggcatgagccaccacgcccagcccttctccatttatttagatattcttttatattttcagtaacattgcatatttttcttcacataggtcttgcccattgttgttattcttataaatattcctaagatttttatcgctattctttttttctgtatggctttaccaaacatgacacccttacagatcttgttcaatattcaatcattcatttattttcccagaaaatatttgttgccaggtgcattggctcacgcctgtaatctcagcactatgggagactgaggtaggtggatctcttgagctcaggagtttgataccagccttggcaacatggcgaaaccccatctctctactaataatgcaaaaattagcttggcattagtaccagctattcaggaggctgaggtgggaggattgcttgagcttcggaggtcaagactgcagtcagccatgtaactgcaccactacactccagtctcggtgacggtgagaccctgtctcaaaaaaatttaaaaaattgttaagtgcttgtaaagtatgagtgagactctaaggtagccactaggcagtccccttcctagtgacttattatatcctgatctgggaaatgttgaacatagagagggcacaggtggtgaaactggtctcagagaagttgagaaaacatgggttcaagaacgcaggtgggaggctgggtgcagtggctcacgcctgcaatcccagcactttgggaggccgaggtgggcagatcacctgaggtcaggagttcgagaccagcctggctaacatggtgaaaccccatttctattaaaaatacaataaattagccaggcgtggtggcacatgcctgtaatcccagctactcaggaggctgaggcaggagaattgcttgaacccaggaagcagaggttgcagtgagccgagattgcgtcattgcactccagcttgggcaacaagagtgaaactctgtctaaaaaaaaaaaaaaaaaaagaaaagaaaaagaaagaacacaggtgggagaaaggagaaacagaagcaaaggaagacacagggaatctgaagtagagtatagaagttgtgagacatagtgttcagtagcctcaatatatttcaataacttgggaagcagtcatctgctaaaaatgagagggcagggacaagtcttcctggtggagaataatttgttgtaataaaagcagcttgttagattacatgagggtccagcgtgaatgtgatcagtggtcaaagtcaatgtgattttgtgacttacactgatagcattcagcaaccacaggagtaggtgaggacagtgtggttggtgagattattcaggtctgaggagtggcatgttaggattagtgagagaaaggtcaaaaataaaagtaagtgtgctgtggaggctagagtgctaccatttgctcagaaatagcctcacttgcacagttttaaaaatgcaactcaaaagataattattgacaattaaatagccccatggcttcaacactaatcataacaaaacaaaaatactgcaaggaatgttcattcattccatttttgtggaaagaatacctgtgttagatgctggaactgttttcaaggagctcatttctaaaaaatttactttcttggaccatttatccaaagaagaaatgccgtttcttcaaagatgtgtgtttttcaaatctgcactatcttctgtaagcattctggttaaataattccccaggataggaaagtcactttgatgctggttgtacaagggaaatgccatgaattcccagatgcttttaaaatacaggtgggttataaagacaaaggtgatgcaacttgttgaatgtctcatttttaaattataactttcaaaggagtgaaggacttgccatcccaaaatatgtcaaactggcatattaattattttgaaaacattggagaaattgtagtttcagaaaggggtagctgacctgcatgcagcaagccataaagcttcttctgtggctcatgcctgtaatctcagcacttcgggaggccaaggcaggaagatcgtttaagtttaggcattagagaccagcctaggcaacatgatgagaccccatctctacaaaaaatatggaaattagccaggtgtggtagtacatgcctatagtggcagctacctgggaggctgagatgggaggatcatctgagtctgagaggtccaggctgcagtgatctatgatcacaccactgcactccagcctgagagacagagtgagaccctgtctcaaaaaaaatgaaagaaagaaaggacggggagggggagagagagggagagggagagggagacagagagggagagggagacggagagggagagggagatggagagggagaatattcctttggacgagatcctccctttactagagccaggaaatagctcttatcaaccagaggctgggaacagggggctgcagtggacccaattaaatatattttccaaagtaacccttatcttctactagttttacaccccgcttgtatctcctagtgactcccctaggaatttattgcccgtagacagatcgcctttgtcctatcatttcttcttaagtttattattcttcatccaaaaagtataaaagcatcttgctttggccacttcttcagacttcactctcttgtgaagatccccatgtacatgtaaaactaataaaatgtgtatgcttttctcttgtaaatctgccttgtgtcaatttggtttctagatccagctgaagggcccacatgagagctcaggcgggttggaggtgatctctcattacctacacgttatataaattcagcataggaataatggttgagggtaaattaacattgttaaaaagaatacaccgtaacataaagtactttaacatttataatatgagaccatttattaaagaaaataccattatataataatgaggctaataatttcatatggaaataatactgtattaattcgatgtattcatactaacagtgaacatgatattttaaattttgctgtcacataattatgctgctgctttatgaaatgttatactgtcacctagaaaaacccttatttgagtgtagatctgcgatcttcagcctcatatggcaggttgtaatgtgttactgaggtatttttaagtgaagaggtgggaaaaactcctggctgagtcataaaactgaggattctttctttcctaatctgcctggagcaaagctgtctaggctaacactggcctttagcaaagaactgaaacactttcctagttctacaaggcaaattgggtaatgggatgtggtattgggtaatgggatgtggtgttaagtttggaatgaggagatatcttagggttgtgagtcatggtccgtattatttttaagttgttgcttaaaaataaaaaagcaacaaaaagcaatcaaagggaaagtgagagttagaagaagttgaagaccaaataattttgtactagtcagtaaatagtagtattgtgactacaaatgactatttggtacaggcatcttaactcctcagctctgttagcactgattaaaagtgaaaaagttgattcattgtgtattggaataaataatgtctcaaagtttacgcagtggtggaagtgaaaccaaaatacaaagctccatttgtgactgaagtttgctaacatttcaagaagtaggttgaagtgacagtgggtaataggaaaagcagacatatttctttgccatgagattttatagctgtcattggcagtgtgttttcttaaactgatatcagctaccatttatacacttaacaatttctggtcagattagggcagaaggttgtggtacccacatatataaaatagtataataatgttctattttttttttggaacaaatttgttacatgaaatgtcagatgagtcattttgctcatgtcaggtatttaaaagtaatggaaagatgccaacatggaagcccagtaattcatgcgctggtgtaatggagcaaatgaaatgcaaagctcttgtacaggtccaatttcagcaccaaacgcttacctgtcagtcagcaaaattgtccctgaataaaaatgaaccccatctgagaggcaaagcattttaatgtacatcacattctttgactctattgcgaggtagaagctgcatggaaagaaagagaatgctgttgaaaaagacatttaacagcaacctctgagcatgctgaaaatctcactcgcattactgcccacaaaaggtttttggtttgccctttctctcctgagctattgacaaactcttgagcattgctgccctccccggctctgtgtctcttatctacatggaaaggcagctgatttactccagacagtgagagatttggccactcagggatgtggagaccaagttttagacaggtaactttattgctgcctgggtgcagctgggggatgtatttatggacgtgacaattaaaagtgtgtgttgcacaaatcgaaagtcagacatacccttgtataaatgattattgtggtccaaagtgactgccatttcttttggaaagcctttcatttggaatcagttcccagttttctatatgagcaagcatcttacagaaatgaggtgtcctagttttttttagacccaattcctgtggtttttaaaaagcaaatgggaaagttaagaatttgtgtgcttcagtgcccacgcacccagggattcttgtaccctacctctaggagtcatgatttgttctacctttgaaatgtctgttttccatttctgtgttttaagactctaagtgcttataggaacccaagcagctattgaaaaccagtaatgactagttcttctaaatgctaatgattgagaatgaactagcaatcagggctcaaaaataaaataaaataaaataaagtaaaataaaataaagtgtgctgaattagaaacgataataattaaatcaagccaaggtgccctatacttatgactgcactaatgcttgaaaaattatgagtacagagaaaatttacataaatcctctttaaatgatgtatgtgaaaaaaaagaaagaaggaaaaaccatggtcacaggactgaatttattttaatcccctggttcaagtggtcctagaaataatcatacttgtatcaatctatattgcatgacttttgtaagatgtgaaaatagtgtttttcactaaattgtcacttattattgttcatttagggccactaacatagaaaaatttctcagctacagtgtcaaaagaatagggacaatttgatgttttcttttgatgctgtttgttgatatctagaccactgtagcttgattgcctaacattaaacctataataacagtgcaatcatagcagtatcatcatgaatgttgttacaatagaaacaacatttacacggcttcagaatggtaattatcaaactttttgtcatgaagcgcttatttgctagcattgatctgccccggtcagttgttagctcttctcatctgaggtgtattgattgtataatcagtagatagaggctgtgggcagatgaaattcagtgttgttgggcaaattatcggctgcttgcctgttgacctggaccctgctggttgtaccttagatgctggtgggattattactcatttcagtgaccctactttatgacagagcactctgtattattataaaagataaatgccatcctgcttgctgtggttgtggttgactacacaaatgtcagaatatagctagtctgcaaactaggcagtgcaagtatgtttccgatgagatcaaaaggagaaattttcaaagattaccttttctgaatttgtctctttgtaagaatgtaataacaaaaagcctatgtgtatctagctgatgataataatgaaacctttatgtatatagctgtttatcatgtgctaaggattatgacaaatcacttaatattttgttttaccagcaagaacactgaagccgacattaagctaagcaaatgggctaagatcacatgtcaatgagcagtagagcttggaattaaatctgtttcttctgaatacaagtcaagtttgttatattctactgctctgtcttattaggttatccaggctgaccattaaatatgtgtatactgacagatctaaggtttcatccaactggattaaaaaataaagacctcaatgttacttaaataaattattgcattgggtaatttttgagactatttgagctattaaataattataacattccaaagcccaaggtctaacatgggattacttttatagacaaaatcattttatataaagagcactgtaaattttatagctggtggctgtttttaaaaaatctagatggtttttgccgggcgtggtggctcacgcctgtaatcccagcactttgggaggctgaggcgggtggatcacaaagtcaggagttcgagaccagcctggccaatatggtgaaaccccatctctactaaaagtacacatattagccaggcgtggtgccgcgcgcctgtagtcccagctatttgggaggctgaggcagatgaatcgcttgaaccatggaggcagaggttgcagtgagccaagatcgtgccgctgcactccaggctgggcaacaaagcgagactccgtctcaaaaacaaaaacaaaaactagatggttttaacagaatgttttgtttatatgaaaaaattctcaaacgttatttatgttaccatgtcctattttccttgtactttaggatcattctatccatcgtaggtaagtacaggatggcatcacatcctaatacctaaaccgggcctttctgaaactacatggaagaacagaaagaatgtctttagtctattttgacatttagattgcttcacaaatacatatatgtgaacttgacagtgttcacagtgtcatttttgctctttctctctgaaaagaaaagagcataaaaaggatgtacctcactaacagtgcaatgccataaaaatattaatgttttggtgctgatcattcaaattcccaaatagtaaaatagatgaagcgatacttaaacataattctccatttctaaatgcactcagttgtgcctggtaagctgtctcattctttctgccaacttctgggccattgttttataaaggtcagtggttacctgctcattgtattttaaaggcacactcacagcacatagtccaataagcaagtccagcaataccacattcctctttggtcttaaattctgcagctgttgaatcatgattgggcaatgattttttttcctcctagttaactactttatgttcttacttttaaaagactaagtgactgatctcttacccaaaatgttggaggagataatgggtggagtacatgaaagttacatgcagaggtggcttagagttgagatatttagtagtttccctctctgtgaataccagaaaacacagctgtttgagtactcccttaacattgcttacctaagcaggggaaataactaagaaagtgactcccagtttctagcattgtaagcttttcgagagaagcctaaatttgtgtgtatattcctttcctttatcttttggctgctgaaatacatactatcagcatagtatttcaacaaaaatgatgatcttttttggaaattcgaattgttctgatactccccacaaaaaacccttaaaatacatataatacataatagtcattatttgggtattgatcctattatactgttagctcttcacatctgacctattttagtatttcctgcattgctcactactatgctttgtgtatagaaggagctttattgattaaaatggactggatattcattcaacaagtatctattggatgcctactagctatgaggcatggtgggagccatcagatacagtaatcaatgagcaagacacacacacagtccctgctctcaaagagctcatgatgagaaagatgtaagacaggcattaagtgaccagttacataatttttaatgcaagttttaccttaatattatatgcttaaataaaattcaggatgttagaggattcttcaataagaaatcagatcaagtttatgcttctccaggacagggacctttaaaaatcaacacttaaaactcaattttttgcacttaaaaataaaatgaggctgaggaccatggctcaccctataatcccagcactttgggaggctgagacaagaaggtttcttaagaccaggagtttgagaccagcttaggctggtctcatagggagattctgtctctacaaaaaataaaaaaatagctgggcatggtggcacacgcctgtagtcctagctacttgggagggtgagggggaaggatggcttgagcccagaagttcaaggctgcagtgagctatgtttgagccacagcaccgcatcctgggcaacagatcaagaccctgtctctgaaaagaagaaagaaagaaaaaagaaggaaggaaggagacaaaaaataaaatgcacacattgcaagtgtacatttcaatgaatttagacaagtgtatacaaatatccatatgtgagtgaataggtagagatgagtatatatgtatgtataagcatatacatatataactgtatacatacccacacatcccctcattcaacatacaggatatttacatgacccagaaagcttcctttgtgctctttccttgagtacaactcatcattttccccaggctcctggattgtttttcgagtttcagataaatgaaatcacatagtatgtactctgtgtctgacttcttttgctcagcctgatgtttctgagatccatccatgttcttatgtgtatcactggtgttttccttattattactgattagcattttattttatagatacaccacaatttatttattcatttatccactgactgacaaaaataaaccttaatttattgctcataaggtaagatgaaagaagtggtacatttttatttatgagctgtgaaaatgtactagaggacctgggatattaccttatattcaccacatatgaatagtgttggcccacactgaagtaatttttatccccaaatgagctataaagacatgtcccacctgaaaaaacagtttcattgataatttatggataatataaaatgcttcctaagttgttgagtagaatgctgaactaacaggtaaaacactaaaattaatctgattctgtgtattgtgggctacttacagaatgcaacaattatttttggaattcaaattcaagtcaaaaaatatttatgaatgtctgctatacataaagcatggtattcagttctataaggcaatagaagataagcaagatggagttccttccttggaggtctagtggcctaaagtgggaaattgggtgtctgcatgaaataattaaaaaaaatagtaggccgggtgcggtggctcacacctgtaatcccagcactttgggaggctgaagcgggtggatcacgaggtcaggagatcaagactatcctggctaacgtggtgaaaccctgtctctactaaaaatacaaaaaaattatccgggcgtggtggtgggcgcctgtagtcccagctacttgggaggctgaggcaggagaatgacatgaacccacgaggcggaggttgcagtgagccgagatcgcaccactgcactccagcctgggtgacagagcgagactccgtctgaaaaaaaaaaaaatgtaaaaaggcttgttgattaaaccaaagtagttttagtgcccagctttttaaaaggggagtaaattatacctcctataagccagtcaagttaattttgatacctttaaagattctgcactagatgaaatcattgaacaatcaattagtcaccacataggagagcatgaagcactgggtagtcactgtcttggctttgcaaagagcaaattgtaccagatcgatttaatttccttcatgaagagattgacagtttatacatacatttaggaagcaattcagctgaacttcagaaaggattttgattcagccacacatgacattttagcactaactcaaaggatgtggtgtaggccagaccatattcctgtaggaagtggcctgcttctctggggggttatatttgaaaagtgttatgaagggcttagtgtcaaccatgaatcttgttttataaatacatatccaaatgctggagttattctgaatttctgtgtcatgcataaataattgaaaataaactcatatgttggcaaaggaaaaccttgatatgagtactctggaagattgttatagattaaatgaaatgatcttaaaccataaaagtgacaattgtgtactttatgaagggctgtaagatcaagttcaagtaacatgctatggtgatcctacgctttaccaaagatagatggaagatgggaacagctaggccataaataagacaagagacttaggagtcatagtggaattcaatccatatattgctgatcaattctgtgttattatttataaacaatgcataattttagagtgtgtaaaggggaatatgatttgcaagcatatggagcccaaaggtcgttactctgcaatagtcaattttaatcacaactctcagactgttctaattttacactacagggaagctagagggtccagagaaaaacattctaaatatacaagaagataaataaatgtttctttaaagttcagactagagaagagagaccactcttcaaatcgtacagaggtatgtacagaggtacgatttgcctattctgtttggaaacagaataggcagccttctgcccaaggtggcataggtgttaaaggcttggtttagtttaagggttccaaaatctgatagggtttcaggatcacttggatagaattttttgaaacacagctttattgaagtataattgatttgctatacattgcacgtatctcaagtgtacaatttgataagttttaacatatgtatatatatatatatgttaaaaggattccctatttaatgaaactattaccacaatcaaaataatgaacatatttatcacccccaaaagttttcccctgctcttttgtagtccttcctacccttccctaggcaaatattatctgctttctctcactatagattcattttcattttctagcatttatgtaaatagaagcaaacaaattgtattctttttcatcaggcttctttcactcagcataactattttgagcatgctttcactcagcataattatttatatttaattcttgcatattgtagtgtgtttgagtcttccattccttttttattgctgagtagtattctgttgtgtgcagttatatgcagtatatttatccatttatccattgatggacatttgggttgtttccagctttgggttattatatataaagctgttgtgacatttatgtagaatcttttatttagacatatgctcttatttttctagagtaaatacataggagtagaaatgcttagatcatgtggtaggtatatgtttaacttttaaagaaactgccaaactgttttccagaggggtggttctattttacattgccagcagcagcatgggaaaggtctgtcaacacttggttggtgagtcctttccattttagtcattctagtagatgtattagaatctcattgtggttttaatttaaacttctcaaatgatcatcttttcattgcttatttgtcatctatgtatcttctttggttgagtgtgtattcaggattttttttgcccactgttaaatttgataatttgttttcttgttattgaattttgagaattctttattctgaatacaagtcctttagcagattctgatgagaactgcattgaatcaatagcttaatttgggaagaagtgacttcttaacaatactgagtcttctaatcaatggacatggcagattttgctgttattttaaattttaaacttctttcagcaatattttgcaattttcaaagtacaggttttacatatcttttgtcagatttacccctaagaattgtatattttttaatgctattgtaaattttatttaaaaaatttttagctctccctctccctccccctccccctccccctgtccctctccctctccgtctccctctctctccacggtctccttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttccttttttttttttggtggagacggggttttgctgtgttggccgggctggtctcagctcctgaccgcgagtgatccgccagcctcggcctcccgaggtgctgggattgcagacggagtctcgttcactcagtgctcaatggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggtcccccatcgtctgggatatgaggagcctctctgcctggctgcccagtctggaaagtgaggagcgtctctgcccggccgccatcccatctaggaagcgaggagcgcctcttccccgccgcccatcgtctgagatgtggggagcgcctctgccccgccgccctgtctgggatgtgaggagcacctctgctgggccgcaaccctgtctgggatgtgaggagcgcctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggagggggggggtcagccccccgcccggccagccgccccgtccgggaggggaggggctcctctgcccggccgcgcctactgggaagtgaggagcccctctgcccggccagccgccccgtccgggaggggggggtcaggcccctgcccggccagccgccccgtccggagggaggtgggggggtcagactccctcccggccggccgccccgtccgggaggtgaggggcgcctctgcccggccgcccctaccgggaagtgaggacccctctgcccggccagccgccccgtccaggagggaggtggggggtcagccccccgcccggccagccgcccagtccgggagggaggtggggggtcagccccccgcccggccagccgcccagtccgggagggaggtggggggatcagccccccgcctggccagccgccccgtccgggaggtgaggggcgcctctgcccggctgcccctactgggaagtgaggaccccactgcccggccagccgccccgtccgggagggaggtggggggggtcagccccccgcccggccagccgcccagtccgggagggaggtggggggtcagcccccgacccggccatccgccccgtccgggagggaggtggggggatcagccccccgcctggccagccgccccgtccgggaggtgaggggcgcctctgcccggctgcccattctgggagggaggtgggggggtcagccccccgcccggccggccgccccatccgggaggtgaggggcgcctctgcccggccgcccctactgggaagtgaggagcccctctgcctggcgagccgccccgtctgggagggtggtgggggggtcagccccccgcctggccagccgccctatccaggaggtgaggggcgcctctgcccggccgcccctactgggaagtgaggagcccctctgcctggccagccgccccgtccgggagggtggtgggggggtcagccccccgcctggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttacatggattaaaggcggtgcaagatgtgctttgttaaacagatgcttgaagtcagcatgctcgttaagagtcgtgtcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaagaaaaaaaaaaaagaacgaaaaaaaaaaaattttaatttccaatagtttgttgctggtatatagaaatacaactgttatttgtgtattgaccttgtgtcctgcaacctcactcaacatacttgttagttctagtcagttttctgtacattccatcaaattttccacatggacggtcatgttgtctgctaatattgacattcctttcccatctagatgccttttatttcttttcttcccatactgcattggctagaacctctagtatagtgtttaatagaagcagcaacagagaatatctatgtctatgggggatattggtctgtagtcttctctttgtctttgtctggtttttgtattggagtaatgctttcttcattaagtaagtcagaaaatattcttccttttcagttttctcaaagagtttgagaaagaattggtgttatttctccttcaatatttggtagaattcaccagtaagccagctaggcctagaattttctttgtgggaaagtttttaaactacaaatttctgactttttaatgattgccattctatctggcgtgagatggtatctcattgtggttttgatttgcatttctctgatggccagtgatggtgagcattttttcatgtgttttttggctgcataaatgtcttcctttgagaagtgtctgttcatgtccttcacccactttttgatggggttgtttgtttttttcttgcaaatttgagttcattgtatattctggatattagccctttgtcagatgagtaggttgtgaaaattttctcccattttatgggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggagtcctttccccattgcttatttttctcaggtttgtcaaagatcagatagttgtagatatgtggcgttatttctgagggctgtgtcctgttccattgatctatatctctgttttggtaccagtaccgtgctgttttggttactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggttggcattgaatctataaattaccttgggcagtatgaccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagtaaagacttggaaccaacccaaatgtccaacagtgatagactggattaagaaaatgtggcacatatacaccatggaatactatgcagccataaaaaatgatgagttcatgtcctttgtaggaacatggatgaaattggaaatcatcattctcagtaaagtatcacaagaacaaaaaaccaaacaccgcatattctcactcataggtgggaattgagcaatgagaacacatggacacaggaaggggaacatcacactctggggactgttgtggggtggggggaagggggagggatagcattaggagatacacctaatgctaaatgacgagttaatgggtgcagcacaccagcatggcacatgtatacatatgtaactaacctgaatattgtgcacatgtaccctaaaacttaaagtataataataataataaataaataaataaactacgaattcattttttttatgggtactgcaatattcaggttatttcttcttgaataatctttgatagttggtgtctttcaaagaacttgtgccttccatttcatctaagttgtcaaacttactggcataatgttatttataattttcctttattatctttttaccatctatagaatctatagtgatgccatctttcttatttcttacattggtcatttttgtcttttctatagctgtcttggttatcagattaatggtcctcagtgcttgggttcaagtaacccttattttacttaataatggccccaaagtgcaagaccaacgatgctggcatattgttataattgttctgttttattatgttattattgttaatctcttatactatgcctaatttttaaagtaaactttatcataggtatgtaagtataggaaaaaacatagtatatacagggttcagtcctatctgcgatttcaggcatccactaggaccttggcttgtatcccccaaggataagggaggactactgtactttgtgatcagagaacatattttgcatggcttaaatctttttaagtgtattgttttgtggcctagaatatggtctagcttggtaaagcttcaactggcatttcagaatactgtattcagctctattgggtggtgtgttctataaatgtcaattaagttggttggtaatgttattcaagccttctatgtccttactggtttctgtatacttgttatatcaattataacatgttaaaatctctgactataatgataagtatttataataaatattcttgagttttgttttgtgaagcagatgtgttactgggaaacagcttgatcctttcagatcttgcttttaagatttgttaggtgggaccagcaatatttatgtagggcaaatttttccacaccactgaggcaaaactcttttgtgtactcaactcaatgttcaatgcattaagaagtttttcttgtcagactggcagaaacatgcacaatttccagttctttgtgaacactggatactatttcctttaatcctttctgataggtctttccctggcctcctgtagttttctcagatacatgtgcttatcaatactctgatgaatactcaaagggaggcatttttcagatatgctgggttctaactctttgcagctctgtactctctgatactctgtcctttgaactctagccacattgttttttccagactttcaactctggtactctgcagggctccatttgggttccctgtcccaatgccacagcccggaatctctcttaaacttgagataattgttggactcactcacctcatttgtattctgtctcccagggataactgtccttcctgcctcctgcccactgtcttgaataccatagtttcatttattatatttgatttgtagttgttttaggtgagggagtaaatctagtcactgttgctccaacttgaataaaagcagaagtctccctggggaatttttgaaaaagacaacttcctttttttttttttttttgaggcggaattttgatctttttgcccaggctggagtgcaatggcgtgatctcagctcaccacaacctctgcctcccgggttcaagcgattctcctgcctcagcctcccaagtagctgggactacaggcatgtaccaccacgcctggctaatttggtatttttagtagggatggggtttctctgtgttggtcaggctggtctcgaactccccacctcaggtgatctgcccacctcagcctccaaaagtgctgggattacaggcgtgagccaccatgcctggcaattgctacaaagagaataaaatacctaggaatacaacttacaagggttgtgaaggacctctgcaaggagaactacaaatcactgctcaaggaaatgagaggacacaaacaaatggaaaaacattccatgctcatggataggaagagtcaatattgtgaaaatggccatactgcccgaagtaatttataaattcaatgctatccccatcaagctaccattgactttcttcacagaattggaaaaaactactttaaatttcatatggaaccaaaaaagagcccgtatagccaagacaatcctaagcaaaaagaacaaagctggaagcatcacgctacctgacttcaaactacgctacaaggctgcagtaaccaaaacagcatggtactggtaccaaaacagatatatagaccaatggaacaaaacagaggcctcagaaataacaccacacatctaaaaccatctgatctttgacaaacctgacagaaacaagcaatggggaaaggattccctatttaataaatggtgctgggaaaactggctagccatatgcaggaagctgaaactggatcccttccttacaccttagacaaaaattaactcaagatggattaaagacttaaatgtaagacctaaaaccataaaaaccctagaagaaaacctaggcaatgccattcaggacataggcatgggcaaagactttatgactaaaacaccaaaagcaatggcaacaaaatccaaaattgacaagtgggatctaattaaatgaaagagcttctgcacagcaaaagaaactatcatcagagtgaacaggcaacctacaaaatgggagaaaacttttgcaatctatccatctgacaaaggggtgatatccagaatctacaaagaacttaaatttacaagaaaaaaacaaccccatcaaaaagtgggtgaaggatatgaacggacgcctgtcaaaagaagacgtttatgcagccagcaaacatgaaaaaagctcatcatcactgttcattagagaaatgcaaatcaaaaccgcaatgagataccatctcatgccagttagaatggtgatcattaaaaagtcaggaaacaacagatgctggagaggatgtggagaaataggaacacttttacactgttggtgggagggtaaattagttcaaccattgtggaagacagtgtggcaattcaccaaggatctggtactagaaataccatttgacccagcaatcccgttactgggtatatacccaaaggattataaatgaactcccgaccgcaggtgatctgcccgcctcagcgtccaaagtgctgggattacaggcgtgagccaccatgcctggcaattgctacaaagagaataaaatacctaggaatacaacttataaggacctcttcaaggagagctacaaaccactgctcaaggaaataaaagaggacacaaacaaatggaaaaacattgcatgctcatggataggaagaatcaatattgtgaaaatgaccatactgcccaaagtaatttatagattcagtgctatccccatgaagctaccattgactttcttcacagaattggaaaaagctactttaaagtttaaaaaactactataaagacacatgcacatgtatgtttattgcggcactgttcacaatagcaaagacttggaaccaacctaaatgcccatgaatcatagactggataaatgaaatgtggcacatatacaccatggaatagtatgcagctgtaaaaaaggatgaattcatgtcctttgcagggacatggatgaagctggaaaccatcattctcagcaaactaacacaagaagagaaaaccaaacactgcatgttctcactcgtaagtgggagctgaacaatgagaacacatgaacatggggctgggggggcatcacacactggggcctgatgggaggtgggggactgggggaggagtagcattaggagaaatacctaatgtagatgatgggttgatgggtgcagcaaaccaccatggcacgtatatacctatgtaacaaacctgcatgttctgcacatgtaccccagaacttataatttaaaaaaaaaaaaagaaagaaaaagacgaattcttggctggacacagtggctcacacctgtaatccaagcactttgggaggacgaggtaggtggatcacttcaggtcaggagttcgagaccagcctggccaacatggtgaaaccctgtctctaccaaaaaatacaaaaattagctggcgtggtggtatgtgcctgtagtcccagctacttgggaggctgagatgggagaattgcttaaaccctggaggcggaggttgcaatgaactaaacatgtgccactgcactccaggctgggtaacagagcgagactctgtctcaaaaaaagaaaaaagaaaaaaaagaaaagaaagaaaaagacaaattcttacatccatcacagacctactgaaacccagtctgtggatgaatccagaaatctctaacaagccccccatctgattctgtagtacacacattttagaaccactgatttgatcaaatgtaatctcttaaagtccagtccaattcatcaagcagccaaggcagtggcatctctcaagagacaatgaggtcatgatcagtttctcagtttcaactttgaattgtgcttgcatcatcacagacctacaccagtgaaccgtggaaatctcaccccgagaaaatcccaggcaaaaaactctgtcaggagactactggttataaaaattctaaggtttactcagtcattaaaattatgcatatataatagattcctttctattttcattgccaacagaaaattgaacatttgcttcaaccttcatgaaatcaaaacttagagaaaaacgatctttttataaggaaaatgagttattccatgttactaattagatcttagctgttaaattttggaatgattaaaatccttttcaataattgcaaaatttgctttgataaagtcaccctagaagttgattatgcagtgtagtttcaagttcgtcatgttgtcttcttggggacagctttctgtctgggggtgtcagtagtggcaatcccctaagtgcatgatggttgttgggttgatgtagccacaaaagatttgataaactgtgatatgactgcttttatacaggtccaacttccacatagactagttaactctctatataactaagttccgtccttggcagatggattaatttgtgaataatgaatttcccttagctacctccatacttccattttggtttactaaatatagaatcatttaagaaatctgtccataattatttccagtgaatccacaattaataataacatcagccagtgatataccaacttacacagggagcatgtcacattctgaactctttgtcaatcctaatttacattccagtgaaaatgtggtagatggtgtgtaagtatgcatattataatccctttagctcagaggttcttaacccttgctgtgtcatgagcccctttggtatcttgtgattctgcttatggatcccttctcaaaataatgttacaagtgtgttaaataaaatccaaaaagcaattacattgaaatacagttatcaaaatatgtttaaaatacaattgtggtatagtaacatatatgcttccttattattttttgtttgtttgtttgtttgtctgttttgagatggagtcttgctcttcacctgggctggagtgcagtggtgcgatctcagctcactgcaaccttcacctccctggttcaagcgattctcctgcctcagcctcctgagtagctgggattacaggcatgcaccaccaccctgggctaatttttgtgtttttagtagagacggggtttcaccatgttggtcaggctggtctcgaactcctgaccttttgatccacctgcctcggcctcccaaattgctgggattacaggtgtgagccaccgcacccagcctatgcttccttattaatgccataaaataataagatctagttgtagctctaataatgattataatttttcattaagaatgagctactaaatatcatttccaaacaaacaatgacaaaaattataatgttagatgaaaatattactgttcatagcctacacttgtaatataaggaaatgctaaatttggttagtttagtaaaaataagaatattttttccttgcaagttcatggaccccctgaattctttctatgaatcctaagaacctctgccttccttctgttaatttttaatgaaaatttagattttagtcacaaaaaccaagttatgcaaaaatagattatgaaggaatatgggagaaaagaaatgaagttccagttttctcgtggaattggttgaaaggctttattcaacattaagatatatacactgtgcattttttttactttccattacttcctgctggaattagcattgtcctcttcaatgagtcactaatgaacagcctgacaagtatgacttaatcatacagcacttttagtctatgaaacctacttagaatgttagcacaaagtagaaatacaatgattaaaggagaaacttatatactataatgaaatcttagctcagaagaacctaatttgcagcaagcttaggacctttaaaatcagaagtcctttgggtcttgtcttagcaacttacttgttaaaggctctgggtggggaggtggttgtgaggcgatataagaaaatgaaaagaaggaataaataaagtcatggtttcacaatgtgaagttcaaaaaggctatataccatcacaggtgttcagtacatataccaaacctcatatttacaagttgctaactggaattgcatgattagattgagtaatcacacgtgtcggtaaaaagctgtaattacctaagaaaagcatagcatttttgtctgtgcagggctcacctatttcgtatgtctttaaaactttgaccaattataaatcttttagcaaggtagagagtaaaatcctatattttctgtggatgttgacacatgtaagttcctgatcattatttattaaacaattagctttaacatgtaagatggaatgggaaaaacatttaaacctaatgtgaattgcctaggtatgagaagccttagaactttgttagaaatttctgttttccatttctcaaatactgtgaccataactcatagtttatttataaatagaaagtgacacttcataatacctggcagctttcaaaactagattatatctgtctttgcctgaagggctccagtaacactattgtacaatattttcttctgaccatctggcagttcttaggaaccaacctctgtcaacattttatagctactgcactggttacagctaatcctttcaatgaatgagctggaaaaaatgtagatacatcaatatcgttttcctttagagcccatttaatacatgccctgttattattttgtttgatagggccattatcttctgtgagaatgaaaagtaatttgtcagaagcatttttttaaatttaaagatcaatctatgtaaatttttcttaaataaaagaaaccacagctttttaaaaaaagaacctcaaacataatcattaagagtctcagaaatgggaacttagggcttagattccacaaacatttttagctattattttctaatctgggttctaacatgtttagtctaataaccaagcctggattgggctatttctgagaggattttatgttaacagtggagttgacaccttggcaaggtttaaaaaaaaaaaaaaagtgtatgtttctcttgttgtttgctttaagaaactaggaagcaattcattccaatgtgggaatttttatgaatttttcttcaaaacgatttggtactctatggactttgaataactaatgattttaaagtactttattttgcagtttatgaataaaagttgtggaaactttccaatgttctcattctaacctatctttacttcataaaaacccatgttggttgaataattttcttagaaaggctgttagttatttctgtattctgaaatttacatttatcattgaattgaaatgggaaaagatattgatctttttttcagattcagagtttaaaactctgctcataataacagatgataaaagagattctcctcagcttcaccattccattacataccaccactatcatgagaccaagatttttttttttatttttgatttttgtgacagagtgtcgctctgttgcccagtctggagtccagtggcaccatcatagctcactacaccctcaaactcctgggctcaggtgatcctcccacctcagccttccgagtagctgggactacaggtgcacaccagcacacccagctaatttttgtatttttggtagagagacagggttttgccatgttgctaaggctggtttcaaactcctgggctcaagccatccttcgacctcagcctcccaagcactgggattacagatgtaagccatggtgcctggccaagatcaagtttttgacagaaaccttttctctgtaaatgttttgcactttcatatttaggtacctcaacttgggcaaggttgttcagttaacatatacagatacagacacacacgcatatgtgtctgtgcacacaaactgttcctaggttgttagatgaaattggtttgttattcctatagttttttggtatcaaaattaatgtttaaaatttctttagagagttttatggtgacttttagaaaatgttttccctttcttttctatcagatggagattaaaactactacaattatagtacaatgttgagtagactcgggaatttatgtaagatgtggctaacaattttgataactgtacattagagtgtgtcaagacaatgaggcttctttgatattgtcttttcttcttctaattaccaggtttctgtcatatcctaaatttagggagggaataatattcatctccaaattaagtataacatctagctatattttgatactttttagttgatacatataatataaccaatatcagttaaaaagtaccaaaatatagccagatgttttacttaatatatataaaggtatgccattactcttttagaaaaagtcatatggtggctcacgcctgtaatcccagcactttgggaggccaagatgggcagatcacctgaggtgaggagtttgagaccagcctgaccaacatggagaaaccccatctctactaaaaatacaaaattagccaggcatggtggtacatgcctctaattccagctactcgggaggctgaggcaggagaattgcttgaaccctggaggcggaggttgcggtgagccaagattgcgccattgcactccagcctgggcaacaagagtgaaactctgtctcaaaaaaataatgataattaataaataaataataaataacaaaattttaaaaaatcataaaattggaagaaacctaaagaggtcgctagtataatttattttcttggagatactatgtttctggtaagaggaaagctatagcctctgttctcacatgtagtgacttttgttatcaaataattccatataggtaaataaactctttcttactattctctaaattccattcattattttatttttttcttgctctaagacattgaatacctttgtttttttaagttatttttaaaaccagaagatttaaacttaatattaaacatttcctctcaattctcttaattactttttaatttttcctactaagaaggacagtttggaaaacacaaagctaaaaggaaaagtaatcatgattccatgtctagaggtaatagcttaacatatgtcctttgattgttttttctctatatctgtactttttaagttgtgttttacaaaaatgataccatattgcatatgctatattgtagtctgctttttaaaaatatatttatttatttatttatttgagacagggtctcactctgtcacccaggctggagtgtagtggtgccatctcagttcactgcaacctccacctttcaggctcaagcgatcctcccacctcagcctctctagtagctgggactacaggtgcacacccccacacctggctgatttttgtgttttttgtagagatggggtttcaccatgttgcccagtctcgaactcctgagctctagctcccaaagtgctggtattagaagcatgagccaccatgcctggccctgcttttagaaaatttattagccaattttgataataaacattcctccacctattatttttaatgactacctagtattctatagtgtgaatgcaccataatttactcaacctgttttccaacatttttattaagagaacaacaaaaatgttaaaataattttatagtaaacacacatatatccaccatttagattttacaactaacatcttattatacttgctattagtctgttctcacactgctctaaagaactacctgagactgggtaatttatgaagaaaagagatttaattgactcacagttccacaagcttaacaggaagtatgactgggaggcttcaggaaacttacaatcatggcggaaagtgaaggggaagcaagcacgtcttactacggcagagctggagagagagagaacaagggaggaagtgccacactttaaactatcagatctcatgagaactccctcacaaacatgagaatagcatgaggaaaattcgcatccacgatccagtgacctcccaccaggtccctcccctgacacctggggattacaattcgacatgagatttgggtggggacacagagacaaatcgtatcacctgttttatcacataccagtcaaactagctatctctccattattttttgtgtattgccaagtaagtggtagtcattagtatattcctctcacccaagtatttaagcatcattaaccagagttcagtatgtgcttatgtacccaacctatatatacacacacacacacatatatagatacacacacatatatatatgtgtttatatatatctttgttttttgagacagagacttgctttgtcacccaggctggagtgcagcagcatgatcttggctcactgcagcctctgcctcctggcttcaagcaattctcgtgcctcagcctcctgagtagctgggattacgacatgtgccaccacacctggctaatattttgtatttttttagtagagacagggtttcaccatgttggccaggctggtcttgaactcctggcctcaagtgatccacccaccttggcctcccaaagtgctgagattacaggcatgagccaccaactggacccccaacctatattttaaaggattcttttacatttattaattatacatatttattaatataactggatcagctatatattgccacacaacaaaataccccaaaatttagtggctgaaaacaaacaaatactttatttgcttttgattctgtgggtcagcaacataggctaaggtcagctgagtgatttttctgcttacttcactagagtttttcatgcaataatagtcatctggccattccaccaaggctggatggagaaagatggtctcacttgataaattcctggaattggagttacttaataaaaaggtatacatacacatagtcaaattgccctctttaattatttaaaatgtattcccctgccccagattctatttgcattctttcaattcaaagtcagtaattttttgagatgctggctggattcattttaatgaatatattgagtatctcttggctaggtattgagaaggatacaagagaaagaaatacaagatattgactgttcttcaggaatttataatctagttgtgtagataacaccaacactaataagatggtcaaactgaattataagacctggtacagttgtcaaattgcttacctctttctcctcttctcacaggacaggctatgttaattacttgacatctaataagtattcagtaaataattgtttagtgtttatcactgaatttaagagaagctctgagttaaagtcctctagatgaggggttttgttaaagaggtgggccttgatatggcccttgaattagaggtacaatttagaattagatcaaggaaaggaatacagatttagtaatcattttcttaaaatctgttttattttgtatgtatggctagaaattacttttcttgtttgtttactataaacacaagactatctgctaaatatttccctactgagttcataactaagattgccaaagtgcttgtttcactaccatattttaatttctgaccatcctttatcatacaaggtgtgactagaagggaaacaaccaattttctcaaacaaattcagaaacccttatctgaaaaccccatgtagtagggtaattcagagtcggaagattttcaacatattggaggaaatagttaagggagggttgtgggtataagcaaacctatgaaagccaatctggttttttttttttttttaacatttttaaagtaaaatatcaatttgggcaccctaaatacacatagtaaaatagttacaatgagattctgaaccattaatatacatttactattttttcactgtaaactttcaggatctccatcttccttgatttccactctatgcttagaagttcaggttgccttgttgctgagggtgcttatactaaaggtttttgcttttttcctgaatgtaattgtcagtcctccaggaaattttatgacacagagttgttgacttccattatctgattcccactatggtctcagagtcaaagaaaactgaacaaataggctgtttgtggctcactttcgttaaccaacctgaacaagtatttctttctgcctatttcaacgtgttattttcccttagttccaaatggagtgccatcagtccctgatgaactgagataaaaagttgaggacatgcaattacaaggccctcatatactttttctcaccttctgtctgtcttccaaaaattcatggtaataattctgttctcttctcctttatttccctgctctttttcttaattatttgtgtaatagggagacaaaaactcttgaggatgaagaagccgtaaataaaagtgaatttcacttaaggggaaatcaaggttgagaaattattattatatagtggcacttatccatacagatgagtgttgccctcttcacattttttatcttagctcaactgtgctgctgttgctcaaagtatgtttttgttatggcctttacaaactgtagcacatttttttgaacatacttggtggtggcatgtctttcttgagggtgagttttgttttgtaaacaagttatctacaatcaaaattggtgattttggcagatggaatcacactgcataatatgtctacccatatacacgttcatatacacacaggtatatcatcacacatacataaagtaatgagaataactcagagtttgtatatcattgaaaaagtgtagtttcctaagtgtttggggacaacattttttatttttaagaatcaaaaagaactgaaagagccttggaggtcatttatttcaatacctcaaggaaactaagacacagaacaagaaaatgacttgtcaaagtctcatgggcagtgattgcgaactccttagatttcagtttctttgttgatgatcacatatcttgcttgtcctaattcctttgagagtgagtgctgagggaatacagattagagtcttgcatgtagagattcctaagaaattattatgttggcatagaaggaaaaaaaccactcatacatagagcttctttaaaatattttaaaagctccaaattctattgatagaattataataatctataggcaaaatttcctttcaatcagaaaaatactaaagaaagtaagaattctatatagttcatgaaccatttgaataatttgagcctgcacctaataattcctgagtattgttcaaaatgaactactccaggaacgtcagttaaatgtttttgtgttttgtgagtgtttgtggctatgttttcaagcatgtttcttttacaaaatcagctgtctactactttccccaatctggacttctaaaatagccactaaagtattagccaaaagtgatccccattgctgtcataaactatgtatctgaaatacctattttgtttggaaaagaaaacagctcatgaggaaattaagtgataatatatgatcattcagagaaatggattggctgaaacgattacctctcaaaatgacaaatatctttttccatttaaataacctagtcaatctaacatttagagagtcaaaggtcttttagaccttatgattcccactcaatgttggaagaggctggagtgatggcattcaaacaccagatccacagactggtactagcctatgacaaggagtctgtgacagcattttagcctatcagtagtgaaatgaggaaaaagaagatgatatggtgagcttattagaaaactaaatatatccagctttttattatttaaatatcatttttgaaatggtagtgataatagatattttttgttgtttgtttttatcatgttcttaccttagcaaaggtgaatccccaaacttaaaaagtcatccaattcaatgttctaccctttcagaatataaacaaagtgcctgctatagaatttgagttattttataaaagtagaataaatgacttagaaatttcttaatgtgaccccccccccaccaagattactgtgagagttcagtttatctatagtttatcattaaaagtttactgcagctggttctatgcagtgattccctacccgcccttccattttcatgaccgtcttgaacctttcattgaagctcaggctgcttaggtagagtctgaattgttttgtcagtattagtagctcataatcaacattgtgatttgtcacataacacctctaactgcactattctatggtttcaagaagttattttggtagcagttcctttatgatcagaaggaacattttgctacaataggaaatgcattctgtgcagacaggctgcaaattcccatgacagggcaggctcatctgtcaaagaatattttttattcccatttacctctttgattacattcagaatgccccagtaatgctgatgagatcattctaactcttaagaacattttcctcatgttttctatcatctccaataacattaaaatgtttatcacagtggaaatggtagagaaatctctgtttttctctttaggaagctaatttggggaaggaaggttggtatatgaatgtctaaaaagtattttttaaattatcagtaccagtgtttattatttaactgaacactaaattgctcttgcatgtgtcgcatttgcatatactatggtttctagtagtgaacataaaagcaccagtgatttactcaaaaaaagatattttctatttattttcaattctacctatactatattgaaagactaggaaatactatgaattattgatatgttttttagtgaaatatggtgttttatgtaccataatgaaaaccaaaataggtaaacacttggttacagtgatttaagtgcagaaatgtgtaattgatgcaattaggtgcttcattggctttttaaatgaagtctgtatttctgcatatgtaattataatttgaatatattctgattttttgtcctctacttttttccaagttatagtgttatatatgctcattactttatttttaaaaaactttttattatgaaatgtaaacgattcaaaaaagtaaagaaaatagtatagtgagagcaatatacccattacccaatatacccattagcatgactgatcttattccacttatatctccattcaccacccttctcccaccactagattatgtaaaatcacataccaggtataattttatccttaaatactttcatatgtaaactgtataccaatagatatttaaaatatattttccttttttttttttttttttttgagacggagtcttgctccgtcgcccaggctggagtgcagtggcagcatctcggctcactgcaagctccgcctcccgggttcacgccattctcctgcctcagcctcccaagtagctgggactacaggcacccaccaccgcgcctggctaattttttgtatttttagtagagacggggtttcaccgtgttagccaagatggtctcgatctcctgacctcgtgatcagcccacctcggcctcccaaagtgctgggattacaggcatgagccaccgcacccagcctattttccttttttgtacttttaagttttatttttttaaaattgacaaataataattgtacttatttatggggcacctattgacatttcaatacatgtaatgtatagtaatcagatcaggtattatcgtatccatcatctcaaacatttatcgttttcttgtgttgggaacattcagtatccctttctagctatttgaaactatataatgtattataaaatatattttcttcataccatcaaatattcaaagagttaagttttcctccctcttgattatctctctctctttctctttttgacaatttgtttgaatctggatccaatcagaatccactgtatttggctgatatttctcctgaatccttaaacttaggtttcctcctcctccctcttttattttcttaccagtcatttttgaagaaaacagggtcatttgtcctgtaaaattcccatattctggattttgctgattatattcccttgtgggtattgctaataggtgcctctaagctgttagtttcagtattttaagattattttccagtttttactttgaatgtaaatctcaacatgtcttcatttttctattcaagtaatttaaatctctattcaagtccaatccaaaatctacctttttcttgccataccagtcaatcacttttgcagtattttaaaagaagattgcacatgaaaagattgcttttccacttgttcctagacctcaaagagagattaattgaaagacatatactgtagctcgtgtcctaagaaagttgatctcaccgaagtagagggtagaatggcgattgccagagactggggtggttaatgtggagggagaatgggaagatgttggtcaaagaacacataattacagttaaataggaggaataagttcaagagacatactgtacagtgtggttaccatagttaatggtgatatattgtatttttgaaaaatgcagagtggatgttaagtgctgttatcacaaaaatgataaccatgtgaggtaatccgtttgttaattagctaactattccataggtgtatatacacaattgtctgtcaatttttaaataaaacactttttaacagaaaaaataggagcttaatcaataaaaaatttagtttattaagttatgccacatgtgagtggcatagactgctacaaggaatataaaggccattttaatccctgtgggtaaaagtcttcaaaagtgactcctaatgtggccataaattcttcattactaagtgcttcttgaccattgcaattttataggatttgatttctgaaattacaaactttgttctgatgaactcattctctcctcttcataactgttctaatttagtgtttttctgcttgctatggagggatggaggagaaatggctcatttccagaagggtggattggaatcactcatagggctcttaacgcctcctgctgaattgatgattactgttgcagtgacccactgctactgatggaattacaaaacatctttcagatgtgctggggtggaaaaacagttgaaaaccattgtcaagagtctctgtaagactttcatgacaaagttgctgtataaagttgtaatatacctagttgactttcaaaggcatcttagcctaaggcattgactgtcaagaaaataaaaaggtcacagaacataatgacctctttttccccactaaggaaggaggtttatattatataccttgattattagtgaagaggctacatttctgaatatagaaatgtgttcattgagaagagatttattgagcatctatttaactgcattgtgtaagtctctgaggaaaaaaggaaataaaagtgtaaagtgtctcttggttccatgagagcttatagtctattaatagttgaagagaaaggcatatagggttaaaagagttaaataaaaatgaaagatactattagattaagcattagaatttgggatgataaagtcttaaggaagcagaataaagggaagaataaggaccaaataggatttctgaagaagtctggggtgtctcctatttgggaggtggcacttttatcatgtgaagtggaatggatgaccctctccaaaacctctaagtttcctccatatttgtgattcatactagaatattatcaaaatctaaagtttcgatggacaaaaactgtcagtatgaccaaaataatgtaaccctttcaactaaactgacaagctacatttgcaacatatttgccaaaaataaatgaaatatctcaaagtaaaaataagtatcagcagtaagccccaattgtgtcattgtttaaatgaagttaaaaatatataagagttcttaaactttttgtgttgagtctgtagagaattgatgaaacatatagaactcttctcctgaaaaatacttatatttacatacagaatattgtacatatttcagggattcatggaccctttaaaacggatccatagactcaatttttgagaattttgacatataagaataaaacagaatcaaactttctaatctccctcaagtcatgagaatggaagggcttaaagctatagacatttaacaaattgggcccaagaaacagtgttagtgggcagaataaagagaagtagatagagaagggcttatcagagcaaaagcaggagtggtccagggaggataatagtctcaagatagtatctgagattgggttttcttattcccaatatgttcctgaaggcatattctatggttaggctgagtccatttaaagagtatctactcagggctgggcatggtggctcatgcctgtaatcccagcactttgggaggctgaggtgggtggatcacccgaggtcaggagttggagaccaacctggccaacatggtgaaaccccatctctacttaaaatacaaaaaattagctgggtgtggtggtacacacctgtaatcccagctactcgggagggtgaggcaggagaatcacttgaacctgggaggcagaggtggcagtgagccgagatcgtgccattgcactccagactgggggacaagagcaagactttgtccccaaaagaaaaaaaaaaaaagtatctacccagatacttttaggagaatacagaacaattttgactacaattaatagtgaaaaaatgaagaaattacaaagtaagtcacattattcctagcagttttaatttaagaactcgtgttctggaacacccacaaaagggagtttaaataatattttcttcagccctttaagcatggtgtattaggccatttttgcacttctataaagaaatacctaagagtgggtaatttataaagaaaagaggtttaattggctcatggttgtgcaggctttacaggaagcatggtgccggcatctgcttggcttctagagaggcctcaggaagcttccaatcatggtggaaggtgaaggggagcaggcacatcacatggcaaaagcaggagcaaatgaggttgggggaggtgccacacacttttaaatgaccagctcttgtgtgaactcagagcaagagctcacttatcaccaaagagatggtccacgccatttgtgagggatctgcccccatgattcaaacacctcccaccaggccccacctccagtattgtggatctcaacatgagatttcagtggggaaacatccaaactatatcatctgggtaactttctaataaactatgtatgtgatgtcaaatgtaattaccatatgtaattttaaattttaaaagccttttacttaacttttatgcactggaattgtgttttaaacctaacaggaagccgttatcattagaatgatcaaaacctgataatagtaaacaaaagagaaagttaatttatgggaataatcattcgggcaatagaataaccagcatatattgctgtcttaaaggggagtagctgtcaacatgtgttactaatagttaaaggtttccagaaaattttcagtatctccctgccaatcaataaagatagcatcacactcatcaccatagctttagttgtcagaaatggtgtatttattgactaaatgcagcactttgaaaaggcaaaaaggagagttaactttgaggaagtagtgattacggaatttcagtagcagtaatttcctctcactctgaataatattacagttatggatatttccctattcttaggactaaatacttatttagtagttatataactttggaaatacagcacaatactttattagttcctatcattaaaaggtccatgaatagaaaatggcttacttgcatttggaccagcccaccaaaaaatcaacattggccaaatgcagatgaaaggttgattctggagtttaaatgcagagtttattaagtaacatgtttattaaattataacagggactcaaaagtgatataaaaactcattgaactgataactagtaagactattttaattattgttaagcttacttttcaatccccctcctttccttcctctttttctctctcactcattaacgtcattgacttttaaagcctaagtcaagattttctctagacttgaataggtctttgccagtctacaatttctgttgtctgcatacacatttcttccagatacattgtctggcaatatgggtaatggtgaaaggaaaagatgaatgggtagaagaatataggaatctatggtattctcttaaatttacatgagatttcaatgagtcttttggggagcagtaaaagatttctgtatttgacattattttggtaacatggaaatgtcactgacagaaaattttaactcttatgtttgttttttatttatgtaattagcatttgcctgtctactatatgcagcagtcagctggtatacagcagaacaaggataccagttgttaaaatactgaaatatttccttactggtagagaaatggcactttcttgaatgccataccccacctctcaggctctggaagtcctagatcctcctccagaaacctccagatctccctgtgacccagaaaataaaaggaaaatgaatagcacagcagcaggacttcaggaccctcatctagtgccagggcaacatcattctgattggtcaggactgtatgctgtgccagttgttaaaatatttaatatttaatattacctttggctatatgcaaagcactgtgtttaactcatcaggaaataaaaaggtgaataagtcacatcccctgctctcaaggagctcacagatgaatcagtagtaataattataccaacggctgacatttactgagcacttactagcagcattgttctaagtacttctcatatatcatctcattaaccctcatgatatccttaggagtttattttctcttttacagaggagaaatcttagacatagggagattaagtccatatcagccagtctgactccttaaagagtattggaggaagcacgtggagttctaatttgtcactagtcatgtgatccccttggttttcacgtccgtctctatggaatgaagaggttcaattacatgatgtctaacagtcttaaaaacctgttattccataacagtgataagacaaatattaattaaaggcagaaatcataagcataactcaaggcagaatatgaaaagccctataaaatagataaatacaaatgtagaaggggctatacataatttgtttccagaaaacctataatgcttttctttctcccatttctccttttcaattaaaataattcttagaaaaaagatcacacatagtttcttttgaaaggttgtatttggactagatattgaaagtgaaaaacagaagagagggcattttgggcaaagaggatagcatgaaccagtaagtgtttcacaggggaagagagagatgggtttatggaaacttgagtgtcttccctgtgccagggactgtgttaagtgtaaggaacacaaaactgactgaaatacagttcctgtctggtgagaatgacggagaagtaaaccaacagtaatgatactgtgactggggaacagttgcattgcattcttcatatttgtcgaaggcacatatttattgaatgtgcctgttttccaggcacatggaagatgctggagatacaccagagagcaaaacggaccaaaatctctgccttcatgaaggctatactcttatgagcaagataagcagaacataaataaataaaatatagagtataacagatggtgataagtgcattggagaaaaacaaggcaaggaaggggatgaaatctgctggagttgagagaaatgagttgcaattttaaatacagaggtcaagaaaagcctcattgaggagacatttgaataaaatgctgaaagccacaaagaggtagcaagtcctgtgactctagagtgaaagatgttccaagcagaaagctgtgtcccctccagagtcttgtctcagtatgcttcacacacaccagcaatttgcttctttttcttttgcatcatcagtctgctactactgtcccgtgcaccacccagtctgctactactgacccttattcactctaaccagctctttggtctccttgcttttttttttttttttttttttttgagacagggtcttgctctgttgcccaggctagagtgcagtggtgacatcatagctcacctgggctcaagcaatcctgccatctctgccacctgagtagttgggactacaggtgcaccccacacccggctaatttttaaaaattattttagagatagggtcttgctatgttgcccaggctggtggcaaacttctggcctcaagtgatcccccgacctcagcctcccaaagcattgggattacaggttgaattactatgccctgcctggtttccttgctattccattaacatgccagatgactttcacatcagggggtttgcatttggctggtatatagagaatgaattagaaagatgtaagtccaaagtcagagaaaccatttggggccggggaagagcaataatcaaggttaaagatgattagcaactgaattacggctatggccaggggaatcaagaaaagtagacagattgagagagatttagaaggaaaaaaattactagaacttggtgactgcttggatatggtaaccaaaggagaatggagacgcaagataattcccaggtttctgccttgggtagctggcaggatgatgatgcagttcactgaggagggtacagttttggaggcatttaggtgagatgatggatgtggtttggggaatattacatttgaggggcattgggcatgatttgagttggtataccatacagattaatttcttgtcaatatttttaaagtattgtaatgtgtttttttaaccacaccctataatttaagtaacaataggatctccagaatgagaataatagggggacccatagagagatggcctctcaaaggcagtagccttttagtgggctctgaaagatgagagatgccaactgtgcagttagggaagactccaggcagaggcacagcagacatgcaggcattcatcccatgtcaccaaaacatccagtatgttttcagcaaatgctgaaaactgaattacagcctattctctgtcccttgctctccctctagtttccctagatcagggtggaaactctccatccagccaaccgtgcacttcaaaaacccagaggtcagcctggacacctcttctcccccgacctccagtcataagtcctgtggattgtccttgaaatctgactgtcactctgctcccttctgtcctagctgccatcttctgtctcttgaactgtgcagcagccccctgccggtgccctgctttcattcttgtgctcttccaacccaatctccatattcagctgagtgatctttgaaaaacacaagtttgctcctgtcattccctgttgcaatgtatttttacaaacacatcctaagatagttagtcacgtaccaacttttagacctttaaaaattgcatttatctgccaagcaattgttccccatggaagaagagctctagtgactactttgttcctttgttgtctctaattttaatattccaaaacccacatttttttttacaattgtcatttgatttagatgacttaaaagctttttattacaagccatatatatactaatagaacaacctttaacaatatatttttttgattcaccagaaaaggtgatcatttcttgatcacaagcagtaaggtttcttgtcctcagctcaacctcattataactatatatttgaacaaactaagatatcctctgaactgagtcacctcatcccagggttcaactgacatggggaattaccttattttagtcagaaagccttaattagattaggttggcctttctgaactttatgtgttgctacatacaggagttaaaaaccttgatctacacatatcacacaaatcaggagaaaacgaaagcagaaatgagctcatgtttctatatgcagctgctttgatgaagacatttcaaatagaaaccagaaaaccaaaagcacaaaactgaggagataatagccaatgaaggggagaagtgattaattcagatcaggaaaaaaagctgcagagttcaaagagactatgatgaaattattaggggctgttggagatgtaatccatatctccttgtcacatgtgtcctacgtgatagtgccgtgaatgtcatgggataaaattagtgccttacaaaataaacatgtttaaactttgtgaaaaatacccacacaagagactgatatacatacattcagaggtggacacatttgtctctagagggaaattcatctgctatgtggtgagagcagctgataatcaggaaactcaaagtcacattctagcagaaacttttattaatattgacccataactgtggctctgcaggagtttttaatctcattgtatttatgtagtgtcttttgtaatatgataacacatttcaaaattattattgttgaattgccaacaaaatgcatcctaaacacacactccttaggtaagggaagagaccccatgtatgctgtcctctgctattggaaacaagttaaaaaagagttatccagtaatctttttcttaaaaacagtcacaacatcttgatgatactgattcaattgtaaattattttggaataattcaaactataaaagctctaatcttcaagatgggaggcttgaatgtgggaatgtaagcacagatgtttatctaattttatccaatagtttatactgcacgatgggctcactgagccatatttcctcactttgaagttacctggagttctacctggtcacaggcttgcctgatttatgtgagtgaggaaggaaaaccacttaaatgaagagtgtggctttaaagaatatagtgcattttctctgagtgagcattcgtgacttctgcaggaaggtagatgatattggacaacagattactttgttttgattgaagattgaattaatattacaataccaatgctttgtctgttcgcaggcaacgaataaatgagtgtgtgatactgaaatgaaaaaaataggatatagatggcttatgtaagagccaaatatagcagaagcatacaactatcaaactttattcagacatcaagaaagcatcatatctgagctattcttttcatctccttcctgtttctttgtatacacttctagtagttaaactgattttaatggatgaattttcatttaaaagtaaaaaatgatgttctctgcttcaagcagcaggtgtgtttttaatctttaataggtcaccttcccaagtgcaagcaggcaagctgttattgatcaaagaggttttgttgggtagctctcagattattgagtgacaaactttattgaatttgacttaacagaagtcagaagacagctgaagcataagagcttgcactgccatcagagtcattttacgacagccagggagcaaagctcagagatggatactgagctttttgctggcccttggagattaactgaacagccttcctaccaattcccaagcctgtcagcagaaccaattagattttcaaccagtagacaagaagggtggcacttggggacctttttgctttaggtcgaaggcttttcagactgcgatgagatgacattgatgatgacacgttgagcattggttggttttaagacaagttaaattagcagtcttgaaatgattccaactgtctcctgacttctcactgttgccatattcagtggatcctgtcaggagcaagttgatgacttaatagtctttcttgagtggatttgagcactttggctgtgtgtttatgtgtagttgtcatgcttaaaatattcatatgaaggtttgaaatatttatttgaaggcgccttctgcagagttcagcagtaaggctctcagtgcttctacctactttttattttttattttttgcttctctaagcagttattttgtacaactaccttttattctatttcatgtataattgatgacaatgtttcatgtaattattgataacttcatttatgataaacttaaaaagcctttctgacatcatgcatttctcccagactactgtaaattcagatctactcataaatagtttggaaatcactggggattaggaagggcactattgtttttattctgtgacctttggtccaagaagactgaggcagattttcatggaagggatataaacagaaggatggaaacatagatgtagtactaatacacgtaagattgtcttaaacgatggaaacaggatatctttgagaagcttcatttttgaccttgaaaaagttctacaggatacttatttgaggtattgaaaacaccattactcaagtctgcatttgaacttaaagattactgaatagtcttaacatctactaatatcagaaaattgttatgagtgtacttctgtgttatatagataattgagattttaaattctcaaatttaaagtttttggtatttagtagggttacctggcaaataacttaaatataataatttgtaattcattgcacctactcttgtacatttttataagtgagaataattttagctgattatgtgtgtatatatatatatatatgcatctgcaaacacatatgtgtgtgtatatataaataattcatgttttgtaacaaagttctacattttctacagttacatgctggtgctatcacttggcaattgccgaccctccaaaaggcatgaaaatgaaaatattttacagtataaattctttcaggctactagagagtactttttgctaagctagacttgaaattttatagctagctccttggcaacctacagtggttacgtcctttttgaagagcttgatttataaacagggcattcttggtgtatgcacttaacattggatttagaattctgaccctatggtttcatacctatacaatgctgtggatagcaatgatgatatgtaggaaataaatatttcaacattagactcatgttttcaaagtggattcttctagatgctttttaagatagccacatttggccagaaccccatgtaatcatcacccagtcccagtaagtgacaacccatgcccagtcttgcccgctgaaaatcccattcagtacttcttttatattattttgaagcaaacccaagataatcatataattttttccataaatatttcagtgtctatctctaaaagataaccacaataccattaacacatctaaaaagacttagcaataatttcttaatataattaagatagaattagtattcagatgtcatttattgttattcagaattaccagtgattaagattgtgatagattttttctaaacacacctatttttcttcccaaatctgttatcctattgtcctttgatactttttttttttaaactccttttcgtcttgcccagccaggaccgtactgttggacatttcaaccacactcttatcactacctttaattctttcaccccttgaccctcttttatgcttactcatcctatcattaaccctacataaagctaaaattggttttctctgtgcctgggctgtcaaaagctattgaagaaaaatgcataactgttgatggcaccattacacatttatgattttcagcctcaggtggcccctttgtaccacctggtggtcattttacccattccccattgaaacaggaactatttcaaatccatacctctttaattcctcaacttggcctctagccaatttcatcaggcatcatagatgacttgaacatctattctgtgagaaaggacaatagttgtgagttatttcacacttcttccttactctatatttatttatctttaattcctaccctctgtttcaaaacaaacagattctttcttccaaaaaagttaatgtttaataccatggattctagtgccagattgcctgtttagaattcaggctccaccccttcttagctatgtgtcattgggcaagttattcaactcctttgtgcttcagttttctcatctgtaaaattatagttattacagttcttgtctttaggattgctaagaaaataaagtgacaatacatgtaaaattcttagaacagagcctggagcaggccgggtgcggtggctcacgcctataatcccagcactttgggaggccgaggcgggcggatcacgaggtcaggagacagagaccatcctggctaaaacggtgaaaccccgtctctactaaaaatacaaaaaattagctgggcgtggtgatgggcgcttgtagtcccagctatttgggaggctgaggcaggagaatggcgccaacccggaggcggagcttgcagtgagacgagatcgcaccactgcactccagcctgggcgacagagcgagactccatctcaaaaaaaaaaaaaaaaaaagcataagaaagcacaacccatgtaacagttgttgttacagttatatttccaaaactctactcatgttcctgactcagggtctttccaaggctctacctgtgttcctgattgtgaaaagtaagatacaagaaagggatgggggaggctgctttacattggatggcctggcaggcttctctgaggaagcgacatttgaactgagatctaaaggatgagaatagaccagtcaaggggaaagctgggagaacatattctaggcagaggaaacaaatacaaaggagctgaaagaaggaatgtgtttagtatgtttgaggaaatgaaagaaaactaattatggctgaagtgtagcaggaagggtgagaatggttcaagatgaagttggggaaataagctgggtccagatcatatatggccttgtagggcagagtaacgtgtgtggattatattcttagttcagtggaaagctattgggggttttaaccaaaggaatagcatgatctaattggtatcttgtgaagattattctttttgctccatggagaatagatttttaggacaagagtaaaatggggaaaagttgataaaagactattgcattattctaagttagagatgatagtcatttggattgtggtggtggcaatagtaatggattgaaatacatgaattcaagatgtaatttggaggtaaaaggtgatggattagatgtgagggatgttgaaggaaagataagaatcaagtataacttctaaattattggcttgaacaataaggcagatagtggtttaatttacgtaaatcattctctaggagagtcaacaatctccaggcacccaaaggtagtggtaaggaataatacaaggtcaactacaaagttactcattttggtttcaaaaatggccttggcttctcgttcctcataaattggtaaatcttgaggaaaacttccacttatttatgtctggtgtctttttagcttttaaaaaatcaactccatagaggtaaaatttgcatataatcaatgcacccattttattttttatttactttttcttttaaaaaacatttattttagattctggggagtatatgtgcaggtttgttacaaagacatattgcatgatgctgaggtttgaagtacacttgaacccatcacccagaaagtgagcatagtacctaatacgcagtttttcaacccctgtcatcttccttccctccttcctcttatattccccaatgtctgttcccatctttgaatctgtgtgtacttaatgtttggctcccacttataagtgagaacatgcagtatttggttgtctgttcctgcattaatttgcttaggataatggcctccagccgcatcctaattgctgcaaaggatatgatttattttttatggttgcatagtattccgtggtatatatgtaacatattttctttatccagtccactgttgatgggctggtttgattccatgtctttgccactgtgaatagtgctgtgatgaacatagaagtacatgtgtcttattggtagaatgattatattcctttgagtatatatccagtaatgggattgctgggtcaaatggtagttcaattttcagttcttttcagaaatctccaaacttctgtccatgatggttgaactgatatgcattcccaccaacagtgcataagcattcccttttctctgcagccctcaccaacatctgttatttcttgactttttaacaaaagctgttctgaccagtgtgagatggtatgtcggtgatttgcatttctctgatgatttgtggtgatgagcattttttcatgtgtttattggccatttgtatgtcttcttttgagaagtgtctgttcatgtcctttgcctacttcttaatgggattatttgttttttgcttgttgaattaagctccttatagattctagatattaggcctttgttggtatagtttacagatatttttctccattccgtaggctgtctgtttactctgttgatggtgtttctcttgctgtgcagaagctctttagtttacttaggtcccatttgctgatttttggttttggtgcaattgcttttgaggacttagccataaattatttgccaaggctgatacagaggagggtatttcctagcttttcttctgagatttttataggttgaggtcttctgtttaagtctttaatccatcttgagttaatttttttatatggtgatagctagggggccagtttcattcttcagcatatgattagcctgttaccccagcaccatttattgaatagggagtcttttcctccttgcttgtttttgtcaactttgttgaaaatcagatggttgtagatgtgtggctttatctctgtgttctttattctgttccattagtcttaagtgtgcattttaatgagttttaatgaatgtatataccagtgtaaacaccactccaatcaagttattgtttctgctgtattactctgaaaattcccacatgtcccttttcaggcaatcccctactccaccaccaggaagctacagatccatgtattgtcactatagtttagactgttgtagaattatatataaatggaattatacagtatgtaatattttatggatgccttttttccctcaaatcattattttttgagattcattcatgttgtttgttttctattagtagtttagtctttttgaattttggagtagtattccactgtatgaatttactaccacagatttgttcatccattccacccaactgttgataaaacaaaaattggcaagtgggacctaagtaaactaaagagctaagtaaacaccatcagcagagtaagcagcctacagaatgggagaaaaatgaatactgttgataaaaagttgggttgtttccagctggaagctattgtgaatcaagctgttagggacatttgtgcacaagattttttgtgaatataaattttcattattcttgggtaaatatctaggaatggaatggctgggttttttttcttttttctatttcaaattttatttgtcttttttattattatactttaagttttagggtacatgtgcacaatgtgcaggtttgttacatatgtatacatgtgccatgttggtgtgctgcacctattaactcgtcatttagcattaggtatatctcctaatgctgtccctcccctgtgcccccaccccacaacagtccccagtgtgtgatgttccccttcctgtgtccatgtgttctcattgttcagttcctacctatgagtgagaacatgcggtgtttggttttttgtccttgcagtagtttgctgagaatgatggtttccagcttcatccatgttcctacaaaggacatgaactcatcattttatggctgcatggtattccatggtgtatatgtgccacattttcttaatccagtctatcattgttggacatttgggttggttccaagtctttgctattgtgaatagtgccgcaataaatatacctgtgcatgtgtctttatagcagcatgatttatagtcctttgggtatatacccaataatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtttcctgactttctaatgattgccggaatggctgggttttatggtatgtatggtatatgtttaactttgtaagaaactgccagactgttctctaaagtgattgtaccattttacatcccccagcagtgtatgagagtttcagttgcttcacatccttactaacgcttggtatgattagtctttttaaatttagccattccaatggctatgtaatagtatcttattgtgatttcaatttgcattcccctaatgattgctgatgttgaatttttttcatgtgtttattgaccatttgtatatattttttgggacatgttcaaatcttttgtacagtttttagttgaattggatacctttttattaaattgcaataattctgtatataacctatacaaatacatttaataaatacatatatttaacaaatcagttgttaaatgtaagtattgcagattttttcccagtctttggcttgcctttttattttattaatactgtctttttaagagcagaagattttagtttttataaaatctaagttatcttttttttcttttatggctagtgcattttgtgttctaaaaagttttgctcacacaaacatcatgaagatttttctcctatgttttaatttggatattttaaagctttagcatttatgtttaggaatgtgatatatttgaatattatttttaatacagtgtgaggtaagggtcgaggttcattttttttccgtaccgatatccagttgttctagcattacttggtgaaaagatcatcttttctcccattgaattacttttacatattgttgaaaattaattgatgtaaatgtccagatctcttactggactgtcttttctattcccttaatctgtatgtctaccattatgccaataccatactgttttgattactgtagatttacaagtccttaaatcaggtactgtaagtcatctaattttgttctactttttccacattggttttggatattttaggtcctttgtatttcatataaatgttagaatcaggttggcaatctctaaaaaatcaaaagaagaaggctgttgtgattttaattgggattgcattgaattcatagatgaatttaaagagaagataattcacatcttaataatattgagtcttttgatccataataatgatatctcactccatttatttaggtcttctttaatttctgttagtagtgttttgtagttttcagtgaacagatcttgtacacccactccgatgtgcataattattcctattattttgttttctttttaaatgctattgttaatggtattgtatttttatttcattttccaattgtttagtgctagcatatagaaatacaattgatttttatactgacctttaatgctgtgacattgctaaattcacttattaattctgatagctttttaaaggattttatagaatattttatgtataacagtgatttagtccatttgggctattatgtcaaaataccataaactgggtagcttataaaaaacagaaatttatttctcagttttggaagctgggaagtcctcaaggcaccagcagattaggtgtctgatgagggcccattccttctcgactgtatcctcacacggtagaaggggctagctagctctttggggtcttctttataagtgcactaattccattcatgagagcttcaccctcatgacttaatcacctcctaaaggccatacctcctaaactcatcattttgggggttaggatttcaacatatgaattttggggggacacaacattcagaacattgcacgagaccatgtcctgtatgaataaagacaattttacttcaccctttctagtctgtatgtcttgatttccttttcttgctctagtgcactggctgggagatccagtgcagcactgaatagaagtgtttacagtggatatccttgcctcgtttctgatcttaggatagggatttagtgtttcaccattaattaagaagttaagtatagatttttttggtgaatgtcctttatgagagaatgtccttctatttctagtttgttgagaaattttttcataaatgtatgttaaattttgtgaaattattttcctgcctcttttgagatgattgtatagcttttctcctttactttgttaatgtggtaaattacatgattttctaatgttaattcaaccttacagaatagggattagatactgttttatcataaggtattatcctttatagatattactggatttgatttgctattttgtttaggattatatgattttattaagggtggtgtcatctatgttcatactagttacagtctttttaaataagttttattatagtttctttttgtctggttttggtatcagggtattgctggactcgtaaaatacactggcaaatgttcttccttcttatgttttctgaaaaaatttacagaaaattgctagtaattcttcccttaatgcttgatagaattaatcagtgaatccatctgaacctggagtgtgtttgggaaaaaaagtttcgttcacagattcaattaaatagacataggcctcttcagattttttacttcttcttgtgtcaattttgacaacttatatctttcaaggaatttgtctatttcatgtaattttccaaacttattagcataaacttatttataatggtcccattttatccttttttttttttttttttttttttttttttgagatggagtctcactctgtcacctaggctggagtgcagtggtgcaatctcagactctgcctcccggattcaagcgattctcattcctcagcctcccgagtagctgggactacatatgcgtgccaccacacctggctaatttttgtatttttagtagagacagaatttcaccatgttggccaggctggtctctaactcctgacctcaggtgatccacccaccttctcggcctcccagagtgctgggattataggcatgagccaccatgcctagcccctttttattcttttaatgtctataggaactgtagcaatcaatgttccctatttcagtcccaacagtgcaagtagctgggactacagacacattccaccgtgcatggctaatttttaaatttttttgtagagatggcatctcactatgtcacccaggctagtctcaaactcttgagctcgagcagtcctcccaccttggggtcccaaagtgctgagattacaggcatgagccactgtgcccatcattaatttgtatttcatctctctttttcttcttgagcagtctagcttctagcttaaggtttatcaattttattaatttcttcagagaactggctttttgtttcattgtttttctctattgtttgtctgttttctatatcttttctttctccttttatcttttcagttccttatttctaattacttggggtttaatatagacttttctagcttccaaaagctaattatttggggcttaacgtaaatttttctagcttctgaaagtgaaagcttaggtcattgatttcaaacctttttttctaagttttttttttttttagatacaaggtctcactatgttgtccaggctggtcttgagctcctaggttcaagtgatccacctgcctcagtcaaatcttttttcttatgtaagcattcaaagctgcaaattgaccctgtaagccctactcttccaacaaattttgatatgctatattttaatttggttcaacatatttttaatgtttcttatgatttattctttgacctatacattttttaaacagtatattgtttaattgccaaatatttgagagttttcaagacatcttttttgttattgattttcaacttaattttagtttggtcagagaatagagtctggataatttcaatctttaagttattgaagaattgttatatagcccatcaaatggtttatctgggtaaatgtttcatgtacacttgaaaaaacatatattctgcccttgtttgaggtcctgttttgtaaatatcagttaaaacaagttggttaatagtgttattgtcatattctacatccttactcattttatgtctacttgctctgccaattactgagagaagagtagtgaaatctcctatataatatatacgtatgtgtctatatttctgtttatttctatcagcttctgcttcatgtattttgaagctcatatttgttgcgtacatatttatgattgttatgttgtctttttgatgatttgactcctacgtctttatgaaatgtctttctttatcctcagtaatatttgttctttgaagtccgctgtgtctgatatcaatacagctacactaacctcatgattagtgtgcacatggcatatctcttactgttcatttatgttttacctacctatctcactgtgtatgcatttctttctttctttcttttttttttttttttttttgagacagggtctcactctgtcacccagattgtagtgcagtggcctaatcttggctcactgcaatctccacctccacaatggctcaagcaatcctcccaccttgacctcccaggtagcggggactacaggtgcacaccaccatgcctggctaattaacagagagccaaatcatgagtgaactcccattcacaattgcttcaaagagaataaaatacctaggaatccaccttacaatggacatgaaggacctcttcaaggagaactacaaaccactgctcaatgaaataaaagaggacacaaacaaatggaagaacattctatgctcacgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacattgccaagtcaatcctaagccaaaagaacaaagccagaggcatcacactacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaataagcaatgcggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacacaggcacggggaaggacttcatgtctaaaacaccaaaagcaatggcaacaaaagccaaaattgacaaatgggatctcattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaaggaaaaaacaaacaaccccatcaaaaagtgggcgaaggacatgaacagacacttctcaaaagaagacatttatgcagccaaaaaacacatgaaaaaatgctcaccatcactggctatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccatttgggaagtcagtgtggcgattcctcagggatctagaactagaaatactatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcatgtatacaccatggaatactatgcagccataaaaaatgatgagttcatgtcctttgtaggaacatggataaagttggaaatcatcattctcagtaaactatcgcaagaacaaaaaaccaaacaccatatattctcactcataggtgggaactgaacagtgagaccacatggacacaggaaggggaacatcacactctggggactgttgttgggtgggggtaagggggagggatagcattgagagatatacctaatgctagatgacgagttagtgggtgcagcgcaccagcaagtcacatgtatacatatgtaactaacctgcacgttgtgcacatgtaccctaaaacttaaagtataataataataatagtaataataataaaaaagaaaggaaatacaaatcaaagagtttaaataagaaaaaaaaacaattttttattttttttgtacagatgatgtctcactttattgcccatgttggtcttgatctcctggactcaagcaatccttctgcctcagcctcccaaagtgtgattagtagcatgagccactgctcccagctgtgtatgcatttcttgcggacagttgtatagttgggtcttggattttgagcccatctgacaagtttttctttttaattgtactgtttaattgaactgaatttaattattgatatggttatgtttaagtttactatcttgctatttgttttctgtttgtcttttttgttcattattctttttacctctttcctgtcttcttttgtattattttttattatttcagttttctctactcttggtttagtggctatacctctttgtttagaatttaggtgttccctaaggtttaaactatataactttaatttatattcaccttcacataatattatactatttcacatataatgttagaagctttaagaatatacttccacttccccaccctctcctttatgctgttatcgtacattttacttctacagatgtcataaacctcacaatacactggcattattttttctttaaatggttaattttccttgaaagcaacttaaaaaaagaaaaatgtttgtatttacccatgtacttaccattttcagcactcttcactgatttttatatatacctgagtttctatgtagtattaataccattttcctttcacttgaagaccttctttaattatttctcactgtgcaagtctgctagtaatatcatcttttgtttgtcaggaaaatttttattttttcctttatcattgtagtaacttttcaatgaacatagaatactgagttgatgtcattttttaaacacttttctctggataaattattttttattttttgaggcgttagtttatttttcaaaataaatttcatcgtatgtatttgaggtttacaacatgatgttatagatacacatagatagtaaagttgtgacaacagtgaaacagattaacatgtctataatttcacatagtcactttttttgtgtgacaagagcaactaaaatcctacatatctaacaaaaatccctaatacagtacagtgatggttaatacggagtatcaacttggttggattgaaagatgcaaagtattgatcctgggtgcatctgtaagggtgttgccaaaggagattaccatttgagtcagtgggctgggaaaggcagactccctttaatctgggccggcaccatctaatcagctcccagtgtggctagaatataaggcaggcagaaaaacatacaaagactagactggcctagcctcccagcctacatctttctcctatgctgaatgcttcctgccctcgaacatcagactccaagttctttagttttgggtctcaggctggctctccttgctcctcatcttgcagatggcctattgtggaaccttgtgatcatgtgagttaatacttaataaactcccctttctatatatatatctatcctattagttctttccctctagagaaccctgactaacacaagtacaattttattaactgcgtaaagaatttactttgatttttttctttaatacttgaaaattttcattccattgtcccctggcttctattatttctgacgagaagtcaaaagtacacccatttttgttattttgaatgtactgtctttggggagtggtgattataaaaaagagaactttatcactggtttttagtaatttgattatgatgtgccttaatgttattttctttgtgtttactctgctttgggtttgctggccttatgtatctttggttttatgattttcatcaagttttgggcttattcctttgaatatatttctgtgccatttctttccccattcctgtggggcatcaattatgtatatgttaggcagatgttattcaatatgtcactgaggctctgttgtttttcgttttttacccctttctctttctctttcagtttggttagtttctatcactcttaccaatgtttacatctgcactgactaatctgatgttaagcctatccgacaaaattttaatttcaggtattatatattttttactctaagagttcatttgttttctttctttttggtttctatttctcttttcattatgtttctattttcctttaatctttgaatatgtttgtattatccttttatatacttgttgttttgctaaatccatcatctttgtcacttctgagtccacttctatggttaaattttcttgagtttcttttatcatactttttttcttctttaaacatctagtaagtttttgaggatgcaggatactgtgaacattacattgttgagggtctgaatttattttttgttttggtagtcagttaagctacttgtggatcagtttgattctttcaacacttatttttggttttggtttttggggtttttttaagcttttggaggacatgtctagtgtgacctttactttatgctagtttaaccctactattaaagccttaccttttggtgttttcactgaatgcctctgttatttaataatatctctctactatggctagaagtaactggaacatcttacagactattgtttttttgcctagcctgatggagtctcacactgcaacacacagcttagtgctcaggcaaagattcaaggaagactctgcatcggtttctgaaactctacttatgcatagctccctcttctctggtattgtgccctgaaaattccagccacctcagcctcccctaatttcatctctacctcctcaacttaatgagtcatccactttctgcttgtagtgatcttaagtctcacttcacttgtttcccttttctcagagatcgcagtcctttgctgcctgttgtccaatagctgaaaacaatggttcgatatattttgtccagttttccaattgtttataattggaggtcaactctagtaccagctttcagtcatcactagaagcagaagcattttaatgccttttaaatataatagtatattgtttagaaatttacttatacatcataccacagtgatttattgagtacctacgatgtgctaggtaccatgccaggatttggggatacaaaggaataactctttctatcttcaaggaagctcacagtctgttagagaggacaaacatgtaatataaatagttagaaaggtgtttgggagctcaaatgaggtcataagtaactatatggtgtggggtagaagtatttatgaagcaactagtctggttttataggtattctccaggttgagggctagccaaaaaaaaaaaagcattctagtcagacagagcaataaatggaaaggtagagagttataaaatagcacagtgtgtttataaagctagtttcattaattaatcattcatttaataaatgtgtctgtagggctgggtgcagtggctcatgcctgtaatcgcagtgctttgggaggccaaggtggaggatcgcttgagcctgggagtttgaggttacaatgaactatacttgcaccattgcattccagtttggatgacagagtgggacactgtttcaaaaacaataaataaaagaagaaatattagatgctatgcaaggtgttaagtgttgagcatccaaagggtgagtatgatgttcatgacttctgccttcatagagcatacagtctactgtttagtgtgaatggagcataaggtgtctagataaggatagtatttatggacaaggtagcaggaatggccaatagaaggcagattgtaagctaccttaattggtaccctaaggggctagttattgttatgaaagctactggcctccaaagttttctgactatatatccagcctataaaaatttcacatatttaccccaacatatgtatacatttattaataaactctataatgtatattattgtactgatatatacactgtaaaatacaccaaaaaatataaatgagataatttaaatataaatagacaagctagtattctcttcctgcattccatgctccatcttgcatatcttgggttcacgcaccttactttgtaaactagcaggaaatgggaagcattcaagcctcttttgcagcaaaaagatttgatcagaattctgattcataaagattctgaatatgacttttattttagttgtgctgaataatgtttttaaaagcataggagaagctgggctcatatgattccttccagttccagggttttgtagctgggggtgctccttagaagaggttagcaatctaacctagtgttgttgattagttgtgttattaagatacaatacacaagactaacgaagtgacttaaaatagactatccaatatggagttggtattccctgcagtgaaactgactttgttacttgcaagtcaccactttataaataaatgagtcacagcaaacaatccaactggtttcctatatagatatttcagtgggctacgtgtcagttttcatacataggccatgcttttttatattagaaaaacacaaaaccaaagaagttgatttgtataaggcagtgcttcttaaatggaagtaataaatctgacaggaatatttttttcctaaataaactttggcaaattactttttgattcatccatattatacctggaagtggagaaataaaggtggggcacactatccaaaaagctggactaagggagcagaactgggcagttttagaggtcccagaaatcagtggtacaggatagcagagacataaggcagatgagatgccaggttgtttagaaggctagtaactgggaagacagaattaggatgagttattccaaatcaggaagacacaattaccagagttaggacccagatgtgcaagagtttggagaatgcatgtaaagaaccagtcccgaggaaaacctcaatgactgaagaggcggcttgcttcagctcagcaggtctctgtgcaaacactaaggcggttaccagtgtaacttaggtgcagctgagaacctgactggaatgggacacaaaaaggctgaaagaaagatggtttgcaagaagtcagtgtgccccaaattcatcttcctaatgaaacatttatattacttatttctgaacttccaacggttcttttatggttttaaaaatattctctcatagaataaagggaagtgttcttcctaaattatatgagaatgtattagctgtgtctttatgtatacatttcctatgcagtttaagagcaacaatacataaactcattttaccaattggaaaactatgacaagaaaacttaggtaggagacggttcggtttgtttttgtcggtttccccccaactttgattttgttccctgtctaaatactgtaattgctttgtagcaaatgcacctttctcttgccccactttacctcacctctctcaaacaactgaggtaacatcacatcacaagccaagaacattctcattctgagttcacttggcagtagatagaacagtactccaacttgacaagcattatagcaggtaagaggggaaaaaaaatgggttactgatttgacatactgctgttgaaaactgtcctaaggctagtgggtgttcgctaaaaccaaaatgggccatggctagaggcacctgtagaatagttaatgacagtcatttagctttcattcatttttcagttcaaattattttagaatactttgttagttcagaacatgtttgcttaagtcatttcagtagtaatgcttttctacaggaggcaattaggtattcttcattttacagctcttgaataatagctaagaaaactgcaattgcacaagcaaagtgcagataaacaccagattatcatattaaagttcttattagtctgtcagaagaattttttgcactgaatgctttttagtttttttattatccattttttaaagtcagacttttccccaatgttagtttagttttaaataaattaatcagtctacatttttactaggaaactaatctttacttcacgtccctgccaccattaacttcagcctaaaatagcaaatttcccttcaaaattttaaaaatatgtataattttaattttttttttctgggctacccaatggcttctctactacaagctgtattagaaaaggtgaacctctccctatgtcaggtgtgattgctttgttaagaagcctattagtaatcctaaacccagtatgacagtggtcttttaaaataatagtaagtttcccatgtgtttgcagagtttcctaggtatttgaaaagccaccagccaggcacggtggctcacgcctgtaatcccaacactttgggaggttgaggcgggcagatcacaaggtcaaatgattgagaccatcctggccaacatggtgaaaccccatctccactacaaatacaaaaattagctgggcatggtggcacgtgcctgtagtcccggctacttgggaggctgaggcaggagaatcgcttgaactcgggaggcagaggttgcagtgagccgagatcatgccagcctgggcgaccgagcgagactccatctcaaaccaaaaaaaaaaaaagagaaaaagaaaaagaaaaaagaaaagccaccaaattaaagtgttcttaaatttacatgaatatttatgttttgcctatgaaactatatatactttcttttcaactatggtttcatcttctggaagggagaaactgtatctttggcaactatttctcttgtttctttcaacattcaggggagtgttaagaaagttagactatcagttaatatttctcagtttctatttgaaatagggtgtttttttcccaagatctgaagagaatacacagagattccccctcgtaaaatctaaaagcaaccttccctttactgcaggcattattgcaggttaaaaacaaaaggaaagaaactgaagttaccttagagtgtcataaaaaattaccaagaagtctaaaatcctgccatctgctttacgtgaaaactcttctagtgagaacccaaggcaaaaactgtgtgtttcttctgtaatacttcctcagagtatctattgtctttcaaatggggccaaggcttctcaagggaaaggaaatactctaaaataaaattgtagggtgcaacataatttgtgatttgttttcttttatgagtaaaattacatggtattttggccacctgtttataactgtgtaggtcctcccatgaggaatattgttgggtccagaagaaaaatagacaagtaggaggcatgcaccgttctttcagataccatctgattaattgcctctgacattccctgacctttgtctgctccagcacgtgttgtcagtgacagaggccttggactgccagttttgctatctttgctggcagaggggcagaaccgacacttttgtagccactggcaagactaagccttcaagtggggaaaaagattatttctgggttgtctgaactgccaagttagctccccaaatggtttgtgccacagcaggtttgatcttttcattgcatcctgagttacatcgatttcctttggctttttgacatggagaaaacaagacataagaaaatgaaccaagaccagttctttagtatttaagaactattccagtcaaaacgaaatagtctgggtatattgacaaagctagcttggaatattaacaaagttaattcaggtcaggatatctgacagaaataactagtcagtgggcaaggaattaatttattgtgttcatctgaacttccaatgagcttatatcaaggtaatgaatatgaccagattatggtttgcctgttgcacaaacagcaaatgccatctttcagatttcctggggggttatattcagttcttatggacagcttagcatagcagttaagagcacagatgctggagtcagactgcatgggattcaatcgcaactctgccactttctagtaaatttgggcaaattaatctatgcgcttcagtttccttatctttaaaatggggataattatggtacctacttcataaggttgtaatgagttataatcagtgacttgctaggtatgaaagcactttagcttagtgcctgatattgggaaagcactatacaagtgtagcagtagcagtgggtggtttatatatgacatacatgtcattggaacaactttcagcaccagctcctatcttttgtggttggatgctggatattttgaggacatttggggagtatgtcaaggctggtttcttttattctgttcaacctatttttcagggtgccttatttaataaaagttgatttgttgctttggaaatacaagctaattttatgaattatataaggacatcagggtaacttaaaagcacataatgcatttgtaaatatttgggattggtttatgttttggattgtcagaacagctacccttgaccccatcttggttgacccagtgaatgcatgtgaatttatagcagtcttgggtttttgcctggcaggaagcatctatcaagtacccagcaaatacccatttccctcctgcttgaaaactgagcttttcttgtggaacacttatccttgcacttaatatctggtttctgaatattcacattaaacaacagataatttgagttattttactattgatgtgtcatcaaataggaagatgactatcaataatatgacttttggtaaaatggaatagaaggagtactttaaatagaggcatcattagaaaaatgaacactggttcttaatacttaaaaaacactggttttaacaatacaatacaaagaaatatcacctatgattttgttccccttttatgtagagttttattttgaaaggtcgcattttgagtatttgagagactgagctcctctgcctggataatctccaggtgcaaaacataggaatgtctgtgaatacacactgggttgcacataatttaaccgcatgggctttggaattatgctgcctgtcctcatatcctggctttgccactctctggctgtatggtttgtccaagttacctaacctctgtagtcctcagtttcctcatacataacagtgttgtgagaatgaaatgaattaacaatataaatgaagcacaccacacactgcccaattggtagtaaaaattagttgctgctactgctacttactattactattattggtgctttgctattattagtactactaataataatgtcgttattcaaccaagtttctttccctaacaaacaaaatcaccaaaaagtactgtgtggagagcatgccctctgtaatgttgctattgaaaagattagagatattctcaagcttctttaatatctcaatgttaatccaccagccatgaattttcccaaagccttttcgaacatctaagcatgtccagctagtgctgcctcttgaaatcatgagttccatgatcttcctgggctatatagaaactgacatagagtgaccaaggccacttggttccagcgtcatgaagtggtgcctccctcctttttatgttacagacttggtgaacatatcacttttgatctctttcaaacacacagagtgattttttataaatccctgttgccccccttttatctcacacattatcttctaagcctaaagaatctttcaagtaatggtatagatatataaatatcttcttaaatggcagcttttcccccagtaaaatgacattcaagagtaaggcagtggttgtttctctatcatgatttctaatttttctagattctagcatagatgacctacggttgcctattctttttctaatgtacatctttttaagctcctttcaaagaattatagagaaagacggtcttatgcacccatttagtctgcccctgacttgggcaaacatcccttctatgtattaggaacagcagttttcccagctgaggtgataacagtcctagtcttgcaaaaacccaaccccagacctaaggcagtagactcaaacacatgcatgtgacaatcattttttgttgctgttatagagccaagttccattgttcagaatttttatgatattttatatatatatatatataattttgagacagggtctcactctgtcacccaggctggagtgcagtggtataaacttggctcactgtaacctccatctcttggcctcaagcaatcctcccacctcagccttctgagtagctgggactacaggtgcatgtcaccaaaccaaaataacttttgtattttttgtagagatggagttttgccttgttgcccaggctggtcttgaactccaaggctcaagtgatctgcccggcttagcctcccaaagtgctgggattataggcgtgagccaccacacccagctctgatgtatttttatctgatcctcaacatgaaccaggactttagaagagaaatgccatccttgcgccaatattaactatcacatttcccagcatctactgagctgtcttcacccatcttgccacctgacatcctgaaatttgggtgaaagtcttctctggcttactattctgaaaggcttgtattgtttccagacctcttaccttatttgtttgtattttatcatacagacatagtaaaatggtaatgaatatgctattttatattttttctgcctcctatataaaaataattagtggaaactatttgtaaaggaagatacatttacctttgttggctaaaagttatcttgattgccagtctgaatagtgccatggatggtataggcaggcctggggcatagatgggaacaaacctaaaagataagcaaagaatgggtggagagaagataagggtgcagagaaaacagaggctcatctggtagaaagaaataaagtgccctctgaaagtgtctcaagtgcttcctagtggcactggtgccataaggcagctgtgttgagtctaagccaagtatcttcctgatctccactgcttcctgcggctgaacggggcacaggtctttcatacacatttattgtaatttagggagtgaacatggtccaggtatttgaaaagaagactggttgtcaggaagcattccttctgcttctctgcattgtgtgtctgtgattatgtgtgtgactttatgagaagtatctgaccttctctctacacaattcctcctgcttgtgagataaggtgtgccctggctggggtgttggcaagcctggtgaacatgtctaaactactctgggggagagaattgtgagagtggggagggggtgcccttgggtccagccttcccagagcataaaaagaagtgacaccctgggacccagccactctgaggctcagggagggcttggtaaatgacttcatccacggtatgaaatggttaatttttctttgtctgaataaagatagaacatacaattacccatggatgattctcaggtaaaggctcatattgagtgtccgctgtgtttatggcatggttgtaagcctaatggataattaagaacacctaatcctcactctaaaggcaaagacagtaaaataggggaggggtaggcagactgacaggaaacacatacatagaaccctataaatcagtattattttatcagtcagtgacatgtctctttagcattcattatactttttaaaaaactcccaattaaattattgtctatgagtatattgaaagctcttctattttatttgtaaaagtttggctacttaatattccttcagaaacattaatgaaaataagattttccaattagtcaagtaaattcaggagcactgtgtaaggcatggagagggtaagagttgagggaactcaaattaatttattgaaacattaaagaaactgtatggaactactaacaaataacatgaaaagatacataattctttgcaagtataatgaatggactatattgaagttatccaaatgaatggaatattgtgataggttggaaaagtgagagaggtctagatggaggaaaaagagcttgaacagttcttaaaagacaggtaggagctagatcggtaaagatgagatgagttttctagctaaaggaaataactaacctataaaattgtttttaaaattttaatagtaaaagccatactcattcttacttattacttgctgggaaagaataaaatatttccaaaggaatttgggtgtttgaaaaaattgtagaaatattctgtatttttctcagaaaaaaattaaatattgtatttaaaagtgaccattagcctttctggtgtgactcagaaatgtttctgtatttaaatatcattgcaactttagttatatcttttccctgtgagcctggaaagacaagatgctggtatcatacctgagatcaattaacatttttatagtgtgtcgatatgattgatattaatacattataataaaacagactaattagagttagcgacaaactgttgagatggtggtattgatgaaatatctctgtccattgcaggagagttgcagcaatccactcatatagtgattacaccttgtgacaaaagacagtatcttcatatttcttcattttaagtcaaagcgtaaatgtaggcagagatgtttttaactaacatgactatgatcatctatgtgccattatctaattgctcacagaaatcaaattgtacaagtgccgaggaatctgaatccagtcttgagctgtcagtggagaatgtcagtcatttcagtaaattgcccccttagggtcatcctgtataattctttaattttaggcccaaaaaactatgaaaggaattttgtgtaaaatgtaccaaaagaactgtcccatttaaaacattttatgccatgcttggaaatgaaaatggacccttcaagaagtaagtctataagttgttttatcaacttatagatgttactcagatggaatggtaacaacttggcttgtgtgttctctaaaaaattatcacgttttcaagttatgcatttaacctgtattgacatatggaagttttgatgtagtttcctttctcaatcaactccaaagagtcaaaagtgattatcaaagctgaaaaggcttttgtattttcttcaaatgttaaagccatgtatgtgaacaacaaggctgatgaatttgctgttttatttcgttgacatcttaattcaaaatgtaaactgaagtttcttttcatttctttgcactgttaatattattctgtttttggttaggttgggtaaaaactgttcactggtgtcattttttataattagacttttatagcttggggtttttggtaagcaaataaatattttaaatgtaattggtgcaattactgtatgtgcactgaacaactttatattgagcttcatgtcatgtcacatttttatgctagtggtttcttatgatttttttaattgtatgtggtattcttctgaaatatataattaccaactcaccctgagttggagaagcaagagttctgtcgttctctcaaacagacttgtattgaaagatataaaaaagcttgctttattctaacattatttccccatcgataaaagtggttcatgtctatgttatttttacatcttgtacaatcccagcatcacattgttctagtaggagtacaaacagataacccaagcttagtccagatttgatttgggagaaactagaaggctgggaaaggtagatggaaggttgtgatgagtaggaggccaggggtaaaagcagaaggaaacaagaataatgtaaccattagctaaacatgaaattttacccctgctcctgccttcgtggcatcacataacatggagagttttaagatggcatatttgttctagcttcatcttttctcagaatgccaaccagcagcacattcaggccacatacaaaccacagcggagaggctagggcaaggattagtgtgagggtgagcccaaggagaaggggaaagtagtagcacagccctgggctctaggaagttttggagaggttttagaatggcaggatgaaaagtagtatcaaacaaaaccaaaaggtccttattaaaatcaattagcaaaaagaatctagaccgggcacaatggctcacacctataatcccagcactttgggaggccgaggcaggcagatcacttgaggtcaggagttcaaaaccagcctggccaacatggtgaaaccccgtctctactaaaaatacaaaaattagccagtcatggtggcaggtgcctgtaatccaagctactcaggaggctgaggcaggagaatcgcttaaacctgggaggcggaggctgcagtgagctgagattatgccactgcgctccagcctgggcaacagagcaagactccatctcaaaaggaatctaagaggagtcaaaatctaagtctaagataatcattcccaaatactctcttccaaagggtaggaagactgacagtgtcctactgaagggccagaaaaagaaattatctttgctcagtgttgaactattctgttataaagcattgtaaacattatagcaacacttatgaccattataaccctacatgtgttcccattgcatgtttaataatttctctactttaaaaaaattgagaactagatcgagaagacaactgattgtagaacagtcagagagcttcgtgctggtgaacattaatagagctataatagtctgccaaaattatgatgaaatcactggaggcatcaaggcaaaaaaacaaatcaaggggaagctattaacagtttagcatttctagtttgtgtgagaatatggattccagctagcagaagaatacttcaactcagattggctgttaggcattgctagaaatcttgtttgtttttgttttttgttttttttttcaaaaacaatattgaattctatactggttctgaaggtcaccttaataggagggctagtttacctgtctcataacgttacagaaaaatatgagcctaagggaaagagaaagttcaacaaacttcttacaattccatccagtgattctgaagctgaattagtactgactgcaataaaacctagtagattatttcaaatcttcactgcctagatgtgcgaagtcctgtcagaatctcctcaccaaatctgtgcactttatactaaggtgaacatttgcccagcctgttctttaagctagcctagaaaatcttcccacaagaaactttctaccctttttccccaaaaccatgaatctcaataatcttacattgattataatttggaaacactttattcaaattgcttcaaagaaaaccaccaccaggcccccaagtttccttagtgagaagccaaagactttagagacactagattctccaggaaggtatattagtgctttttaaagagctgcatgttgtctctggttagtaaacgatggttcatgtcttagatgaaagaaggatgagagccaatgggtctgtgctcttctccagttggaaggtgaaagtgatatgaaaaggctattagggaaagtatatttttctgcttacttttcttatcaatggtatattttaaaagtattccttggccgggcgcggtggctcacgcctgtaattccagcactttgggaggccgaggcgggcagaacacgaggtcaggagatcaagaccatcctggctaacatggtgaaactatgttactaagttcctctagctacatagctagctagagtctccccagtggcagcaattgtcaacattcctgtggtcaactacaataactccattgacattcaattcaaattttaattctactgttctcacttttagtttctttgttgtaccttcctttttgttggtcagttttcctttttcagttaccccttttcgtaaagtgtcacgttggtttatcactgggagacagggaaaagcaaaactacattctttgctgtctgtgcatggactgaataatgaagtgcagtgaacaatcaccaacagacttaaaagaagtgatgtgattggtcactgatcatgatgcgcatgtgttatttacatagcaatttgtagagaccaagcagtgaagtttgtacttcatgcagttactcatagttaacattctgtggtaactgaaacttgaactgtgttgctcgggggacaactgtgataactgaaatttgtgaatattgaaactatgggccgggcacagtggctcacacctgtaatcctagcacttcgggaggctgaggcgggtggatcacgaggtcaggagatcaagaccatcctggctaacacggtgaaaccccgtctctactaaaaaaatacaaaaaaattagccaggcgtggtagtgggcgcctgtagtcccagctactcaggaggctgaggcaggagaatggtgtgaacccaggaggtggagcttgcagtgagccgagatcccaccactacactccagcctgggcgacagagtgagactccgtctcaaaaaaaaaaaaaaaaaaaaaaaagaaactatgaacagcaatgattgcctgtataaggatgttcactacaccattatctgtattaggaaaaagtggagattaaaaacccgaatgaagaaacagttaagtaaaagttagcacatctacactaggcaattgttaaaaagaatgaggtcaatcttatatgtattgacagggaagggtgtccaatgacatgtcatgaaaaaaaagcttgttgtagaacattatgtatagtataatgccatgtatataaaaaagaaatatttatgtatatttgtttatttttatatttaggtttgatagaaaaagctctggaaggcccacctaattgtcagcaacaattactcctgcagagtagaaattgaggactggagtttggtggtgggcagactttcaaattgtattctcacactttttaataattttttccccaataaatgcatgattatttattaaattttcaaaaaaagtacaaaaatttaaaatctcatatgaggaaccatttaagatattttgcctgtcatggagaacatgatggcattcttcaaacatttgaagggccgtcattggaagaaagattacatttgttctgaaagatattgaacagctgatatgggaccaatggatgcaataaaatcatttcttaaactataagaaatgtaaaatccttttaaagaccatacacagggctttcagtcagaatgcctgagtcttaactccttcaccatcacttactaaccttgggtgtatttcttaacctttctaggtctcagcttttgtatctgtgaaatgagtaatcagactaatgctacctttgagagcagtgatatcttcaaggtgaagttagcgttgcttcataacccttctataatctccaccagctttctcccctagactaccccaaataaatatacaatctaagtaaaaacaaaaacatgagccagctaggtgaacacagcttccagacaagtactatagtcatccacttctaaccaaattactactataaaccctttctttataaaaagtcatctagagctgccactgcctcagaaggtgttgaagggattaaatgagatatttaatataacacttctagcgtgatgcctagcacatagtaaatactaatgaaacaaaaatcacacatacacatatcccactaaatcatgatataagtgagatgacattttaactgggggtatattgaacaggtttttcccttcagtgagggggggaaaatggtttgataattaaaagcctagcacactcttgttgctcttggatcctgtttcctttcagttttcctgcccttgaggttcagtgacttttctcattcttttgttaattcggccaccatttattgagtacctactgagttccaggttcagtcctaggtgctggccgtactaagatgaaaaaacagggactctgtgctcagacggctctagtcagaaagagaaggaagttggataattgcaatatgatgtgatctggattaaaaataaaggtctgtaaatgacattaatggagcaagcagaaaaacatactgaggtcagtctgagggagccagagaaagcatcctaaagggagaaacgtctgaactggagcttgaagggaagacaggcatctgctgggtagaaatcctcttcataggatgtatgcagatgctgcttgatgtgggttgtgaaattttccatgactgttcataaagctgaaatgacagtaaattttggcttctctttttcccaacatttggctgtagtgatggaaaaccgaacaagtaattattcaaatatgttagagatgtgatagaacaaactcacccattcctgctctcctgtccttaccctgtggctttcattcttagtatcaagcgggtcactgtacctttagccaaggccttctccctgtgaagctttgtaattttatcaggaaggaaagtctttcccctaaatcttccacttatgtctcattagacagaatggtgtcacgcagccaccataagttgtgagggaggctgaaaattaatctagcaaactacagtgcctgccagagcaagaaatacaacttctccataattcctatctggtttggtcttatttttatagttgtagccatttgttttagttctctggggtttctttaacaaagtaccacacactaagttacctaaaacaacaaaattattctttcacagttctggaggctagaagtccaaagtcaaggtgtagagccatgctccatctgaaacccctaggggagtccgtcactgcctccttgtagcttctgctgtcaatctttggcgtccctgggcttgcagctgcatcactccagtctccacctttgtcgtcacctggtgctctccctgggtgtctctctgtcttcacgtggccggtcatattggacgaggggcccactgtactccagtgtcacctcatcttaacctaactaacaatatctgcagtgaccctgtttccaaataaggtcatattttgaggtattgtgggttaggtggagggaaggagatcaatccataatatcattgctttgtgcttagtatataaataagaaatgctctatttccaagtgacgtttctttatacctaggattagtaatgaacttttaaaagccttatttttattcctagtttgagaaacaattactttaactacaaaattgtggcaatatgaaagattacttgataaaccattttcaaataactggttacaaatttagaagaaagtttaaaaatccagactatactgtatgccaaaaaaatgtacacatgtgttaaagagttaaatattttatagaattgcaggaactggtcttttgaatatttgtgtggttataagaatcagtaaagattataaaagattcataagtcctaactgtataaagttgtaaaacttattgcacaagaaaaaaaaaaaacagtgggaaatgacagactggaaacattacaacgaataattcagacaatagacatgaacaattcatacaactattaagaccccaatagctagctggtcaaaggatgtggccaatctaaaaacaccaggtttgttaagcaagcatatgggaaaatgttcagtaatagtttaaaagtgcagtttaaagtgaagtgtgactgataaattactctattgctgatggtgatataaattgatataatccttctgaagagcatttggcaaatacatccagagctataaaatgttcattcaattgatgtttctgggaacttaccctaactaaataggctaaagaagaaaaaagctgtgtttatgaagctgttaattgcagaaccatttgtaataaagtgaaaacttgggagcaatctagttacctgaaagtagaatagtcaactgacttacgcatcctttttttggaatatgcagacatcaaaagttcttgtaatgacctgtggcaacatgaagaaatacctgtgttttaaagttgcatgttttttagccagacgccgtggcatatgcctgtaatcccagcactttgctaggccgaggcgggtggatcacctgaggtcaggagtttaagaccagcctggccaacgtggtgaaaccctgtctctactaaagatacaaaaaaaggcactctagcctgggtgacagagtaaaactttgtcttaaataaataagtaaagttgcatgtttttagaaagtggcatctatgattgcagttatggtaaatttaaaagtatgcatgtggaaaaagtcagcaacagtgagatagtgaagtgtgtagaaggtattagggagcctggagttgtgttaaggtgaatgattacgaatccttttcccaactttcgtataatttaaaaaatatttaaatgtattcaacttacaatgagtttaaaatcctcctgtactttttgcatgttaatgaaaccattagaaggaaagaagaatttaatgagctttctgggaaaaaaaataattttgctcacagtagtattgtaaatcacaccagatgtttttctgtcatagaaaagtctgtactatagtgggattattctaatgtgaaaaagtgacatttgaagaaagctttttaatacagtatatgtgcattatatgattaatggtgatgtttttgactggtgaagtaattattttaatcctgtctcatcattcactgtagttttgttttgtggctgagattttaaagctatgtttataaataaaataactctacccacaggctggagagaaatagttttactttcaccatgacaaatgatctcttctgactttctagttatgacttaatagtgtggatttaatggcaggtgatcaatgtagttgatactattttagcaatcccttttacttgtgttcttataaagaggacttgcccctcgcttctcagagtcagagtttatgagaactgtaaaaacatgatcattagccctgttccttgttcctggtggggcacccctagcatgtttcctaggcttgctgaactgctcagcgtccgcaagggaacacaggtgctgactctctttgggggtgtgagaagtaaccagggatgacaacccctctggggtctccacaggtaaagcttgattatgcctctatggttgactaggctttgaattcactggtctgaatttactacctgaatattaaggttgggtggtagtgcatctcaccaccactgcctccccctctccaaagtaacaagcgcatgcacacacgtgcgtacagacacacactcttggacactggtttaacgtgaaacaatcaacatatcctttaagagaaaaggcggggtctagtgggaggagtgtgggagtgggagtgatgatggaaaggagttaatccgtatctccgaaataaagactagacaatgaggagccctgcaaagcagtgctggacaattgacatccactgactccctagtgaaatgcagcctgccctcagttattcagagaccgagcatctaaagtgtggattatccaggccatatgcttctcctcctttgccatctggctggttgcctgcttcccttcttattcacatggaaaatagtcaaaatacctcagtccatttctgccaaaccttttctattacctctatcaaccctccctttaagcttattctgtgcacatcctggtcaaatctggtcacttggcatattctgattcctcccaggacacattggctagtttctaacgtacagtcttgtgcttgttgatcctggcttcataagagtctttttttattatttctcacttcactagctcgtgagctcctttaaagcaagggacatctcctctgcttttaatatcctcttcaactggcccagagagctcctcttcacaaggcaggtgtgggacaagtgttgttggctaagtactattcattgtcatttcaaccagataagtaataagaaagtcacaacacagaggagaagtaagctgaagtgccatttgctgtaaaaatcaaccaaaagagaatcgcagacttttagaattggaaggaacattagatatagttttatctcattgatagagaaacatgggcccttaggagtgaagtaacttgtccttggtcacccagagcatttgtagcagagctaggactagacttcacctctttagagcccatttctcttatactccagtcatccaaggattataaaggaatggagttatgcagaaggtatgcagagaaggagtggcttaggttaggttcccaggaggaggagtctacattagtgacaggtgaccaaccaagattaatgaaaaattttatcccccttttaagtaaattaatcttttgggattgtagatataatagcaataatttggagttatttttattcattttaatgactgatctaaaacaagaattgaaaagatctcatcgagtgcctagaacaaaactgacacatagtagacatcaattaatatttgttgagtgaaagaatgaaaccaaaactgtcacattttagcctaaagactaggagtatttttcagttccagtataatcaaacccatttatgaaaattgttagagtctttctttgaattaaaattttcttagtttgccgtgtattttaattgactctggacaaataattcagccatgagttacaatgaacttataaatacctgtttttggatgctgtaaattaccagagaaagctagtgccctgtcacttaccaatgaaatgtccattgaacattttatgatcttagcctaaacatttcaaataggattcctgtaaatttccaaggtaaatctcaaacatcagataacatttccaaatccagttgtgggggaatgtaattctatgtaatttacatagaatttaggtttagaattatataattcatgaacctttacatgaaggcaaaattgaattctattgttttctttaagttttttacattactcaaataatacatattcatggtagagaaaaattagaaaatataggtaatcatgaagaagaaaaaaactactcttaatcctagaagccaaagattaactgttaacaattagttgtatgccctttagacctttttacacatattcatggggtcatatgctacaaaccatttttcgtttttgtttttttgtgaaacagagtctcactgtgtcacccaggctggagtacaatggcatgatcttggctcactgcaacctccacctcctgggttcaagcagttcttgtgtcttggcctcccgagtagctgggactacagacgtgtgtcaccatgcctggcgaattttttgtattttttggtagagacagggtttcgccatgttggccagattggtctcaaactcccggcctcgagtgatccacctgcttcggcctcccaaagtgctgggattacaggcgtgagccactgcgcccggcctacacgccattttaaaacaacttttttcatgtcttaggaatatttctcagtgtcaataaatatttctaggaaccattcttaatggttgcagagtatcctgttatgtacatgtaccataatttgtctaactaaccccttgcatttggatatttaggttattttccatttttttgccattataaatgatgctgtgatgaactttcttatttatatatcttgactcacgtgttcagtgatattcttagaatgcattctgaagagtacaattgctgaatttaaaatatatccagttttaagagtggaaaataggaatttttaggtgtcagagatcactttcatgtagactttgaaatgctggcttttagagacttagtacttaattttggctcttcatggcaataataaacacatttttattatgtattaatacaattgtatttgataaatgataagctcccaaatgcattgttttagatggttttcaaacatttaaatgctttaaatgctggtattcttctagtaataataatgatacattatgcctatcagtttcctcattcttttcaaagcctggatgctttatttggctagttgacatgaggcagtttcttgctggaggcaaaatgtcattggaccatgaactaatctcccttccccctccccattttacccacttctaggctgattatataaacaataatgtgttgtctttttaattaagtgaaagtgactcattacaggtgcttttcaaccatctgaacttatctcctaaataggccttgcattatctatacgcaaatgagaatatgattatccaggcaaggccactctagaaaagcatttaaagcaaggagcagagagtcttctccagttttgcacgcgataggatgtaagagcagagctatccaattagaaaaggagacaggggaggcggggaatgaggccatgcttaccgagcttgttcaacttgatgacattatggttttcatgataaagtctgcaataacctttatctttttgcattcaatttaatggccttggaatctggagaagccagtaggacctcatttaccatgtagcaaacatcagcctcttctggtacaatattttgtgctaactaaaagagacatgaaattaaaaataggtcagaaggctttccgttccagttttgttgatttaagtggggcagtggggagggtaggcaaaacattagtttcttttaagtgatattatggagaaaataatctattaatgagtgaaaagagattatagcactatgagaaaagtaaagattatgttttgtgaaaagagctctttctgaagcatcagagaagcataattcccaaaatgatttcaagttatctacaagtagttttggcttgaagaaagtaagggaatgttatttattggaaatattttaattgtctttatgtaaggctgtgatggaagaggtgaatgtgtgttttaccaaatcatttcttcattcataagacagtacatttaaatcctgtgagaaacttttctcaaaaggaatttttttcttttttttttaaaaaaatgaacaaaaataatgctgcttctgaaagtatgtttagaaggccctggcttctcaataagagtggataaggaatgtaaactcaggtacattacagcttttctcaaaaagaatttaattataagagtgtggataataaatgtaaattctgggccatggctacatgactgtaatgaaacacattatagaaatacaaatagctgttgacattctaggtgagttatttctcccttctccattccactatgacagtcgctctgtttcactgagcacgctgaaacccattgtgccctctaattatgatgctaaaggcctctggaaaaggtcccccccaccccaccttttttttattggtcactaacaaatccctcattattattcccaaattaagaaaaaaaccttatggcaagagtcaaagtgggcagagatgaccttctgacagaaaaaaagttcctattttaaatgaggtagcacacttaaacttatattcgaacaatgtgatccctctcaaatacactggataaatatttttctgacactgcaagcaggaagataagcatctccttatacaccagggccacaagtgctctcaagaagcacctactatcagaaagaaccacaaaactaaaatgattgatttttgacagggacattctgaatccagactgggtcacattaatgtgtttaacaggttgtttcagatatccttcagatatctgaggatacaggcagttgctaatttgttctaatgtgctggtcagagtgcagccccacctgaaatccagtttgtatgagagccatatgaaggccatcccgtggagaggtcaggacctctcagagttgaattttagaagattcagataacttcttcaatttgaggttcctggtacattaaagaactaaagaaatgccagaagagtgttgcacaagttaattgattttcagtggttacatataacatatcaatgtctaacctgactcatttggagagggctttaaaagtcttagcattgaggatccccatgaatattgtgaacctgaagttcagaatgactcttccaccctccctatgaaaggattggcagatcagaaatttggttacatgtgccatcaagatatttctggccaaggtcatgccttccatgctttatggtatgtaagtttggaattaaactaagtcttcaagttcatgaatagatggacatagaacttttttcggaacaattcatgtccctgactacaagtgttcctggggccacgtctgaaagcagcttatcacttcactaatacagcaaaagcaaggcattctgttgttcaaaatacatctttgccaggtacatgcttactactttgtagatttttaggaccaaaaaaagcttattttggtaaccgaataactgacaatgatggattctcaaacatttctgctaaccaaagaaggaaaatgagattgtacccctttagagctggagtccaaaatagtatggcatacttaacgtttatctaacatcttaggtgttcatttcaaaattcatataaatgtctcattttcctccatactctgtttttatataaaataatggtatctctctcctcaaattatttttcacacagatttactctcctgaattttccagaaatgtagatacttttaaatcaaaggaaggctgtattttgttttgttcagaacttttctattccagaaaatcatgtcaattgacagcaaagccacttgtggtcattgagcctcctgtgtaaagcaccgacgtcattctgtagttgtcatcactgtattcagggtgattctacacgtaggagtgagcatttgacagcttccatgtcttctagtgcggctgagaatttacatattaagatacacattatttattatcaattactttcctgtttcaatgtccatttagagcactaaaaatatctttgtaggtagttgatattacttatgaattttatttcaggagagcaaaggaaaatacaagatagttgtatgaaaagggggcaccgggtgtgctagagtggctcaccaccgccctacacagtgggctaattggctggagagtagagctgactctgcacagttgcatgctgaccctctgaagaatttttttacaaaagcgtgacgtcgcgtgaagaccttgacagaattagcaaagcggttgagatgcatactttggagtcagacagactccagttcacatcttggcttttatacttacagctgtataaccgtagacaatctatctaccctctggccgactccatttcctcaattataagataggataacttgtgaaatgctttccacaagattactattgcatttattctcctcaccactcttaatgaagagagtcttgtaacagataactctaattgtcttcagagttcaggtccccaagaaagattatgccttctaaaagctagtctgtttccttccagtgggagccatttcattcatgctgctctactctttacttggactgctagcaaacatggagctaagtactcatgcttaatttctgtggctttcctcaaatagggtttcaatactatagtttgccctcactccattccctcctccaattcccccttactgctaaattttggtctttcatcccatgttgttagctgttggtcctagtgatcctgtggtttttattataaaaccacttttgtgtgtgtgtgtagtttttttttttttttttttttttggtaaaatgattatcttaaatcatttagaaaaagtaggtgaggctaggcacagtggctcacacctgtaaccccaacagtttcaaggccaaggcaggaggatttcttgagcccaggagttcaagatcagcttaggcaacatagtgagaccttatctctacaaaataaaaaataaaaaaattagccaggtttggtggctacatgcctgtaggcccagctacttgggaggctgaagtggaaggacagcttgagcccaggaggttgaggctgcagtgagctgtgattataacactgcactccagcttgggcaacagaacaagacccagtttcaagaaagaaaaagtggcggagggcggagttcagtgggtcatgcctataatcccagccctttgggaggctgaggtgggaggatcctctgagctcaggagttctagaccagcctgggcaacatagggaaaccccatctctacaaaaaaaaaaaaaagaaaaattagatggaaattaaataagtaaaataagaacgaaataataaagttccattctctttatggtactttatagtatttatttctgtaggtggcaaagttacttttttcccttaatttatactgtctattcatggtagtattagatctttactgtatcacttacttggggaaatatgacaataacactaagatgatattttacctaaaatactcatctatagagttatttcagcataaactatttatttctattttcttagcaaaaatctgaagaatagcacacattgctgtctctcatcatattattatagaacagtaattctcaagatttttggtccctggacacctctttgcacttttaaaaattattgaagacccaaagaacttttgtttatatgagttatatctatcaatatttattgtattagaaattaaaactgagaaattttaaaaatatttacaaactcattcaaaataacattaaactcattatgtcttaacataaataacatatttttatgaaaagtaattatattttccaaaacaacaataatgggtaaaacattcttatagaagagtgtcattatttttacaaacctctttaatgtctgtcttagtggaagacagctggactgtcttatctgcttctgcatttagtcttttgccataacgtatgttatgtggcctcatgtgagaatgagagtgaaaagggcaaatatgtatcattactattattatcgttaaaatagcttggaccttatagatctcctggaagtgtcaaggggatgctccagggtctggactacactttgagaactgctgctgtatagaagataggcaatgcatattgcaacataagaaatggaaataatattttgctcacattttaatttttagtggtttcaaagagccactaagttttaaaaaatatgcctcttaatccttcctccaaagtctacagaaacattaagggtcaaactatggttgacaagaaagtttagattttttccttgaagatctggccaatatatttttttgtttgtttgttttgagacagggtctcacgctgatgcctaggctggagtacagtggcacaatcatggctcactgcagcctcagctcaggtgatcctctcacctcagcttcctgagtagctgggactatgggcacacactaccatgcctggcaaatgttttgtgtattttgtagagacagggtctcactatgttgcccaggctggtcttgaactcctgggttcaagtgatcctcccatcttggcctcccacacctggccaccacacctggccaggccagtgtattttgaaaggtactagcaatatatggcatcaatgttatgtttttgggaatagtttttttttaaatatatgtattgaacagggatgatccttttacttgtggtatataagaaaacttagcttttttacccttccaatctatagtggtaaagttgctttattaaaccattatttttatttgtgtgtgttgcttgttgtatcatctttataccattcaataatgagagtagaacaaatcgatttctcttattcctgctgtgagatggttcataatgaaaggtagatggcttgcctaatttacagagtggcattaggttcagaatgagttagtacagaagaataacacattttattttgctctattttatttttctttatttaggtaataacaacaatggttgtgagcagcctttttttttttttttttttttttgagacggagtctcgctcagctgcccaggctggagtgcagtggcatgatctcagctcagtgctaccactgtttcctgggttcaagcgattctcccatctcagcctccttagcagctgggattacaggcactcgtcattatgcccagctaatttctgtgtttttagtagagaaagggtttcaccatgttggccaggctggtcttgaactcctgacctcaggtgagcagactttaagccttggtattgctataagactaaggatggcagctgcactttcagtgtgatagaatctccgttacagtgtgattttgctagtttcattaattacttgtgttttgtttctctttccatgaaagaacaatcttaaactatcaagcacttccccaggagaaaatggatcacttgcccaacagtggcattagagttaggtttaggatattttgaagtggcagaggtattaagtagtcttagtagacacaacccaactaaatttctttgggtttcagacaggtggtggtaaaatagacaaggtcaagaagtgtcaactactatctctagtgactacatgagtccttgctgggccctgtgaatctcctttatatcacatcagacttttcatggaagattagattatgccttcacctaaaaaatagcttgcccatatgagtctatatctatcactgtatgcaaccctcatgatttgggacagctgtaattattgggaaaggttttttcccaacttaatcagagactaacagatactgttgtccacactatagtacctcaagtgtttgaagacagttcccatgttttactcttggatctgcatgagccttctcatctccagcctcagctctgttctttatatgaaaatgttgccagtccctttcctacccttgttctctctcctgttgtcctgttccagttttcattgtccgtcttaaaagtatgatgcctagaatgacaatcagtgcttctgatattgaacgactataagaggagagtggggccaactgctttcttactgccattgtctgctaatgaagctgaagatctggcttctttggcagttgtatcacaggaacttgtactgtgtttactgtcaatggaaattgtgtcttagtcacatcaaactattaagctatattttcctcatcctgcatttgggcaattgtacgtgcacattcaaaactgaatccattgaagtttcacaagaaagtgttcttttttgttttctgtttttgtcagtggaaataacattttatttaatttttttagatatgggggtctcactttgtcacccaagatggagtgcagtggtgccatcatatctcactgctcaggtaatcctctcacctcagcatcctgagtagcatatgcatcaccatgccaggttaaattttaatttttttgtagagatgggattttgccatattgcccaggctggtcttgaactcctgggctcaagcgactttcctacctcagcctcccaaagtgctgggattagagatgtgtgctattgttcctggcctaactttttattttgctgtaattttaaatttacaggaaggtttcaagaatagttcaaaagattcctatatgtcatttgctttatcattctctaaatgaataaatatagattagatacacatataaataattacatataagttttttctggacaatttgagagtaaattgcagattatcatgcctctttaaatatttcagtttatttttaccaagaataagaatattttcttaaacagccatggtataattataaaatcaggaaatttaacattggtataataccattatctaatccatgatccacactcaagtctcaccaattatcccactaaggtcctttatagtgtttttggaagtgggagggtttccaggtccagaatccaatctaggatcatgcatttcattcatatacctgctaatttctccacctgagaagagatgttcttatccttcaaaaattggatagtagctgtgtggattacccactcctttgtccatagcttctacatcattgattcgcaaacattccactaccatcttcaagcaaaaccaaaacaaataaatcagtctgttcatctttgagcttccccttctgtgaaatcttgtttagtatcttaactatggacatttcaatgtggacatcagagagtaataacttttaaaaggttcattattctccactcaagtccattttcagaagctttgcattcagtgagcctttcttctccttcctgcagatgtggcatggctgttagattgtccttttgccctgaggctcccatgtcagttatgccccaatgcctattctcatggggttttaattgcctataacattttattgttcaccctcttcagtctcctaaactctatttatttctcaaggtaccatcttgttcgtgaatctttccattcatttatataacaaatggtcaccttctatgtggtaacattgttcttaggtgctgggagtacagcagtgagcaaaccacaaatagtcttgccttttaacacttacattcttgtgggggaagataaataagataaataaaatttatggtaagtgagatggtaataagtctaaggagaaaaaaaaataaaggagataaggagtgatgggggaggtacagtttaagttgggtggccagggaaggttgctaagtcattactgcagcaaagcctctgaactctgctttttctgaattcttcagtctgtaagtagttaatctcaattaaacagttgggttatagttgtttcatgataatctgtttattaaaagcagcagagtggaaagcacttggtttctgaaattagacataagtttgaatatacatttagttgccaagtaaacttggataaaatatgtagcctctctaagactatacttttatgatctataaaatgaggctaatgatgccttataggtttgttaagaggactaaatgaaatagcaaagatgtagcatctaacattgcttggaacaaacgttagaaatttaacaaatgttaaatttaacaaatgttagaaatcctattgtctcctctatgtggaatcctattgtctcctcttggtgtcacccacaggagctaagctcagtgctgggtatagaatagatgtgtaatagacatgttcggtaatcagtgtcctattattggctcagcttttatttcattaatttagtcacatgacatttactagcactttctgtatataaggtgctatgaatattaatacaaccctaaggtgtttataatttaagaggaaataaaacaaatacataaattaagctagaatgtaaagataaaagtaaagacaaatacaataagagaggcaggcacaaattgatattggtattcacatgagattgcctcctcagtggagagaaagttttaagaagaggtgacattggaactgtgtcctaaatttctgaaagggttttaaaggagatttcaaaaaaaaagcagacagaaaatgagcagaaactagtggatggaaaatagccttcagaatgcaagaaactggcaggtggttcagtgtgggtcacagtgattctcagctctggctgtagagtagatactggaagggccctataaaagatactgctattcattgctaccccccaggaattctgatatagttggtctagtatgggacttaaacattgtcaattttaaaaaaagaagaagttctcaaagaggtttttttgtttgtttgttttttgtttttgagactgagtcttgctttgttgcccaggctggagtgcagtggtgcgatctcggctcactgcaacctctgcctcccgggttcaagcaattctcctgcctcagcctcctgagtagctgggattacaggcacccgccatcatgcccggctaatttttgtatttttggtagagacggggtttcaccatgttggccatgttggtcttgaacccctgacctcaggtgatcctcccgcctctgcctcccaaagtgctgggattacaggtgtgagccaccgtgcccggcctcagagaggttttaacgtgcagccatgggctgagacctcaggccagagtatactataggggaaaggtttaagatcaaccaagaaccttatattgaggccatattgtagaggccttgtttcagattaaggagtttgattttaatttaggaaatcattgcccttgaaccaggcaatgatagctggaccacttctgaacttcctggatggttgatcagatttttaaggcatttgtccctcaatgctcctgtcttcattgtattactgtgatttgggtacatttcttatatgccctataagcataccaaaggtgaaaagggggttgtactcatctttccgtcttcttcagtacctaatattgtcttacatttatattccctgtaagtgtttgttgaatgagtgaatgaattagtcaaggatcagagctgcaattcgatttggggtccatacatcaaatcagtagactgctgcaatatgagcacctgggtaagaacactggcagcagggatggagagaagacacccataatacctgctgcagaagaagtggttctattttgtcctttaaaggtggccaaatcactcacccgtcaaactgactcagagttaaagcggactaggaaaaacacggagataatgaaagaaataggcaagccatgtgaatttaggagaagatagattttaaatcgtttgcattgaaacttcagagatacatccagattgagctgtttctcaggcagatggaaatgtaggtttgatctttggaaagaggttaagagatttacatttataacttaagcatagataaggaaaaaatgaaatgtgagggaaaaaattgttcgacctgaataggcagatggaaagtagtggttctgagcaaaatttcagacagtttcatcaagtcattgattttctaaaaaatacatactgttataatttggggctttctgttctttacctgaaacataactaaattctgctttttctttatcaacattttcccactgcactatctattcacagcttgatgaaaaagtccaggacccccccgagccctttggcccccagaatgcgataagcagcctaagcccagcctggtgtccttaacttctcctcctgcaaatagggtgaacagacagacaccaagatctaagttcaggaaggagaagccaccacgttctccagtccaactttattagtaataaaactgaacttgtattttgatctccttttggctcctggaatctttttttttttttttttgagacagagtctggctctgtcacccaagctggaatgcagtggcacagtctcggctcactgagcctccgcctcctgggttcaagggattctcctgcctcagcctccaagtagctgggagtacaggcgcgagccgccatgcccggctaatttttgtatttttagtaaagatgggatttctccacgttggccaggatggtcttgatctcctgacctcgtgatctgcccgcctcggcctcccaaagtgctgggattacaggtgtgagctaccacgcccagctatgttcttaatttgttaagaatccatacaggaggagaagtaaccaatttgcctacccccaaaccttctgcacttataaaccttaaatctttgtacagcagtctggtcatatattgaatctaaagatatagccatactcatctagggatttgataaaatgttctgaaatggacattttagctgcagggaggcaaaacccgagagacctttgtatcagcttgtgttcttggaaagagagcctccaattcagaccacccatcgctgggagctttaggatccaacagttccctgagggccttagcttctagctaaagtctcctgactaaatggattgatttcctatcttcccataagggactatgttgactcattccatccaccccgtgtttacctctatcaccagcagatgatatccccatccggctctcccctgaggaccctgcttcccttgctgccctctcagcagctgaagaggtttctttcatccttcctactgtggctccaccttgccaccttcacacatttctcctgtctcaagaactgtagaccctttaaagcacaagttgctattatccgctaatgtttaagacactccctcttatttgctgaagattttagaacttggctcactatcttcctctttgtcattattctcaaagtcttcaacatccacatagatagatcatctatctgtagtttgttattcctccccgttatctccatagttctttccctgcacaccctcttagctacctacccccgcagtcataccccagaccttgtcatcaccaataaccacaccacctctgaaatctccaggtcaagcatcccattctctgatccccaacttctttttctacagctcaggtactgtgatagctccactccaacagtgtttcattttggacctccactccaacaccgtttacgtttttcattgctcatcactccctcctccctgcctgcctcaggttctcatttatcttcttccctatttaggttccatgcccatgactaggtatttcatcctcgacactcagcctctatgccccttcctctctcacttcaacagtccagctctaattaaactctgagcctgtccctgagcagctgactgtggcaatcaaccatgctgagtggctttggtttgaataatgaccacagatctcaaatcagcatttgagaaatcctgctacatttccctggtaaatttgttcttcaaacccctccaatatctcctctcctattattctcagctgatgacctggctgatcttgcattgaggaaacagaagcaactacaccagaactacttcatttcccatcactagagccacctgtccacctgtgtctgtgtcgtgtctcctccttttcctttggtaacagtgaatgaatggaccacccttgctcctcactaaggctaggcattcttcttatgcttcagaccccagctctcctcgccagcttaagtattttgctcctaaaattattccgtttccttcattaccacattcctctctctgctgatcgactcctatcaccataaaatcatgtggcagtatcactcgtcttcagaaaaggaaagacaagacccctcttgactccacagtgccctctagctatcttgtttctctgctctttttcatagcaaagtaccttgagttgtctatagtgttctattgcctcacctccagttcacccttatttttctttactttttttgaaatacacatacaagacagcatatataattcgtagaatattaccaatgtttttaacactttgtgcatcctttcccaatagtgtgcccttacctccactgcttaagtaaccactctctcaaatttttgccatcatttacttgcttttcttttttcttttttcttttttttttgagacagagtctcactctgatgcccaggctggagtacagtggtgcagtcttggctcactacaacctctgcctcccaggttgaagcaattcttatgcctcagcctcccaagtagctgggactacaggtgcctgccacaacgcctggctaatttttttgtattttagtagaggcagggtttcaccatgttggccaggctggtcttgaactccagagctcaggcaatccacccacttcagcctcccacagtgctagaattacaggcgtgagccactgcacctgacccccacttgttttttgtttgtttttgtttttaataattttacaatatacatatgtatccctaaataatacatttttgttttgcatgttttggacttatgtatatggaatcttattatatattcttctgtgaattgcttatgttgctcacctttagatttttaaaaaattcatatggtgtataattcatttttactgcaatataatattctactgtatgatattagtttatttttccagtgtattgttgatggacacttgggtcacttcaggattttttgccattacagacaaagctactatggacatcctcgtacttggctcctagcacatgtgtgcaaaaatttctgtagggcatatactgaggagtggaattagtgggttgcctttacttgatgttacctaattatcctctgaagtgttgtatcaatttatactaatataagcactggatgaaagttcccattccaccatatgtttgtcaaaacttggtgctatctgacttttaaaaattttgctagtctgttcgttaagtaatggcatctcattatggttttttttttctttctttttcttcagacagggtctcgctctgtcacctaggctggagtgcagtggcacaatcccggctcactgcagcctcagcctcctgggcttaggtgatcctcccacctcagccttccaagtagctgggactacaggtgtgtgccaccacatctggctaatttttgtattttttgtagagacgaagtttcaccatgttgcccaggctggtctcgaactcctgggctcaagtgatctgctcacctcagcctcccaaagtgccaggattacaggtgtgagtccctgtgcctggctcattatggttttaatctgtatttccctatttactaatcagctacttttcaatgattataggctttcatgttttctctcttgtgaaatgcctatttgtatttttggcccatttttctactgggttaattgtctttcccttattgatttgtaagaatgtcttatatattctgaatactaatccttgatcagttatgtgttacaattatcttctcccagtttttagcttgtctgtttactgttgttatggtgccttaatgaacagaaatttcttgaactataagaaattgcttatatgtgatgattttcacttacacaaactattccatgtggttcctggagagctcattaaaacacagactgggctgggtgtggtggctccacctataatctcaatacttttggaggctgaggcaggaggatcacttgacaccaggagttcaagaccagcctggtcaacatagggagaccccatctctaaaaaaatcactggagtgcagtgattgcaccactgcactccagactgggcagcagagcgagatcttctctctaaaaataacaataaaaattagttgggcatgctggtgcatacctatggtcctagccactcaggaggctgaggtgggaggatcagttgagccccagtgttaaaggctgcagagagctatgatcatgctacgataatgccactgcactgcagcctgggtgtcagtgagaccctgtctctaaaaaataaataaataaataataaaaatttaaaaacacagattgctggaccccacctccagagtttctgattcggtaggtctgggatggagccttaaaatttgcatttctagaaagtccctaggttatgctgctgatccaggaaccacactttaagaaacgctgcctcagccaggtctgtcttctgaacatctttcgccaatcctctctccatggttccttagagattacactctattgcctaaaatataatccacctcttctgctcttgacctatcaatttttgggccctgggtcaccttaattgactttttaccaggccttctcaatcctgggtacagatagctagttgcctaaggaatgcttgcaatattaataaatgctgcctttttgttcaaagttaacaggtagcttttagaatggcctagtattattgattagctgactttgtagtctcctttaggagtataagtgtgctgaagttattctgatacaacgttaagtcatgaatcaaactcattgtccttccatgctccagtacctagtctccttccccaaaatcctacccccttttttccttcaaaattgcacttcagatctgcatcctttcctgtcatcagttagtcccctaaatccccagtcctatttgtgatacccatgtatttttctgggacatgaataacaacctcaaacatcttaataataaagcctcagatgggtaacaggaatacactgcaaaaattaaattacaatatttaagccttccttgtaatttatttagagccaggtttcccagcagtgacactgttggccttctgggcagatgactgtttgttgtctgggcctgcccggtgcactgagggtgttcaacagcagcagtggcctccactcaccatgccagtggctctccaccctcaccccgtgtggccaccccaaatgtcctttgagggcaaaaacctcctctggttgagaaccactgatttagagacatctcatgccttatttgaattttcagggatttttttggtgtgaagtattgtcagctggtttgggccttttaaaatttcaactccccaagcccttttaatcttctccatttcttttttatcatatatttctctttgtttctggctaaaagagggcattgtattttcatgattttttgaaaaccgattctcaaccacatttctccaagacaaagggcagttcccaccaaacacacagaagcagaccctaggacacacttcagattcttttcctgcccttcctgcaagtattactctcaccataggatggtggtagttactgtgattaatatacttttaactgtaatgcgattatagaaaatcatgccaaaattgctagagctaaaacttgacctgccccgacaggatgatgaaaactcaataccattctccctgaccctccccatccgcctcactccccaaatagtcttgcttcttaatgagtaagagtagtttaagctgcaattatttcctcttacactgactgtccttttcaccctgattactctttggatgtataatggggagatagccgcatgcagactagcaaggaggtctggtgaatggcagcaatacatacttactcgggaagagtgcattccactctcagaacaacctgcccaaactgaatgcggctcacaagtggagtgggcagagctttttacaatttcaatttgaaatgccacttttctagttttcgtggctaaaatagtaaataattttgtgggtttttttttcagctgctcttcatttgacatttgctgagcccctcttgaatttacttttgcagaacaagaccatttgtaccccaactatttgtaccattaggccactgctcctttttagttgcatttagggaccttctccaattcagtctctttctacatgagcagagcacctattcattcaaagggaacaccatgacacagccagagactatgccccgggagtataaagagctttgtgtctgcttcccagtttcagaaactcatagttgcttatttaccagatatcaaccaagctctgggtaccaggcacttttgtacatttctagttttgtcttagctgagataaataccaactaccctgaagtactgtaagatgtacaagtaccttattaatcatccaaaaaaaaagcctaagcaataacagtgttttatattagtttgagggttagatgaattctatttttagctatatttttctaggtagcagttctaataaacagacatttcataactactaatcaaaataagtcaatgccttggttatctgtaattttctcttacaacaactttagacactggaatagcactgaaatagggagtaatgatcttaattgtgtatttcttggtaaatgacagaattcctccatatatatgattttgtttgatttttttaattggcactacgggcaaaggaagaaactttggggcaatgagtggttttaaaaacataggctgggcgacgtggctcatgcctgtaatcccagcattttgggaggctgagatgggaggattgctggaggccaggagtttgcaatcaccctggtcaatacaaggagaccccatctctacaaaaatttcaaaaagtcagcagggtatggtggcatgtacctgtgggtccagctacttgggaggctgaggtgggaggatcatttgagcttcagaggtcaaggctgcagtaagccatgattgcacgccactgcactccagcctgggggacagaatgagaccctgtttaaaaaaaaaaaaaaagagagagagaaagagaaagaaagagagagaggaaggaaggaaggaaggaaggaaggaaggaaggaaggaaggaaggaaggagggaaggaagaaatctatacacccaaaaacctaaacatcatccctgatgagtgtgaccagcttgcttatcaaaaggcaaagaggggttctcatttggtggcggtagctatctaaaccaaggcacttgctgcaaaacctagaaacatgggaaaatgacaaataaaggagccaagcaaaataagcgttaaggaaagggggaagaagaaaatatgaagactgcaggacaaagaagggagatgactggaaagagaagtgaagatttcaacactgatgtgagaaagtgacagcataagttacaaagaatttgggaaagattaaatacttcttcagggtgggaacaaacagccgagcataatggaacagtcttttaggacacccagccctcagagctccagacacctcacttcataccagtttagcccagtaactgctcttcatagcaaatctccttcttgctgaagaaaagtttgaatcatgtttgctattttcatgcaccaaaaccttcaaaattacctaaagaaaaaaagaagtttgcttaatttcccctgtaatgaaagtctgtgtggaatcacttattgtctgacaggtctcactaaatttgacgttcctgtcctggatttatcaggatacctcattacttcatcatgctatatgtaagagtcaactagaatatagtcaactcattattgtttgaatgatgtaagaaggaaaggttgataatccaaaagggtatgcaaacccctgtgatttatacttggttatttgcatttgtattttgatattataaacttgcccctttgtattgtaacaatctgttaacccatctgtctcctccactagactatcagcatcttgactgcagggaccatcttagtatccaaaagctagagcacagtctctggcacatagctggggttcgaaaaatgttaaataaatgaagaaaaacatgtatctgatctgagaaatcactgcaaacaaagtaatgcctccacacaatgaaaacactcagtaacacctggaaagcttaactgcttgtctctcagactgctgcgaagcccccaacctcaaccaaagtgccctactgtaaatcttttcccagaataacggaagtggttaagtgttcaggtgtcaaaatgctaccctgctgggctgcaggccacatacaaagttatattacattgagtttgaaatgctaacaaagcaagtaattaagctgagtaagtgctaacttgcttgcaagcaagatttgaagctgataaaccaaaatgctgataattaagagttgattatacagctttgttgtttctctaccctgctaatagcctcacattcttggcatgtaatgatttcttccccacaaggaaaaaaaaaacacacaaactatcaatcttctcctcctgtctcccaccctgaaaaaggtgtgactccctcctttcttaagctaaatcctctccctgtggtcttgatccttctctctattgcatcttttacctctcactctccacgaatttcttcttttctgtttgcaaacatgctcgggatttaccaaccttaagggggggaaaaaaaaaaaggcaagccagcaaatgatagtaggagaatcttcccttactctacattcccttaattctctcccatctttctcctctgtatcccctaacctcttggaaaaggaatctgtgttccttgcctcctcaacttgatggctgattgctttttattcccttaaacacttctcctggtttcagcactctaatgaggctctttcaaaagctataaataattcttaattgtcagattccggaatctttattttcttcatctctgcaatctttcacatggttgacctgcccctttggtagaactattaaaggggcttttatgacttccatgacattcttaccttctggttttcttcttccttctcttattactctcctcaccctccctgttctccttctttcttttccttcttcctttctggtaagagaggaaaagaaactaatatttattgacatacaagacaaattatttgtcagatgttgtgccaagttttcaaacgtcttttattgtcacatcaaccctaggatatagatattcttatctccattttaaaaattatttatttttaattgtggtaaaatacacataatgtaaaatttaccatttgcatcattttaagtgtacagttcagtggtattaattatattcacatcattgtgcaaacattaccaccatcaatttccagagctcttttcattttcccaaactgaaactctgtcaccattaaacaatagctctccattctcccctcccccagcccttggcaaccatcattctactttctttctttgtgaatttgaccactctgggtaccgcaaataagtaaaattgtacagtatttttctttttgtggctagcttgttttacttagcatgatgtcccccaaggttcatccatgttgtaacatgtgccagaatttctttcgtttttaaggccaaataatattccattgcatatacataccatattttgtttatccacccaactttcaatcatccgcatataaatggtgaaactgtggctcagactagtgcagtaaactcattgaggttgcacagcttttccctctggggaagcattcttctaaattctatccttagtcttatttcctctttccctctctcgctctctctctcttccctctctttgctgatctactcccatatttttaattttaatctccatccatgtgggtgtttcttaaatgtatatcccaaatttatccttggtactgaatctagttccatatttccagtagatccaaccagaatattcccatattgctttcaattcactatgtataaaacccaaatgcgttatcatctgatcctcaaaacaggcttgactttctcacactcctattgttgttaatggcaccacaaatttcccagtcatctggaccctaaacctctgagtcatccttaagcctctttctccacatctcccaaattccgtaaatcctaaagtcagtcttgtcagttgggtctccctaatcatcttcatgcccattccagccttgctgtgcctgcagaaggggtcctacagtctggtgggtctaagagcttgggttgggcttaagtcccagcccagccactcactggcatggagaggacggaaggtgtttggctagtcacctgacctcactgagcctcagcttcctcatctgagagagagaacctaatgagcaaggtatgttgatccttaaatgaaatagtatttatgaatagttcagcacaatgcccagcatttagtagatgctaagtaaatggttattttttcttcttttttaaaaaattctgtcttcctgcttctaattcactagccttcttccctcataaggattttttttctctctctcagaattctctgcaggaaacaaaccactgtattttagcattatgttttattttacagtgcccttgattctttatacctgtctgaggacagtgactgtgctgaccctttacatttgtgtttcaacaatcctgaaggggattttcatctcctgaactgctttatcaatattgttttataaacaattgtgacctacaaaatttattgagcccaacctcattttttaaaggactgctataaagtcagtggaatagcattttcatgattaagagcagtcggagggattaatggagaggcagcatgagcttattcctaactttgagtgtgccaggagttttaacagggataagaggagtcaccaaacatctcttccctgtcccttgtattattttgcaagaacataggcaaacttgtgcatatttcagcagaagggatatctgggtagaagattgcattcagtttgtggagtaagggcatgcaagcaattaaatcccaacttcctcatcagcagtctgtactcaggagagctgtccagagtagccaggccacatccagccacattggagataggaattccatgtatatggcaaaaccctatctctactaaaaatacaaaaattagctgggcatggtggcgggcacctgtaatcccagctactcaggaggctgaggcaggagaatcacttgaaccagggaggtggatgttgcagtgagccgagatggcaccactgcactccagactgggcaacagaattgagactccgtctaaaaaaaaaaaaagcgtatttacttttagaaggttgtgttattttttacaattctcttataacaatgcacctccttattgcccgcacctggtgtactccattccaatctccttgctcttggggtgtgtgtgtgtgtgtaaaatgtctggcataaaacacaagtgtgtgtgagagtcaatgtgtatgtgtatttcacagctggactcatgcataacacccagttaatggtgtcactaaggagtacaattagaggatgtataaagaagagagaactgacaaacttttctgtactatgaaaattttacaatgggaaataactctttacaatacagttttttcaataagaaaaaaaaaaggaattccatgtatgaatcctaaactaactgtgttccttacctagctgggttgctgcgtttccgaaaacccattagcaacaaaaacaccaacaaaaccccaaacaatctttatgagtagcttggaaaaaaattttttaaatgcgtgaaaaaagtagacttgtgatggtgcacttcagattaattctttccattaacattttgaaatgttaagtaaataggtagtgaaatggggatggtgctagttcttcatcttgtgttagacatccaggtctagccatgtctgtacttctctaaatgtgactgtgtattcactgagattgctgctgagcctacctgagatcatgaggctgcttactcatcagtgaacagcatgaccacccttggtacacactccagcttcaagctaatggttcaggcatatctaaaatggccaatctctccaaacacttgggctgaattcattactcctgcctcattcctgaagtgcataatcaaattctaaagaccaattgcttgatattcatattttttttcctacagcaggttttactcagcaaaaaacggacaatactactcaatggataacttagtagttcagaagccatgttatgttttgtgcttgtatttttatctcatgagtaagactgtaattgtgaatgtttgtatattgtcttctgagtgttcttttctcctgatagccttccttctcatcttttctcagtctgtctcttatgagtcctgaaagtgggagcccctggtattccatgtacctgttttgtgaaaatggcagactctgctactcacttttctttattcataattatctatcttggcccaaatcctatttttctcccattctaattgagaaatttggttctcttctctctacattgagttgaaaatccccaggaacccaatagcagactggttgttaagttgatttggtcccaaaagaaccttaacaaaatcctctttctactcttatgaatcgaattcccaaaactcttttgaataaaccatcctggtttcctctaagctgatggttagagttgggtcatggagttcagggtggaagtattaactcagaaagtcaaactccagtgttttggggcctgtgggtgaatcaatgcttgaggaatattgtgaccatttatttgcctattctcttttgtccctgcccaaaacctcaatatagtgatattaaattttataaatgtggctcaaaacttgacaactattatatttgatattggactgcagccatcctctcagggatctctgccctcatttttttccactctgattacttgcctccgagtgaagggttcaagaataaatgcattaccaaaatgaagggaaacagtctttgaacttctgagtggagaactgtaaagtgaccaagaatttgattactagtcaggcttctagatggtttattaatgaagcagtgcattctccacgaggggaaagaaatgccattaatgttatacccttggcacggaagttcctatttaaggaaaagtaaatgcatagcctgcgccatgtcagaaaactaattttaacgttaacaatgagttgagtattcttatagttatgagaaaatattccagccttcattgccttccacaaataagttgctggaagtaaacgaggtgtgctatttcagtaccaatttagcaatacctctgctctattatcagcaacatgcacagttggttcatggcagaatgcaagccactcttgtctgtgaataagcatcaggctgactgtgcaggatgataattgctctgcctgcacttcctttggcacctactgatctccgctaagtggttagtaaaacatatttttgaaggaatgtcaagcacttctaaaaatttgaaggacttcatctttgattgttctttttcttatgtttaagtttgaagaaagttcacaccaagccattccacggctgccattactcctagcaaatgtctgaaatagcagggtgccagtgtgtctgtgcttggcatcttttaatcagcggtgttttctttttcatgatactgtgacactggctggatgtgttgggatatcaagtgacggacttcaaatagatggcaaattcactaaagtgaaaatgattgtggtagttccctcatttcctcctgcagtgtatgcaaaactgacttttaaagtgtttagtggataatagatcatgtaaggtcagtgctagccatggcagccatggctattattttcccttttcatgggagtgtgctcagcaaaatgagattgtcacactctttttttgagaggacagcgacagacagttaaaagcctcttcatgtaaggatgttatttcataaggacaccagcactggattatccccttcactttaaacttctgccagcttgtacaaagagataaaacaaaatagccctggtcccaggggtggggaagtgccggccagctcagcctgggtccacaggctttcattttgattcgtcacatgtgaggaaaattcacttaggctgagaggtaaatttaataccagttatgcccatgctgttcatatcacaaccattttcacatgatgccacttaattccctaagaagcagaaaggtaaatcggtggctggccagcaaaggtgtcacaatgcattaagaccaggactcgctgcaggggataatggttctgattgctgttgactcatgtctccaccaactgcctcatgtaaaataagtgacatttaaaagacatcaagatgtgagaagaggtaagggagagagaaagaaagagagaggagggtaaaaagtatgcgccactaaacttgccacccgaatgtgcagtttcttttccaccctaagtggtaggaaatgataactcgacatgccatgggtgacctgcgctaagcctttaacttcttgtcttgtgtttttagagaaaaatctgtaaaattgcttctgggaactgctccaacatgttatcatttatttccaatttaattttttttaaactcttattcttttgccctcacatatcagtctattcatctctttaaaagctttaggctgaatcaagttaggcagtggtagacaacaagaggcaggctactttctgaaggcccatttatgtctatttttataaagagaatcaaattccagtttacagtaagcatatgcttcagttgacatctgtttctaagacttggacgctttgtttgcataacagtcaccaataaatggccttgttttaagtctgctcactgagttgtatgtgggttgttcagctggggattttagtcgcagctgatcccctaccgctcatagctgataggaagggggaaaagccgagaagcccagtcctatttattaatgcagattttaacattctcaatgaaccacttatccagtgtgattcggcaaccaaatccttatttgctcaggcagaggagggggtgttcttaaagtgctgaattaaagctcttaccagctttttttttttttttggagggggaggggaatggggaagaagaagcaagagcaaggtcctttctttagccagtctctgataatttggagtacaatgagatcgaatctttaaacaggacatcataaaccaagcttatgtttaatgtatttgttgtaaactaagatgatcagatgtttgcagagccctaaatgttggccctttgtgcaaagtcttgatgattttatttaataccacttaaatatcagtttagagtttgatagaacagggttatgtttccttcattcatctggtttttgtttcattttaaagcatatctgattctgcatacgtgggaaacggacacaatattaaaatatttcaagatatacatgtgactgtctttagaatcgttactgctaattaaagaagttactacttgtgttaagcagcttcaaatacaaagctaatcctcggtctcgataagtctgcccttttttctctgcccctgaaaggcatgccagcagttaaaaatattaaaagtccaaagatggggtcgatgtgccttagagtgtaaacctgattaatagagggcttccctttaattcccttttttacatagaagagatctaactgtaatgtatttgaaaatatgtgttcactgacaaatacactgaactttttcccctgaattattgtataatattcagtaatcgtttatgaaatgtgtaacatttttcaaggggatttacatatcaacttttcctagtggaatcaacaacagtagcatgaaatgtatctactccatttactcttatccagtgctcctactttctttttccctttaatttttatatatggtaaaaatttcattgaagagagattttagatgacaggactgtaattttaaacccaatagaagaggtgtaagcaatttgagcttagctgaagcataatcttaggttgtcaagaagaaacccattctccctatgctaatcaatcagtgtatcaaccaaccaatcatctcttcagcttagcatatatcctaaggtttgatatatctattaactgcccatcatgcagctggtctctggatgatgagattccccctatcttggcatttggcggcagacgaccgagctatcacagcctcagataaataccaaagtggagatttcaatcctgttcctgagtgcagagacaatcgagaaacgttgaaaatattcttagaagagaatacgcagaaaattacatttctcaacactgttgtatgtgaaaattgtatatattacatgattctccctccctagacacaacaatgtaaaataaaattactcttttattatgattggaatgctggtaatcaaaagaattgttggaatctgctacaaactcttaattgcaagacaaattacatgtagacatctgaataagtaagactaatgaccgtgtagatgataaatttcctgaaaacaaacagaagcccaattatataaagcaaggcacacaatcattataattctggagaagggggtcactatttctaaagattttatattgcttcctggcctctattcagagattctgatattaggtaagctgcagctgaatgtatctgtagcctcttccaccagccagtgtattggagcatggaaaggaggcagggtttctataaaactgtttattgagaaatagaaaccaaaaaaaaaatgatttaattgctaagcatctgtgaatatgttgaaattgggatgagtatgattcatttcttcaaacactgatatccacctggaaggtaaaatctctccacaagatgcaaactcaaatcatgtctttcccacactatagttaaagtctcatactctgaaaagagaaccatagtgaggtattaggggactgaggttctagcccaaactcggtcattaactagctagcctctgtgtgctaagcaagcccctggatcctttagaccttacttcataaattgcaatgtctctaaagcacctatgaaaaacagtaacgaggcagggcgcggtggctcacgcctataatcccagcactttgggaggccgaggcgggcggatcgcaaggtcaggagatcaagaccatcctggctaacacagtgaaaccccctctctactaaaaaaatacaaaaaaattaggcgggcgtggtggcggacgcctgtagtcccagctactcgggaggctgaggcaggagaagggcgtgaacccaggaggcagagcttgcagtgagccgagatcgcgccactgcacaccagcctgggcgacagagcgagactctgtctcaaaaaaaaaaaaaaaaaaaaagaaaaagaaaaaagaaaaagaaaagaaaaatagtaatgaattactctcctgataagtaaacacgatttcatattcttccaaaaggttattgtttttcatgtcactaatggtatgaatgtagacttccaccatagtatttgctcagccaaaatctcttcaatgctgttgggcagcataaacaaatgagaaacatattctagcctaaatacaacgttctgggtttgaagccattgtttcaatcatttgttgagggtggggccaaggaggagaaatgatggagttcacaataacatgaactctttactgctggagagagaaggaaatctgttttctgtcctgagaagtccagcatgagttcatagagaccgtgatgacttctccgttctcaacaactcagcctgtgcactttgatctcaacttaagaacactcgtgtgtcctggtgtgaaagggctgataacaatataacagctctagaatttttgtatttttcctaacagaaggataattgtggtgtcaagttcagagcaagagttcggtttaaatagtgtattttgaaaacctttctcgaggagttgtgattctaagagaaaacaattttctatatggcttaaggttacgaattttatcatagcaaagagaaggggacaaaaaaaaaaacctagacagaatcattttctctctctcaagtcacttaaagcgtccattctaggactcattccaggctcctatgattagagacctgcatgtttgtagatatccccagataagccccagatatgagcacccatgacatggtctctgctgaacaaagcaaaaggattgatttagagaaagatggcctattgaatgtggattcttccatgttgctggcctggaaactggtaagcatgcacctttcaggcccagggcagtcctcctccccagaggatctatcctgtctattggtgataattgtcctgccaggtctacagattgtggatatagataagaaagtcagtgaaagtggattgagtgcaattagaaacttacccacacaagaactgacctgtgattgcatttgtaggtagaatcaggtctggagtagagagacagcatttaaagctcagcaaatagatcttgcaaaagaagagggattcattttttattgctgagttctaggtttagaacaattcgttgctattctccatgaatacagcataacttcatgtgcatcgtgtaaacatgcccccgagaagaaaacaatgaggtccctgtcctcaagcagtttatgttcaaagacaacataaagaaagagatcaaattattttaatgaaaccttgaaggtgggatcagcaaattttctttatcaaagtatgattgatttttgctttttaaaagaaaggtttgctcttatgttatgaattctctcaaatagaaaaagtgggcactaaaacagacgtgaggatgaaagtgaaaagaaggagagagaatgagatggacagagggaaaactgagggaatcaagggagggagaaagcaatgggcaaagtgaagggagggagttctttcagcttagaatacactggggctggagagtgagtatgcacccaaacatcaggcaccaaggtttgaccaccagttatagctagagagaatctccccaaaggtgtcctttccaacttgctcttggagagaccaccattaaccagtacaaagcttatgaatctctgcaggattctagaagcattatgctcagccattaaaacagtgcagcagacaagggaagaaagcaggcacagagaggagagggaacatagtgaatcctttataaacactctaaatggggggaaataatgacctctgacttctttgtggttctcaactcatgctgccacaagattggttataaggtccatatcacactgtgatatgaaagtattaattgaataggagcaatcagcatttctatgtgaataatgacttagaaataatattctgcccatttcaacaatggaacaggaaaccaaggcttcacctggctacacagttcttttgatgaggtcagatttttttttttaactctgaggtatatatattttgtgtcctcttttaacacttcaatctgatacgcatttctttggagtaacttaagaagatggaataaaattaagggaaggcaatatatgatagatgatagtattgtcctttaagttcaaattatgactttctgacagacaccttcatcagctctcatctgaatagtgactcttctattaaaagcaaagccttggccaggcccagtggctcacgcctgtaatcccagcactttgggaggctgaggtgggcggatcatgaggtcaggagatcgagaccatcctggctaacacgatgaaacaccgtatctactaaaaatacaaaaaattagccgggcatggtggcgggcgcctgtagtcccagctactcgggaggctgagtcaggagaatggcgtgaacctgggaggcaaagcttgcagtgagctgagatcatgccactgcactccagcctgggcaacagagcgagactctgcctcaaaaaaaaaaaaaaacaaaacaaaaaacaaacaaacaaaaaaacaaaccctcgtttagttcatagtaatgaaccaatgtcagtttcttaatttcgagaagtataagatgttaacaatgggagaaactgagcgaatgctaggaactctctactatctttgcaacttttctgtaaacctaaaattattccagaataaaaagcttatttaaagaaaaaaaatgcaaccatgtatatgggctttgccatgaacacgtttgaataagaaagccctcagtgctacatttatgggagcattttcttaatctttctggaaatgaacgctcattggagtttgatatcctgagaagctgatgactaaccctatgctcatgtataccaccagacaggtcactagctgatcaggctgaaatgctcacttatccagtgttgagtcagaaagagaggagaatttaaaattagctgacttcttggactggcacctagcactaaaataaaataatcccttagcatgtttactagccaaaacatactgtatcacattgtaagttgctttaaagtttgtattttctattaagcttgctgcatggtgatcatgtaaaagtgtctaatggttactgtaaaattagaggctgtccaaacgaaacttaaaatcctgaaactttctctccaatgtatgataattcttggctacactagtaaacagtttgacatgtgtttaaacataattcaatttttttatcagatcgtcttttcttaaaggtatgtctaatgaagtgtgtgactgtataatagaggagacagtatttgatttttaatttttatgttaaatggtttccactgttgtatgcccatttgagtttttacaataaaagacaaatataaaaatgtgtatctatatcactgtgcttaccatattgttttactgatgtttttgtgttcatcttttcccttaatgagtgaactccttgagaggaggggctgtggtcttagtatctcgcccagtgcaacatatagtaaggattcagtaaatatttgtttggatgaataaatgaatgaaatcacattcaaatgcattatttctcctttgaagggaaccaaatagctgccagtcaatttgctcccttcactgcccttgttttagggtggcctcacagtttggactggtttttatcattgctatcattcagccacatatactaacctttcaaatctgcaaaaagtatttaaaagaaagagaaattgttcatgtttcaaaacctattataatgcatcttcaaatatgtcagacacatctttgttaaaattaaaccagggattggttttgagcgaatagccctatatccttacagatgctgtggatggatgcatctaagctgcttattatattgatgggttttgctgctctgcagcaaatgaaagcaggcagctgcttcctccatcaaagcaaaaagcagcctgagtttttattaaccgagtgttcatttcttctattgccaaaattcttacacaaaacaaaagagcagttttagcacattattgcttaactagacatgaacaactgacagcaagtgataagcctgtctgcttttcacaactggtaatcatttttggaatagatgttttaatatagttgaatataaattttgtaatttacatctacaatggtacgtaaatttatagatccagtttgttgcaggagaatgaaggctataatcacaaaaggcttttcccagtgttgtttaatttttaatgactatttgaaaactggggaaggaaaatgaaatcaaattcatttccttaacaaaaaaaaaaggtgttaaagacaatcatacaagttggttggagacatttgtagatggccccaacagagcaagaccgctgtgtttacagccaggacgtgcttagcactacatttccacattagttgcagtgagctgcccaagttagtgcagcagcagaaatttttggagagcagactgtcacatttccttcatatcaatgaataatgatgagtggagatacaggaaggacagagtcctggccattttgcacagctgagattgtcagccagctctcatacatatatatgtgtatatatacacatacatatatatacatatatatatattttagcaatctgaatgtcatatatttaatttcagatggcatggcaaagtgaggtttgtttaaagtaggtttagactaaaccccaatgagatgttgccctacttaccatgtaaatttgctgagtagtgttttaccttttggaacttgctaatggcaattcctgctgttagaaggggaggcagttctcctccttcccccttccccacacagaaatgattctttcctcaagacctaagagaggaaacttggaataaatgcagtgtgatatgctgggacgtgcacctaaacaacattgctaaaataagttatgctgcctaacagcctgataccaggactgtttaatgaatgtgttctgttcttgcatctggaacatgcacctcctaaatactatttactctccaggaaaccttgcataaatgtgtagagcatgcattccacatggaacacatggctttcaatttgtttggaatttagccatagtgtttacctgcaaatgagataaagctggactccgaggcaggaaaatgctttagaaatcaaattcatgaatcacaggtaactccagggaagaagctcacttttgctattttggtatgccctgtaacaagtatgtgtctgtgttcgggatgtggctgaacacctaagacagggaacaataacaattattcctaatactttatttcctccactccattggcacattgctgctcttacgtgccttttcaagacatgacccagcactattttttatttatttatttatttatttatttatttatttatttatttattttgagacagggagagtctcgctctgttgcccaggctggagtgcagtggcatgatcttggctcactgcaacctccgcctccccggttcaagtgattctcctgcctcagcctccctgtaacacggcacagttttaaaagggaaaagggtgatctcatcagaatgatggcctgttcatcccaccctgaggacactcaagcacagcagggccttgggggaaggcattacttcccccacgtaaaggaataaaactgacaatgaaagtgttcctttttcttcttctcttttttgtttttccactgtgggaaggacatgtggtgtttctggggaaatccatgtcatgttttccctcctgctaggaactctgtggtctgattttctgggtccacctgtcctagacatgcttcttctcactttctgacatcctctctgaccaatggagatggagcattttctcacataggcccagatagctcacatcaggagatgttcttctacctgtgctttgagacctcaggagaatctcttctgcccttaggtagttttgttacactgaggagaaggaaattcttctgaggaaaaaaatacagcagagagctgtgctcaatattggagagggaaaatcatacttgaagatgttttctgttattaatatgcttgattaactaaataagcattcacatctagtttatataggtgtagggcagttattttctgaagctctgagatttaattaacaaaggtagttctaattccattgaaatagacatgtaatgaagatttaacttctaggaccatttcgaaacccatctaaaatatttcttggtagaggtttaaatttgagattatagtgaaaataaaatattttaaccaatctaatttctttaaaatgtcacaggctagagcccactggtaattttatagttttcatttggaagtgtacacatataatgatctctagtcattggatttagagttggaggaggcctcagaaatcaattcaactcttccatttttattcttgaagtgagagcccaaatatgatttgtccaaagtccccaaattagttattgacagagctatgagaactagcaactagttctcttgattctaggaccagccatcagggttggggcacagaatgcagtgatgagagactgggctctagagttagagtatgtgggcctaaaccctggctgtgccgcttcagcttactattctgtttatgctgtatttcactgtgccttttagctggtcataaggataatgcatatcttataggggttgttttaaggattaaatgtgatcatccatgtaaagtacacagcccagtgtttgccaggtagtaagtgttcaacaagtgatgctgccactgccaataataatagctgggtgtggtggctcacgcctgtaataccagcactttgggaggctgaggtgggtggattacctgaggtcaggagttcgagaccagactgactaacatggcgaaaccccgtctctactaaaaatataaaaatcagctgggtgtggtggtgtgtgcctgtaatcccagctgttcaggaggctggggcacgagaatcacttgaacccagaaggcagaggttgcagcgagccgagatcgccccactgcactccagcctgggcaacaaagtgagactccatctcaaaaaaaaaataacaacaataataataatactagcaaacactaactgagcacttactagctcctattctgattaatccccagtctatagtatggagtaggtagtattattactttcagataaggaatcggggaaggagaagttaaatgacttgctgaggtcacaaagatattaagtgtgagaggtgccttccaagttcatgtcttcacgctctaagccactgcggtgatggctatgaccgccgtgcatttctttttctcagcagtgcttccgtatcctctggtcctgtctccatttctcatctgtcactcagctgctttctcagcatctgctggaaaactgactatcagccctacgaccagggcctcggggaacgttgcctgaaggctgtcttcccctccctgcttcagtgtcaggacatggctgggaccttgtccatcttttctttacctcctaatcgtcacgttaatagtctgagttaaaatggacattttaaattttaatgcatttttaatcaaatcacacccataataaacaggccatcctatagtcctagaagaatttattgttgaaatacttgagtaattttttatgccccttcatttctcctgcttccacatgctccttatctgcccttctctcagctcaggtcagttggcaatcagattggacccttgtttttgtaatctagtgagaggcagcagatcccagaggttaagaataacaggtctataatcagattgcctgggctcaaattccagctctgtgacccagtatctgcatgactggggagaaggtttccaaacctccctgtgccttgatttcctcctctgcctcatagtccctgggcagcatcaacgttccataaattatagagtgtcacagggcaggcctccacctgcccacctgcccaccattctggaatattcagacattctctcctactcagatgttctttgtgacctggctccacaaatatagggaggcctgcacttaatcatatattgtacagagtgagtctgctaatgggtcaaagcgggaggacaagtatagaacatgtattgtccatatacatgtaatgattgttttggatccattttcaaagctcccgtaacaagggcacatttatccaaagttcagtttgttttgattttgtgggttatcaatgaggaataataatatccctgaaagtaccataaaaatgtaattcaggttgataaaattccctgaatagaaacttgtcacaacagtaatagcagcagcatcatttctgtttttaatagtaaaaaaaaaaaattactctatgttaggcacacttctgaatgtcttacatgcattatctcatttaatccccacagcaccccatgagaaggtacttttattgcttgtacttaacaaatgagagaagtgaggcattacccaacaatctggccaaagtagccacctgtcccactcccataattattctctatttcgttaacatgttttatttccttcacagcactattcactgtctgaaatgatcttacttgtgtctattttccctatgaaagttatttaggcaaaggccttgttttaatcactgctgtatcctcagcttctagaacaggcctggctgccttgataattgtatgttgcatgaataaatgaggcttaaaaagtttaaataccttgcccaagatcacagaaccataagagccagtattcaagctgcactgtaactcaggaagatgagagctggctttctgctgtagctttttatagttgaagaccccccagacataatctaacccaaggctatcattttgcagatgaggttactgaagctcagaaaggataaattactttctaatatcttacagtttgttagtggcagagccagaatcagaccccagatccctaggtagtgtttttttgcaccatgaattcagcctcctcatttcatataaaattgaaggaaaatcctatatgcgtctgctgtacatcatccgcccacttattcatgccataaacctaagtcatacttgacacttccctctccgttaccacccccttcatctaattaactagtaagtcttgtcagtgtaccttctaaatatatctcaaatctttccacttttcttcatctctgctaaccatcacccaagccaccaccagctctcatctggatattagtagtagcctcctgcctagtttctccctgcctcctcttgccccgtttcatctaatttcttagagtagccagaattatcttctaaacagtattataaatctggtcataccacgatgctgcctaaaacgtatcatttattctcaggtgtgacttaaaattcttaacatggcctctgggcctgaggggtctggcccctcaccacccctcctccagtcttatcttgtattactctcttcctttctcatttattctagagttccactgaccttatttccattcctacaacattaagccctcttgttaagactttgtttcatggagctccccttctgtggaccacttcttccactttgtcctcctcttccttctttattgtgttcttccccctctgggtctcaaactagactgaagccccagtgaccatgctatctccatccctgttgatccacaggacccgaaacattgtagatgcccaataaatatttgaggagcattctgtagtcctcttgtggatttctgcactgggttgacacatcagtgacaaagcagaaatgtgagttggattaaaagaaaaggagacagagtacaaagactgaaatgagcccaggaagcttccatactcattccaacatgagcagcttttctttttagtaacatctacccgtgcatttattcttccagaaggtttgatggcttagctaagtgtgtgttggcctctccacttgagtctcagatttgagagaggcctttttttactgactcctgtgtgataggcttgatcacttcccttgagggagctagagaaaggtgctgcttcgatggacatcagctgatcacagaaaagctgtatgtctgctgtgagagctagatgtgttgtcatcatggagcaagtacaagcagttggtggggaggagggagccagcagtgctgcttgttggatgctgtcgatcaaagccttaggactgtcctccaggacgaactatgagaagtgaaaagctcgcaaatggaactgatctagaaggccccaagcttagctggatcctcaggttactgaattttaggatttgctcagtcttcaggttaatcatagttgtgctgtttgtttccagattaactatgaaacttgacatttaaaataattctaggccaggtgcggtggctcatgcctgtaatcccagcactttgggaggctgaggcaggaggatcacttgagcccaggagttcgagaccagcctgagtaacatggtgaaaccctatctctaccaaaaatagaaaaattagctgggtgtggtggtgcacacctgtagtcccacctacttgggagagaatcacctaagcctaggaagtcaaggctgcagtgagccatgacggtgccactgcactccagcctggctgacagagtgagatcctgtctccaaaaataaaataaaataattcgaaactagctacttcactaacaataacaacaacaaagtggttgcttatattaagtagatcacattgccagttttccacctcactcttgctacacagacagctgttttagtgttggctggctataggctttctaaagtctgacaaattcaacaggcccagttctgacagaagcaactgcagggaaccaagcctttgttcaaaagaaatgtgataaaacaaaatgaccatagatatgcaagtatagtgtagtactcttccttttccagacagaactcttgtttagccaatgcttttatggaggcccaaaggatgaaggaggcctttcctcctatgaaataaactcatttgatttatacagaaagcactaaagaataggaaatgatatgcttcttaataacgtttataacgtgtttagagaatactttacctagaataaactattaatttaaagtttggggatgcttttttagattaacactttagctactataaatgccactttgggcattctgcagcacttcattgagtgacgtcaataatgtagcagaagtgctataattttcagataagcattataatctatttttttaaacttttattttaagttcagaggtacatgtgcaggtttgttttacagataaattgcatgtcacggaggtctggtgtacagattatttcatcacccagttaataaccatagtactataatattattaagggaacataagaaccttgggatctcatcattagtgttcttgtcttgtacgtccttctcctaaaaattattctcaccacctttccaatgaatttctctctagtctatgaagtccccctactcactattcttccagaatgagtgaatgaaaccccaccattctgagcttaaagcattgatgctaaaatgtactctggaagagataagaatatgtcttggattccagaactgtcctacaaaactatattcaaaagaccatgcatttctaggtttcaggtaaacttggagactgaacaatgcactcctttaagaaacctcactaaacctctacatagggatgttttttaaggcataaacccacgtgaatgacacattggccattttaaggggcagcatgcaatagcaataaaattttggaagctggaaggcaaatgcattgacttagcagatatgagaaagccagcagttggcaaagctgagaatcaacccaatttaaacttctggagccttgaaggctcggaaatcggtggcatcagatgtagctggttctccgtatccatggattctgcatctgaggattcagccaacctctgatccaaaatattcaaaaaaaaaaaaagactaaaaataacacaaaaatttttattttattttattttttgagacagggtctcactctgtcacccaggctggagtggagtggcgtgatctcggctcactgcaacctccaactcccaggttcaggcgattttcctgcctcagcctcccgaataactggaattataggcgtacaccaccatgcctggctaatttttgtatttttagtagaaacggggtttcactatgttggccagggttgtcttgaactcctgaccttaagtgatctgcccgcctcagcctcccaaagtgctgggattacaggcgtgagccactgtgcccggccaaaaatgtttaaaaacattatagcaaatatttacatagcacttatattggatatgcatgcaaatactacatcatgttatataagggactttaatatctgcaaattttggtatggagtggaggagtcctagaactaatcccccacaaatattgaggggcagttgtacttctaaaagaaggagttgaaggggatgaaactaaggagaattgattgaaagttgtttaagaagtagttatatccccatttcaggtgactgggcaactcttctccctctactccaacaaaaaactggaggtttattctttggagagggttaaactggggattttgggcttgggagacaccaggtacagttgaaagcagagaatacgaaaagccaggtggagtgactaagtgaacatatgcagactgaatgatgagccccacaccctcaccccactcacctacactcagccttctttacttccagaattaccagatacctgagggaagcttttaatgtgacagataacaaaaccaagaaacagaaaaaaacaacttgaaaaaaacagactttataaagatgagaaaacttaaaagaaactataattaatactttcaaataattaagacattgcattcatgaaacaggaataggatgcttataaaagaaacattcagagaatgaccatcaataacaatagcatatattaaaagaacaataaaaaggttagaagataaagttgaggacatttccaagaaagtagaaaacaataagagatgcaaagcaagaaagaaaagattttttaaaataaaaggatgagttcaggagattcaacatccaaataataacagttgcagaagaagagaacagagaaatatggagtaaggaaataatcgatgatactttgtaagaaactttccaagaactgaagaacatggagtttctggattgaaattacccactgaatcatgcaagttcttaaacatttacctctcctaccccctttttcaagaaactactggaggacgtgttacactaaaatgagggaataaaccaagaaagaggaagacaatgggtagaggaaacaagagatggaacccaggagaaaggcaaaaggagcctgggatgatagtgaagattaggctgtcagctgtgtaccaagcatagagggcattcagtccagactaaggcaggttagaagataccaggagagatttcctcataaggttgatagaacacccattgtgaatgaatgtattgagaggagaaattgacaactgaagtttgaggttgcctaaaaatcttagcaaatgaggggggaaaagacctttataaactccagagaaaacaaaaatgtgtgcatgaaagaaaaaacaatcatagtttactacatagctgttttatttcctagtcataataaaatcaactggggagtgatcttaccaaaattttaacattataactattattgtaatattaaaatataatattaagcagatggcgtggggtggataaggggcacacatatgtgatgtgggaagaggaatagagataaaagcaaaaaatgctaattttgcacagtgaggggtcagtagattttgcttgaaactgaaaaatcaagaagcaacaatacaaacttattatgtagaaatataaacacaattaccagaagagttagctaaaagagttgaaagtaatagtttctggggaagcagaaatactggggaaaggggcttggtgctactgtttgtcttagccattctaatagatcccaatggctctttaaactatgtgtctctataactaatttgaaaagaaaatctttttgaaaggcaattttattcccacaaataagaatgagaaaactttaaaaagtagcagctttattgagatataattcacataccatacaattcatccagtggtagttagtgtattcacacacttgtgcaactgtcaccacaattttagaatattttgtcacctccaaaagaaaccttatactcattggcagtcatgctccatttacacctaaccattgttgccctgggcagttaccatgccacactccatctttatgaatatacctattctggatatttcatataaataaaaacatacaacatgtggtcctttgtaactggtttctttcactcagtacaggcataccttggagatattgagggtttggttccagaccactgcaattaagtgaatatcacaataaagtaagtcacacaaattctttgctttcctggtgcatataaaagtttgcactatactgtagcttaagtgtgcaatagcattatgtctaaaaagatgcacataccttactaaaaatactttattgctaaaaaatactaatgattatctgagctttctgtgagttgtcatctttttgctggcagagggtcttgccttgatgatggctgctaactgatggttagcagggtgatggttgctgaaagttagggtggctgtggcaatttcttaaaataagacaatgcagtttgccacattggttgactcttcctttcaggaaagatttcgctgtagcatgcgatgctatttgacagcattttacccacagtagaacttctttcgaaattggagtcaatcctctcaaaccctgccactgctttatcaactcagtttatgtaatattctaaatcctttgttgtaatttcgacagtgttcacagcatcttcaccaggaattgattccatcttaagaaactaccttctttacccgtgcgtaagaaggaactcctcatcctttcaggtttgatcatgagattgcagcaattcagtcacgtcttcaggctccatttctcattctagttctcttgctatttccacctctcaaaatcatccacgaatgttgaaatcaattcttccaactcctgttaacactgatattttgacctcctcccatgactcacaaatgttcttaatggcatctagaatagtgagtcctttccagaagattttcaactgactttgctcagatgcatcagaagaatcactgtatttggcagctatatccttatgaaatgtatttctgaaataataagatttgaaagtcaaaatgactccttgatccatggactacagaatggatgctgtgttagcaggcatggaaacaacattaatctccttgcatatctccatcagtgccctttggtgaccaggtgcattgtcaatgagcagtatataatattttgaagggaagtgcttttttcggagcagtaggtcttagcagtgagcttaaaatattcagtaaaccatgctataaacagatgtactatcatccaggctttactgttccatttatagagcataagcagagtagattttgcataattccttttctcttattttttttttaagagacagggtttcactatgttgtccagggtggagtgcagtggctattcacatattcaatcctagcccactacagcctccagctcctgggcttactcaagcaatcctccttcctcgccctcctgagtagcccgataggcacctgccactgagccaggctagacttagcataattcttaaaggcgctatgatttttagaatggtgcagagcattggcatcaacttagtcaccagccgcactagcccctaacaagagactcagcctgtcctttggatctttgaagccaggcagtgaattctctctagctaccaaagtcctagatggcatctgcttccaatggaaggcttccaatgtttgtctgcattgaaaatctgttggttagtgtagtcatcttcatcagtgatcttagctacatcttctggataacttgctacagcttctacatcagcacttactgctttgccttgcacttttgtgttacagaaatggcttctttatttaaacatcttgaactaacctccactagcttcaaacttttcttctgcagattcctcaccttcagccttcatagaattgaagagttagggccttgctctggattgggctttggcttaagagaacgttgtggctggtttgatctatccagaccactaaaactttctccatatcagcaataaggctgttttgtcttcttatcattcgtgtgttcactggagtaacacttttaagttccttcaagaacttttcttttacattcacaacttgtctgtttagtgcaagaggcctagctttcagcctatctcagctttcaacatgccttctccataagtggaatcatttctagcttttgatttaaagtgagagacatgcaactattcctttcacttgaacacttagagaccatttgttaagtttattaattagcctaataatagggaggcctggggagagggagagagatgggggaatgccgactggtggagaagtcagaacacacacaagatttattgattaagtttgctagctatcttatatggacgcaattcatgccgccccaaaacaattaccatagtaacatcaaaggtcattgatcacagatcaccatatcagatataataataatgaaaaattttgaaatattgtgagaatgaccaaaatctgtcacagagacactagttgagcacatgctgttggaaaaatggcaccaatggacttgctcggtgcagggttgccacaaaccttcaatttgtaaaactgtagatatgcagcatctacaaagcacaataaagaaagctgcaataaaatggagtattgcctgtataacgttttcaagtcccatctatgttgtagcatgtatcagttcttcttttattgtcaaataataatccattgtatggacgtaccacattttatttatccgttagtcagttgatggacattggggttgtttccacttttgggctactaagaacaatgctgctatgagcattcgtgtacaagtttttgttggacatattttgatttatcttgggtagcagtggaattgctgggtcatattataatctacatttaaccttttaaggaactgctacacaattttccaaagtggctacatgattttacattcccaccagcagtgcatcagggttccaatttctccacatcctcaccagcccaacattcgttataacctgactatttgattgtagccatcctagtgggtgtgaagtggtatctcatttaggttttgattttcactgagataacttttaaaaacttagattagcaaaaattagttatgttgaaaaaatcctatctgggcaaggctttgaggaaacaaacactctgattaggagtgtaacttggtgcacattttatggaggtcagtttgatatatttaaatgcaaaatatatgtaacctctgaccagatatcccatttcctagtatttgacctaaggagaaaaccataggttgggaaaagatgggttgtcatattgtactactgttgatgttaatggcaaaaaccacaattacttttgcatcaacacaataatctcatcatatcaacaactttgaaactaacttaaatgtctgtcaagaggaaactggttaaatgaattctgattcacacatagaatgtctaagcaatcattataaataatgatgcaggtaaagtacatttttattttctagtaaagctatctaccacatattgaatgagggaaaatcaggttattgaatatcttcatgaaaagatcccattggtgtaaaatatctgtttgcctagaaagatcttttgagatgacgtccaaaatgttaacagtgattatatcctagtggtcacattttacgtgatttttttttttactttgttctttgtatgtaattttgttaaaaatcagcctctataattttttgagacaattataaaactattacaaagtactgcattttagaagtcgcatttttgtacttaatcaaggcttaaattttagttagatactctttgtctatcatttttttaaaacctcaagctaaaggcataaagaaattcattatagtggtgattatgttcacttggtgtagagcattgtcttatgctcttccttcagagacttttatttatactttggtcttaatagagttatttttatgtggagatatgaccggtattaggatttgcagtaacaggtcaaaatggttttccatttttctggttattgggatacgaattttggattcacatattctctcttccactcttccatccctctttgctggagaataacattaacaatgctttctttttctttgatcttattatgtgttaggaaccattctaaacataggcatgtattttactcatctctcaggccagtcctgtgaggttgacaatactgcaatgatattttacaaatgaggagcatgagggataggcaggttaagtaacctgtccaaggtcactccacaggggaatggcagagctggcactggagcccaataagtctggttccaaaatatctgtgatcttaactgccacattccactgcctctcttactttcctcctaaatatgactccaaacacttcttgctggttttccttgtttctccctcaagctgtcattcctaccagaaatgccagagaggctgaggtagtgtgtacacctgactgggcttccctgcaacaaatgctctatggagacacctctttgctgtttatatatttaccccctgaatctcttaggagtttacttaacatttctttaacaccctcttctctgaaatgtttggatttcttagtcctcaaagttggaggttcatctaggggaaaaaaattaagccttttgtagatgtttcaaccttgcattaagaccatcagcagagtgcttggtgttgagtcagagaacatttgccacccgttcccaggactgcatggtgctctcagccttaggaagtgcaagatgcctggtgctctgactgatctttgagtttgattaattgggggaaaacataatttttataaggttatagtttattctaattataagggtagtatatgcttattgtaaaaattttggaaaatacaaaaaagcataaagaaaaaaattaaaaacacttataatcctaccatcctgtgataacaactagaaactacaatttccaagcatgtttgtcttctctttaagcaattcatatccattcatgaagactaagtatttgaaatcagtgatttatggatgacaattttagaaaatgtccatccatgcaatttagcaggtagaattattgttaaatttaaagatgtaccaaagttggtgaaattaaaatttcttaatcttacacagcagtttgattttatttaactgaagaaagacataattgtggccaggcacagtagctcacacttgtaatcccagcactttgggaggccgaggcaggcagatcacgaggtcaggagttcgagaccagcttgaccaacatggtgaaacccagtctctactgaaaatacaaaaattagctgggcgtggtggtgtgcacctgtaatctcagctactcaggaggctgaggcaggagaatcacttgaatccaggaggcagactttacagtgagctgagatctcgccactgcactccagcctggcgacagagcaagactctaaaaaaaaaaaaaaaaaaaaaaagacagaattgtgcatgtttaaaaatattagcatggaatcaaacaaaaaagtgtagtgacgtcagtggttttgtttgctcctgtgtgtgatcgtcccatttatttttgcctaatatgggctgcatatataagcaagtcttcaactgatactaattaattttatgtgcacaagatgaagatctatgtgaagtaccatcaaaatttaacttgatatttgtgattttggttgttactgttttggctatcttgtgatcaaaatttagtataatttatttaggatatttttctattatccttgggaaagagttataaatctcaccactataaaaataacaacaataaaagacacccgtgacatgacatattataagtaataacaatgttgtttgattgaagttgaaatagcttgtactgaacattatttttaaaagccgtttcttaaaagaatgacttctataatcaaaaggtttatcctcttgtgttttctaggcatctggccatctgaagaggttttggcttactactgcctcaagcacaataatatattcaggtacagagctgcacttaagatattttttagcccatcacggatattgaatcaacatattaaaaattgccatgattatattcttcaaattaaattgttagaaaaaaatataagaaaagaaaaacaggaagaaaaggaaaacagaaagaggggaaaaagttcacagtgaacacatgttgcttctcaagtgaaatctgaattgccttgggtactaatattgcacagcaaggtttttgctatatgtcaaaggcttttgatttccactcaaggcattttatttcactttgatttgggggaaacaaaagtgaagctccaatcaatccttactgattgtgaaggtcaaaaaaaaaaaaaaaaaaaccaataaagacattctttaaacttctgctggggaagtcactacagaatgtctgatagataaatacctcacagctattatttaatgatgccatcccacccctggttttaaaggtagttttatatatctaacaatatgtatttgtgaactataaattaccattacggattcatgctacggaaataagtgttttcaactgttagtgtgcattacagatcgaacccatggatggaatttaggaaaaaaaaaaaaaactttatttgaaaattctaaagatgtttggtagacccagaaaatataggtttttcattttaattctcattttataaaagtcattcaatatatacttcctgaatagctcattatgatagcagataagccgctagtgatcatagcgtgtgttttaaccgtatgtacttacaagattgggtcaataatatgtatttttttaagctctatgggtccatatttaccaaccagtctacaattgctttaaacaaccaaacactcattaagtgtgttttgaaatattaatgtccttgcttggcttcttctcctccctttccccctcttcccacctctccctctcttttaattttgctttttttctcctcttgaggtaataaacttcccaaactgggaagaggaaacaatcctaagagtctaagcatataaataagaacagggcaattttgaatgtgggctgcagagctgccctggaagtctggcatttgttcatctcgctgtgcttaagcttgactggagctccaatcagcgagcagtgggccagggcgagaatgtcacacgttaagggctgatatttaggcacaaaggggaaggtaagtgcagagtgccaccctagactgtcagctttaactctgagccgctttacttttgagctgtgaagtcagagcccagtcattactttagcctgggtttgctggcttaaccatattatgtccctgcattgtttattcactgtgttgtgttggggtcaattgtgatttaagtgttaattgctaaatgctctttgtgtaattgttctttatggggactgttcagctttccaaaatgtttcagtttgtttaagaatttttttttaaaattcaggattgcatctatttattttgtgtgtgttgtttgtatgtaactataatataggtatatacacactcatatatattcttcatttacttgtctaactgtttttgaaggaatgaatgtggattaacagtgttatcctttcctaacacttctctttcgctactctagctagtttagttctaaaagacagcgccattgacaagggaaaaaaagggaaccttctcagatttttcagctcagcggtggtaatgttgcagtgaacactaatgagggaacccccactgatttgcctgctttgtgacttttctatttcataattatttttaaaacgcaaaacgacatgaggtagcctagtcatgtctctacaacttcctggtagcgccgttcttactgcagatggcaatttgttcttgtaacatatatctctctctgaccattttcatctaatttgtatgggttctaccatttcttttctctctttcagggcccttgctgtgtgtgagctagggggtggcatgacatgcttggctgggctcatggtaggtcttttctccattccaatcccattcagagggaggaacaaaaggaaaaatgttccagggcctccaactgctgggtcagagaaccgtcaacagcatcagctgcggtcaagctgccgggtcttgagagaccttctagattgacttactttcggatcatattgattttatggttgcctcgatgagcagaaacattttacctcagtgtagtcaatattgcttgttgtgacattccaggcctcgcacagtctttctttgccatagcgaaagcattttttttttttttttcagattatagtcccatttgctaagatacaggaatagcccggcgaatcacagttggagcaccatgatatagctgctaatgttttgcctgcattattacaccaacaaacatgatccagagcgctcagtaattagattcttttgaattagattggccattcaggaacgtcgttccccattctctgggttctgagtcatgtattcaggagatattatgtagcagcacagtgcattagacaagtttttatgtctctacaaataaaagcatattgttacactgattggcatttgacaaacctgtcgctcttatacaatgtgtcgaggttacagcccaatgtgcgagcatgtcaaagctcacaaaaaaattaccctcacaaagccatctgcctgcaatgcaaagttatatgaagggcatcaggcagtcagacagaagcaagctgaaaggcagagtgacagccttgtatgatggctctactagataaacagaagcccacaaatgaaagcctctcagaataccatcatccgctgtcacaatgcaattaccgaacagaatgatagcaagatagaggctcccgcaaatggaatgataaaagtattgactgatttgattgaatgattaaaataatgcagacataaaatgaaaaaagattgaagattgttacagagaaataggtgaggaagcatgatactgaaggcttgtcactcctgtcttcacttccacacagacaagcatatttgctcattgtttgctgtgctcccttttttttttcaggttgctatttctgcagatgtcaaagaagttctgttaactgatgggaatgaaaaggccatcagaagtatccttattcagatagaaaacgggtttgttgtgctcattcctttttcctggctgagtaacaattgatataaagaaagacagcatggggtattaaaagagagtttcccccctacatacatgataagtaattaagaaaaagtagaaatatatgaattccttgcatacaactccgtaggtttttttctttccatagatttttatagacatctctcatgaaaggagcctatttttgtggacctcccgaggcaataagaaaatttgtttcataataattttcaagcattcttgttcttttatttccattggaatttgccagtgtaaaacaaattatttggtatttattgtatttggatattgctggcaaatattaacttccagcttcatgtttgttattacatttatacacttgatattgtatgtactgtataatattgtgcctggtctaattgctgagggtacctatatcccccactggaacagctgtcagttcttcattatttccttttatttaggattttatttaggattatacaagctatctctatttttctgctatgctattgcagttcaaactccattagattatgctttactaatatgtacacagagttcatgaaaattgaactgtactttaactaagaaagcaagcataaatgtagctactttagcagtcgagctgatttgttcaggggcagttaacagctgttagaaactgagaggaaaagtggcagatatgtttgctttggatttttttttttttttttttttttttggtgtgccttacatttacattatgagggagacaatctacttatttgaattttaagctcctaaactgccaaagcagttttgatttctgtggcatcttacatacaatctatttctgattttctttttcgacttctgccatatgattttttcaaaatatgcagcagcttcatcaagctgctcaaacaggagaaaggaggaacgagaagcacagtagctaatattgttcagtaacacttgtatgctctacagagccccacccagctaattgcctgacagacttaaaaaaaattcaggaaggaaaaacagccaatcacaatcttggcctttcacacaagggaaggagatcacaaaaggtgcttcctttttttaaatgcaggattttaatcacgttcttgagactgtctcaagtttttcaaaatattcctgaagatgagcagatgttttttcattcactctgctttattctgagttatttcgtgcatgtatccatgtatcatttcactgtgctcctcctccttatgtcagggaatacagagcaagaggaagctcaggtatgccagctcagccccagagaatttttagagggtggggggagcaggattattggacaagagaagattattttagccacagaaactttcagcttgggcccggtaacctaaggtttttttcaagtcagcaggtgtcttatttaatagcgtcagaaaccaattagaacttttatcaaactatgggaaacatctgtagtcagtatgtaagtctaattgttctaaaattattattgagctaaactacagagcttccaaagaagggaagcaatgctaatgtcattaattaacacacctttgctttaaacaacaaagatgccatgccagcttttgaaatcagagaggaaatctcagattctgtattcattctgccggcctttcaaagaaatgattggtacagccccctcccaagaaaatggatttttaacatttggtcctcagaagctcagccctgagagtgctttattgtgctgggttttacaatgggtttaatatagcggggtgccaaagggcaggaggggaagaactttacaaagtagataaagtaggtcttttcaggatgcagaccaaaactggtagtgtgttttatttcatctcttaggactttcctgatggagttccgtttttaccatgcagttgttctgtgtttgtatgcctttttctgttgtaaccagatctaattttttttaattaagagaaaaagcatgcataaagccttaaaattggcaatgtgtttttcctgcttttaatactaatgttattcttgatttgctaacagagcttacaattggcattcgttgtcatctgttttactgactgaggttaatatgaatgatttttttttctatttgcatgcccactttctgtaagaataactaattcactgaatcacatactattgatgcatatagattgaaacaaacttatttaaaaattactgtttacatctttcctttaaaattttaggaagtctaaattatatagcagttgtaggatattattcaaaaattactttctaagaagtaaaagtggatgtcaacaaaaaaagggggagaaacattgccagaagccagaaaatctgttagtaaagctgctaattattcttaatgggcaagatgagcacattaagaaacaaatgaatacatcagtgaaatgtaattgaaaattggcctggcaatggcatatcgcatctgagtattggcctgtatattattcttatcattttaaaaattattttttttgttcttggcttctgaatttaatgaatccaactgaatcttcttagtctcttaagcttctaagattctgatttttacctttttttaaaaaaaaaaacagcatttcctgatatttccttttaattttatattatttctatttgttttagtatgtgaggcaatgaatggattggttctgaatctttatatcacagaagcatgtcaaccagttttgagtttatttattatctccctaaaatgtatcagatggattgcctatgtcttcttgagttttccaacttgactctgaaaagctagatgttgatctgagatttattaaacagagatgtctggaaagatattaagacttgaggtaaaaatttttaagtcacaaatattttcttagattcatgggtagttttccctaaagtctccttgatccttaaactgcattgctgggtctacgaactcaaagcccccacacctgagagctgctcttccctacagatgccattttatctgtaccccaagagaacaaaggataaattagaaatgggatcatttggtttgtccagttctcaaatttattctaaaatagtgtgaaacatgttccttttcttttttttttggcaatgcccctttagtgtcaagaaagaaatcttcaactgcccacatataataattactccataaggtttgtaacttgtgataacaatgacctaggaataggagagagacatggtatactgagttattattgatgctaagcctcttctaaattataatgaataaaagtagaactcctgaaggtgagcaaccctctctggctacaatcactaatgtgcccagcacaagcaccctgccttagtaaacatctagcagttctatgcagaaaattccaatgtttggtgacccatttctctgtaagcatcttatccccaaagtatgcacagtgtggatcatgatcttgaacttaggattctccaaaaatgggtaaatcccctgtgctttttaaaggagacacccctggtttaacattatttttatttaatacaatccctgacttgagtaactaataagtgaagcttcgtgtgggctgtgcagcctgtaccatagatggttaataacacggaaatcccgggccatcttcctgtgtccaggcttcttcttccaatgccggctgtacttccatctactgatgagtcataagtaaactatatgtgcctcagattgggtagcagcacaacaaatatgtattttttggaattaaattaaaattaattcaaccaatattaatggcatgtcattacaggtgctaaagatacaatagtgaacaagataggtctagtacctatccttgtggggcacagattttgccttggctagaatacatttatatacatgaagggcagaagttctttgataactttggttatttaaattctacagtataaatgttcacataattaattctaactttttttcttctcctttttgtggagaatgaggtcttgctgtgttgcccaggcagtcttgaacttctgggctcaagctatcctcctgcctccacctccctaagtgttgggattacaggcgtgagccactgtgcccggttcaggtaattaattctaagcagcaggaaaagaaaataaagtgtaactgccaaacctcatgttagttactttacccacctcttcaccctaccaaagcttttgcctgaattatacactaagataatgaattgacgtgaattgggcacctactgtgtgccaggcccatcacacgtgatactccattaagcctaacaaataggtatcattacttctgttttagagatggagctcagagagattaatttatcccaggacacgcagcccccaaatattagaaccagcactagaagccaggttcatttgacttcaaagcttatgttttttcgacttaaaccattctgggtcaccaaaaactaaaatgatttggtgaacgtcatcttgcatttccttacatgctctggaaataaaggcctctcatccacgaacataacaattggcattgctaacagagtttatagtacctctatggtatcttctcaattcatatgagtaataagcacatttaagaatattttgcagccttaaattagcaaatattgccacattaagcattaaaaaaaaaacttgagagatcaaaatgaatagggtttatattataatctcatagtttcctaccctcatttttggtattccagcgaaaataaagataacataaaccaagaaagtggtgctttgtgaatcacagtgttattatttttgaaatatcttcttgcttaaacaacatgccaactctcaaaatatatatataactactgataaataattgctaattgcaggaggaggctgatatttttaacaatatgatgcatacatataacatgtatataatttgtttaaattactattatataaaaatattttttaagaataaaaatcaactgaaacaaaattgaaatggagccctacctctgaacggggctttatttgagaagaaaacctagagttagaattccggtttctttttagccacaaacatatatcctgtagctctggaagtccagttgcctagacaaggggattggaggcaattactctgtattcatttaatcagaaatcacattaaggctttctttgcacccagtccctcccactgaagtcctccagaaggtgggtgcggttcagagaacacgatttggcccgttgtgttgaacactatcctggacatatcgactcaatgtgattggatttcctttattacactgaggtgacacagaagaatgataaaatctattattggacaacacagtgccgtccagaagaaccatcaaaatctgacctaaagtaaggggtggggagcaggatgtctgaatttatctcttaaggtaatattttaatatactgttgacattttttcttctcatgctcattttaatatttaaaaaaacctcttaaaccacaaaacttatttcctgtccagttctaaaaataaagcagcctaaatactgctgtcgaatttttttatttaaaaaattgcttctagaatataaatacatatgtttgcttcagcctgaccacctggagtcacaggtttataaattgtataaaagtatatagtgttaagatgtttactaaaaattattaataggttttctgagttatataatttaacttccctgagactattttataaaaagtattacctccactaacaaaataatatgttttgcttgatagattagtcatgtactcatacgactctacaggtgtactgggcacattatggcatgcggttggatgccatggaaactctaaggagggtgtggccagagtgtgggggaacttaatcaaaaacagttgtcagctgactctttactaattttgttcttctcagaataaagatgtcagctgtccttttctgcaagacatttcatttagaagactttcctgaaataatttcttcctgaaatagacagaactgtaggccgatgtgtcattttagttaatcaaaacaagtaggcaaattagtctcttttatttttttaatgaatgtaatttaacggtatttaatttgcatacaggaaagttcacccaggaaaaaaaaagtctgcattatagcacttttgtaaacctcaacaaagcccttcattagcagacctaattgatttttcctacccacccctgggggaagaaagctatcacagtacctgcttattcactcagagaagaaatgggtgtgcctggtggttcaagcagagatttgggttaaaaagtcctgtggctctgtttttgcagggagatcttggtcaatgcttgctttgagcattcaggaaatttgtttttctgagcaataggagaacatcgcttgtctgcttggtgtcctccccatgggcccaatttagttcaacttgcagccttcactggaattattttatttcttgtttatgtaaacctgccttattccaaaagagggattttgaggcttcttaccatgacacatagaatatatcatataaaatgaatgggaaagtgagggcagttggaaattggaaagccaggaaaatatgatgaagccaggaatagaggtcagtagagaaaacatacgcaacagggtcttttgtggttgttagagttaggccacacatttggctctgagttgcacaggtgctggagcaaagaaaaagaggatcaactctaagagttatagtgccaggaagtggaagcaacatcccttgatctgcagaccagcctttcctggtgctgaaacctgactattttttccaacaggcccttgtaaatatggcgctgggtgatgtaatgaaccagctcctgaaaacatgtcttccataaatgtggctcttttgtacaagtccttccatgccaaaggccatagcgtaagtctgtaaagacagttcttcaggggacttttcactcaactgactttcttcagtaattcattttctctcaaagattctccaagattttcttcatctttttcttctcacttcctcccaagtgtcatcctgctgctcctctccacccctccctagcagcatttaggagattggaaatacttcacactggaaagtctcaggagactgacattgctctccctgctgacagagaggcttgcctttggactccttgcccttttaagcaagtaggacatggcacctatgggacagtcatttcccaccagcactcataactctggggcttgccatgatgatccatctcaggtgataaaatgcagcccagggaagtaaaagagcttgcctgtggcaagtcagcatcctgcttcacacctcacatacagctcttctcctttcgctgtgctcatcccatgtatgataaaaagattggccaggcgcagtggctcacacctgtaatcccagtattttgggaaactgagacaggtggattacctgaggtcaggagttcgagaccagcctggccaacatggtgaagcccatctctactaaagatacaaaaattagctgggtgtggtggctcatgcctttagtcccagctactagggaggctgaggtgggaggatcacttgaacccaggaggtagagggtgcagtgagctgagatcacgccactgcactccagcctgggcaacagagcgagaccctgtctcaaaaaaaaaaaaaaaaaaaagataactgtttctggacctttttttttggtcacttcacaatcagtgcagatgttttcttaactgtgtcctgtagatgtgcaagacatcatcacaaggaatcagaaggctggtgtgtttaagacccagaaaatatcaagctggtaagatacctttctgcattaaaaaattcccattgaaattgcttttcttgatactatggatggttattaaaaataataatagctaacatttattgagcacctgctgtgtgtcaggcactgttttaagcactttacaagtattatctcatttaatgctcattggaatactatgaggcagacagacactctcattagctccaattaatagatgagaaaacaagataagtatattaaacactgggttggggatgatttatgattatacagtatgaggttgggagaagccaggcctgggaactccttaaatggctctcttccagtgagtctcagcctaggagcagttttgcccccaaggggacttttggcattccctggagatatttttttttgttgtcatgacttggtaggagagcggggaatgttgctactggcatctagtggtagagaccagggattccactgaacatcctatgttgcttaggacacccccgtacaacaaagaaacatctggcccagaatgtcaatagtgccaacactgagaaaccctgctctgtttcatgattttaaaatagtctaggtgtccattcgcttttagattctgttaattcttatacaaactaggaggaatgcttgctcttagccacaacaatggtgtgttctgtgatgctacattttatttttgccctgttggtaatggatctagagaagtgagtaatcatttcatagttttcacatgaaacagctgtatttgtgcattttttgtcattcatttaaccacagactttattagaataactctctgttaaattaattgttttctttattactgtgaagctgtcatcatttggtattttgaattttccctatggtaaagacactttcccaccccaacttcccagtttgattttttttattagttatataaactactcattaacagacaaagcccacagactgatttctcttggacacacccacgatacagccccggcagccagtgatcttggtgtgctggcttcggacatgaaaatagctacaatgcttaaaaaccaaagtgatgacacatattggtgtgaggctatggaatagcaataatttttttctcttatattaattggtgaatgtaatgaagtgtccatagtgtatttttaaatcctgtttaaaatgttgggagtaagctggtggcacaggggacagcatattctgtgtttctcatataaatgaacaaaccacttctgtttcccagaaaacctggggtaggttgagagaaagagaaagggtctgccgttacctgtggggtcctcattgttaggacagcctttccttcacagtgcagacggccttacccttctggagaggacttcgtttttggacatgattttcaacctggtcttttagttatcaatcaaaagtgcattttctatgttgtcctcatttacatttatttaatgtttaaggtcatttgtgagcatttgagtgtatttcagcatatggaatcagggaataatagatttcagcttcatgctgtgaagagagattgtgtttttacaagacataatgttgtttactgggtgttaataatcactaattaataaacatatctagacatctaaaatgttgcattttgaggaacaaaaatgtcaagtgtttaacttatggagtgcaatggtattttctgtcatctcttcataaaataattaagttacataaacaagcaaaatgtcattattcaacaaaggacatataccaaatgcttaatacatggcctttgtttctatttttctgttctcaaaaatgctatttctagatatattgctctgatatgtacctggacatatagactatatgtcaataatagtcatatagaaacctccaagatgaggatgggctttttttgtcatcttcatctcatactaattgtggtcagtttcttttcttttgacccctgtaagcattttgttcaaagtctactaaagcactttctagtgaacaggtagatgagttagtccttgaaatgccttgatcttatattaaggagtgacctgatcacttaactgtcaagaagctaagagaaatggccagccactgatgtaataatcagtattctccctccatccactgctttcccacccataaccagtacaatgtgatgaaagtattagttccatgagagaagaaataaaaggaagccattcacaaaagagctaagatagagttcaatattcttttttagtgcctcagtgcatatgcagaatttctcctccaaattggagatgtggaataagagtagtgacagataactaagaagtatttaccatagctataaagcccacatgtgagccaaatatttctgctattaaatagcacttcaaagcttgacatgaggtttgtaacagctgaatgtctcttgtgacttcatttgcaaagaagatgtataagctgaaaggaaagtcgtggtatgagaactataagcctaagaaatggtatttaaaaaaaaaaaaaaaaacaagctgcccagaaatttgactggcacccaagctcctattcccactactccgatgatgttctcagtaactatcagcatttctcctgctaccaacctcttcctacctcttacacaggggcagacccaggttgtgtggggcctgaaacttattttgagggcccacttaggaagaatgaattctattataccttactttgataaattttacagaaatatatgaccatgtgaacacattactagggcttgtccaagggccttggaaggggccttgcaagaggctctgacgctgaaccttcattagcttcacagtcaatccacctctgctgtcataagcaccaccatccttgcctaaagtaactcttctcttagctaccaaactttcctgctccctctatccattttaatcatagtctgattgtagctaaatgtgaaagacatgctggtgaaagtctggaagccttagccctagctgaatctaagatccacatatatgaagaattatattcattacatctcagcttaatgcagtcatttggtttatttgttgtccatccatgcagccatccattcacttaacaagtatgtccaaagtactctgcttttgagaatataaatatgcagttatcaaaaataattcttgaacaaaggaaaccatgctactaaatatagctagagattgatgaaagagcaaggatatttacagtatctcaattgttgggtttatctaaagctgtcttcaaaattgtgactgtttaacaaagaaccatttggagcttttgacgtctacgtatttctaggtcttccagaattagtgaatagcgtcattctctggttaatattagttgagagttcttaaaaagtctattaaatttaccctgctgtgatgatgtaagtaagtttcacttaagaatgtatgtatctttgtgtgaaagttgctagtgaattcaggtttatgacctttattattctttgataatccatgaattttagtaaactatggaacttgtgttaagactttttttataacccaaactttacctttatgtgggcccccaagattggttattggtcccattgccctattgctttttaaagatttatgcctcctctgagactcagtttcctttagaggttaaaatggggatgtggaaaatgatttttgaaaggtacgttccaaccaagtagaatccagtggttgattttcctgggccttctgcagtctgcccttatatccacatctcatctagctgctgcctcctcttttggttaccctggacccctcacttgcctccgacagatatgatctctccatctctagtctttgccattcttgtttctctcctcttctccatctaaatccttccttctaggatggctccactgccattttccccttgccttctcagcctaccctaatctttttaatttctgctgcccttagaatagtaccacagttgaacatggcatagtttctttttgttcaaagcatgttggctttgtttgcatgttcactggtttatctacttgttgacaaatattttgaccaccttctgtttgccaagtcctattctagatgctagagatggagtggtaaacaagatggaaaaggccgtgccttcttggagtttatgtcctagggagggaaacagatcatgttcttgaaggcaagaattctgcttaatatgtttttgtactccctgaagcaattagtacactttatccttggtatatgaaagcttttaaaattggtatttagagaacattttgaaagacatgaatccataaggcttatggaaccaaaccatttttagtagaggaaagtcaagctctagagaatcagacatccatttctacatcagatagctgactttcatttcagtgttggcctcttctcaggcatgcgcatgtagtgtctgtagacaaactgacagtgtgagtaggcatttatctgttctttgtcaggttgaagaggaaggttagtagaaggtaactgagataaggaagctgaaggctctctttaagaaattttctgataaaatatacctgttagtgagttttgctagaattatagtaacagaatcctgaagaccgctgagaattctagagatgccacactcctgtttccttctgttgctatcttggctatgacaaaatgaaattatcatgtgtactttctgttactaacataacactgttgatttgcttaacaggtttatagatgggctcatatccctactatttagtgttttgcactgaagacaccaactcccataagaacgttagccggttcagctatttttgatagagttatcctttttgtattaaaatgagccagactttaaaataggaggatgctgtatttttagggaccctcttaaactacagtcaattaaaaattaaggccttttattttagaataacattgtattgattctttggatttgcccacttctactttttaccaaggtcaaaatctcactaccaaaaataggccaggtgctgtattgatagctaggtatgcaagtcagactactgtattctctgtgaaaatgtcttctggttttaagagagaaatccttctcccttcacagaattttatattgcagaagttacatatcaataaaaatatttttattttcaaaggagttcttcacttaaaaatagagccatcttaaaaaacttttttagagaatggccacatgataaatcattgttaaacaatcatttattttttaccttaataatggacattagtttgttttcaatattttgttattataaactgctgcagtgagacacatctttacataaattatacatttgcaagtgtgtctacacaacagattttcagaagtggattgtgtctatttgtacaaccctaccaaactgcataatttttgtcactataactttgtaatatattttcatatttcatatttactaagacttgacattttaaaaactgggagtctttctatgcaagaacaggtattctctttttaagtttttaaaggtgtttcactagcatttttatttctcttaagtttatttttagaaactttttgttggtcttacaaatagggttttttcttcgattatattttctacttccattatgttttactatggggtttgatatagtaagcgtttagtcacctcagtgggttattgttttgaatattttgcaggtttatcctcttgagttttccaaacaaacaatcacatcatctgcagatgatgacaattgtaacttctttctaattctcatacctcctttttctctcttgtataattttattggataaaaatatccaccatgattattaaataataggcatctttgagtctgactttgttgggaatctactaatttttcaccattaagtatgcattagcttttgagttgagataaatatgatattttttatcttcttaaaatttcttaagagatgttatcacaagtaaatatggaactttagcagatatcttttcagcacctatggagatgttcaaattgctttccctattttatttgtaactatgacaaatcatatcaaaaggtttcctaatattgaaacatccctgcatttctagtagttacttattcacagtgtcttaattcttcttttaatatgcttctgtgttctaataacaaattatctgagatttttgaaaattacaactttattgagatataatttacttactatacaagtcacccactgaaagcatatataattaaatggcttttagtgtattcacagagttgtgcaagcatcacaatcattttagagtattttcatcacccccaaaagaaagctcatacttggccagatgtgctggttcacacctataatcccagcactttggggtgccgaggtgggagggttgcttgagcccaggagttcgaaatcagcctgggagtttgaaatcagcctgggcaacatagtgaaaccccatctattgaaaagaaaagaagaggagaggagaggggaggggaggggagggaaggggaggccctcatactcatgccccttcctcactcctccctcctcccttccagggctaggcaaccactgatctatgttctgttgctatgcctttgcttattctggacatttcacataaatggaagtgtataatatgtggtctttcacatctggaatctattgcttaaaatagtgtttttaaggttattcatgtgtagcatatatcagggcatttgtcatttttggtactattccattgtatggatagaccacactttatccactcatcagctgatggacatttgagatgtttcctttttcttttttctttttttttttttttttctattctggataatgctgctatgaacatttgtgtacacatttttgtgacaagtttcatttctcttgggtttatatggtcacatggtaactatatttaacctcttgaggacctgccagactgtttttcaaagtggctgaaccactttaagttttctaccaaaaagtatatgatgttttctgagctgcttgcttagatattcatcagtaaaattggtccagaattttctttattgtgcaatctttgtctgattttaaatagcactgacataatagctatttaaaagaattttgaagtttgtcttatcttttgaaccacctcttagtgggttgccctacactgctaccataattctagatcagaacaatttttaccccattattttgtacgtgatatttggagatatagtggcaagaaagaacaaaattacattaaaaaatgcactgcacttgaaagtatgtaagtttgaaacattaaaaaaaggaagaaaaataaatgaaaacaccaaaaagcaataaataattttgtgatttcatctgagatggtatataattgtactttctagtccattcattctaatattttgttgtcactttgttttgctactatgtaagttaatcagctgtcataggatcagagatacttgaaacggaaaatataattagtaaaataattagtacctttcatttcaaggtcttgaaaccctttctagtcctctttaaccagtgcagaatatactggtccccagcatgaggggggtctgaatgttaggaaaatatccctcttttggactctgaaataagttcatttctgctaaattccaaacaaaaacacagagctgggatcagttttaaagtcagtccagaaaaatgtaagtgataagctggaacaacagttctcaaactttgttctcagaatcatttgtagagcttgttatgacacattctagatccccacaccctgagagactgaggcaggcctggggttttgcattctaacaggtaactctgacgcctggtctggagccctcacgtggggaccaccaaactagagttctcgctgagagcttctcattcaattctgcagtgttccattgctttaaaattgttcaaattttcttgccgggagttgtagctcatgcctgtagtcccagcactttgggaggccagggtgggtggatcacgaagttgggagttcaagacctgcgtggccaacatggtgaaaccccacctctactaaaaacagaaaaattagccaggcgtgtcggcgggcacctgtaatccgagctacttgggaggctgaggcaggagaattgcttgaacctgggaggcagaggttgcagtgagcggagatcacaccactgcactccagcccaggagacagagcaagtccatctcaaaataaataaatacatacataaataaataaataaataaataaataaataaataaataaataaataaaataataaagttgttcagatttccattcattgaagccacttccatccactgtattttcttgcttatttcgtagatgttatgcacttacaagaaaggaaaggacctgacttacagtcagctctcatttgtctggaattcattaatcttacaggtcttctgaggtaaacatttcattgagacctaatttttcttccccctcgcctttctcccagccttattcctagtccagaaatgtaaaataattttgtttcatgataaaatcaatgaagttgatcagataatctgtttcaaggaatttacatatgtgaaatcctgttttggttaatctgtgatgttgcttccttctctgagataagggaagtgttcttaatcaagtctgtccttaggggaactgtcacttctctggaatggcactttctttaaatgcttgggactaaaaagcctaggcctgtggctaaagaatgttctagccaggtgcagtggcgtgtgcctgtagtcccagatactagggacgctgaggcaggaggattgcttgaggccaggagttcaaagctgtagtgtgtcatcatcctgcctgtgaatagccacagtactccagcctgggcaacacggcaagatcccctctcttaaaaattttttaaaaagaatattctaaatgtaaattcatacaggtagagatcttctgaaacgagattttcaaagtggttcatgacccatcatcacctgtagtgctaattttaaaaacaggtttccagacatcacataaaccttgctgaagcaaactccatagagttgaggttcatttgaacaatccgacatttgaacaatctgacagttgaatcaccttctcaggtgattctaatatatctgaagcacagagcatgcttcgagaagcccattttatatccctggattgttgctcagatgagtaaactgaaagcgtgagagtgaatccatggatagcctctgtttgtcattagaagaggcattttttcactctcatgtgagagctttactccccacattggactctgaatttctatggtatcatcttagtgaagatgtgacctcagtggaaaggggaaagttgtatagataagaaagtaattctgattcgtttcttgtctacatcacagcttttagttgttgggattcaacaagaagcacatatcggaggtggacaggcctgaggggatagtccaaccacagctctcaaccagaagtggactgtgtgtccacctctgcactgtttgtaatcatatgggacatttttgttttattgtcacaatagctaagtgctattatggtactgggaagagcagcaactgtaaatattctgcaatgcaagggacagttcaccacaatgaagaattgtcctgttcctcaagactatcccagctgagaaatattagttccagactagatgagaaatggagatccaaaaatattgcctggatctcttttacagcattgtcttgctttctggacgtgtgtgtgtgtgtgtgtgtgtgtgtgtgtgtgtgtgtacctgtatgcatgtgagtgctatatcggtcttacatacattcttctttaaataagggcatggaattgatttttctaatgaataaaagttttttgcctaaaatattttactaagttgctattctagtccaacttttattattcagttcagtgcaatgaaatataatttagtgtctgctatgtgtaaggtactatgatgggctttttatgggttataaagattaaggtgaggtttctgcctttagtaagctcaagatgtccagacaagagatggacatttccccagctaccaagttacaagacagagtctgctctaattgagttaaccatgctatgtgagtataaagagatctgccaattcaaggtggaaggatctgagaaagcttcatgaaggaggtggaccttgagctgtgatctagcaaattaaagataacgaaaggaaagaagttgaagtgggcattcctggtataaaaggcagggaggaaataagaggtagaagtagaaaagatgtgtccagccagatttagctatttgtgataaatagagagaggctagaggcagaaagaccagttaagaaatcatcacactggggtgaaaggggagatgaatgagacagagcacatgaagggacttctaaggttccaagagaagttctatttcttttttttttttcaacttttatttaagatacaaggagtacatgtgcagatttgttagatgggaatattgcatgatgctgggatttggagaacagatcccatcacccaggtagtgagcatagtatctgataggtagttttttaaaactgccccccaccttctaatagtctgctgtgtccattgttcacacatatttatatccatgtgtgctcaatgtttagctcccacttataagtgagaatacgtggtatttggtttcctgtgcctttttggtagaatgatttgttttctttggggtatatacccagtaatgggattgctgggtcgaatggttgctctgttttaagttctttgagaaattttcagacagctttccatggtggttgaactaatttacattcctatcaacagtgtgtaagcgttcccttttctccacagcctcgccagcatctattgtatcttgaccttttaagaatagccattctgactggtgtgaggtgctatctcactgtggtattgatttgcatttctctggtaattagtgatgctggcattttttatatgtttgttggccgcttggtgtatcttcttttgagaagtgtccgttcacgtcctttgccctttttaaatgaggttattgttttttgcttattaagttccctagagattctagatattatgcctttgttggatgcatagtttacaaatatgtgctcccattctgtgtattgtccatttaccctgttggtagtttcttttgatatacagaagctctttcgtgtaatcaggtcacacgtgtctatttttgtttttgttgcagttgctgttggagacttagccaaaaattatttgccaaggccaatgtcaagagagtatttcctaggttgtcttccaggatttttgtagtttgaggtcttacatttaaaaccgtaatccattttgatttaatttttgtatatggcaataggtaggggtccaattttattcttctgcatatggttagccagttatctcagcaccatttattgaacagggtgtcctttcccccttgcttgtttttgtcagctttgttgaagatcagatggttgcaagtgtgcggctttatttctgagctttctattctgttccattggtctatgtgtctatttttataccagtaccaagctgttttggtgactatggctttatagtatagcttgaagtcagtagtgtggtgcctctggctttgttctttttgctcaggattgttttggctatttggactctttttttggttccatatgaattttaaaataacctttttctaattctgcgaagaatgacattggtagtttaataggaatggccttgaacctgtaaattgctttgggcagtatggccatttttacaacattgattcttctcatccatgagcctggaatgtttttccatttatttgtgttgtctttgatttctttcagcagcgttttatagttctccttgcagagatcttctacctccttggttagctgtattcctaggtatttcattttctttgtggctaatttaagtgggattgtgttcctgatttcactctcagcctggacattgtgtaaagaaatgctactgattgttgtacattgattttgtatcctgaaactttactaaagtcatttatcaattctaggagccttttggcagagtctttaggattttctaagtatagaatcatatcaacagcaaagagagatagtttgactttttatttggataccttttatttctttctctttgctaattgttctgcctagaacttctagtactatattgaataggagtggtgagactgggaatccttgtcttgttccagttctcaagggaaatggtttgagcttttgcccattcaggatgatgttggctgtgggtttgtcatagatggctcttattattttgaggtatgttccttctatgcttagtctgttgaggttttttatcatgaagggatgttggagtttatcagaaactttttctgcatctattgagatgatcatatggtttttgcttttgattctgtttatgtggtgaaccacatttattgatttacatatgcttgtttgtttttagagacagggttttactctgtcacccaagctggagtgcagtggtgtgaccatggctcacagcagcctcaacctcccggggtcaagcattcctccttcctcagcctcccaagtagatgggactataggtgtgtgccaccacaccagggtatttttatttttattttttgtagagacagggtctaattttgctgcccagcctggtcttgaactcatggactcaagaaatcctcctgcctcggcctcccaaagtgctgggattacaggcgtgatccagtgcacctggctgttttgtgtatgttgcgccagccttgcatcccaggaataaagcctacttaatcatggggtattaattttttgatctgctgctagattcaatttgctagtattttgttgaggatttctgtgtctgtggtcatgagggatattggtctgaagtttccttttatcattgtgtctttgccagagattggtatcaggctgatgctggcttcatagaatgagttagggaggagcccctcctcctcaattttttggaatagtttcagtaggattggtatcagttcttcttcatatgtctggcagaattcagctgtgaatccatctggtccagggcttttttttgttgtaggttatgactgacttaatttcagaagttgatgttggtctatgcaaggtttccatctcttcctgattcgatcttgggagactgtgtgcttccaggaatgtatccatttcctctagattttctaatttgtatgcatagagttgttcatagtagtctctgaggatctcttatatttctgtggcatcagttgtaatgtcacctttgttgtttctgattgtgcttatttgtatcttttatttctttttctttgttaagatagctagggggtctatccttttttttttttttttttttttgagaaccaactcttggtttcattgatcttttgtatggattttctatttcttaatctgggtggtggttagaagggtgtttgcctgataatagttaaggcatgtatttattccgtgtggtttactgtgtcttatttcacaatacaacatgtcttttgtttttttaaaaaaaaaaagccatttcagtagtaccggagagagaaaaagagggagccccagcctgaatgagagtggaaaatggtgagcaaatacggggtcattccagagaagtgactgtacgtagaatgtaaaatagaggcagagtaagagatagccatttggaaatttacatttgaggtggcagtagaatagatatgtgacagtaactacaagaggttagaaataaaagttcagatctcagaaaaaatattgtgctagaagatttggagatcaaaatcaagtgatcagaacataactacgggaattggaaagtcagaagagaagatgaccaaggacagaatcttagaaaatgtctgtgtgtcaggagtagtaaaaagagccagaaagggatactaagaagggactggagagcaaggttgatggctcagggtggtacggtataataccacttcttaatggaagaagtccaagaaagcatttcaaggagagtgtggttggctgctgcagattactgaaggtaggtcaggcagattgcaaagtagttcagtgactgttggaagaaaggtcatatcatcagggcaggtgaagcaatgggagtgtccactcccataagaatgttggtggcaaagggagagaagttgtgtgtgtgctaaggggaagctgaggtggaagagttgagcatgtgatcaggcaagccgctacagccaagaaagaagaaagaagaaagaagtggagacaagaaagggaaatatttgatgaggcaaagatctagatcagggcttctcaaagtgtggccccctgaccagcaccaccagcatcagttgtatacttgttggaaatgcatattccaaggccccacctcagacctgctgaatcggaaactctggagttgaagctcaggaatgtgtatttcaacagactatctaagaattatgatgtatgccgaagtttgaaaaccactagggaagaggaaggggtggctttatccagcacacagatggagaagttctccttaatgagaagagtgaccctacttccttttagacaagaggaaaggagaaaaagaagaagaggagaaagatggtatcagatagatagcctcaggctttctgtaaggtcacctgctgagaacaaagacttgggatatttggggagcttaaagcgtgagtgtgttcattccagcctccaaaccctggcctcttctttaggctttgtctgatatgtcctcttgcttcttcattccccatccagatcctgtgtgtaagatcacatgcagttccaccttcttcaggataccttccccaacttgtccagtccacagtgattactcctttggtagtaccttacttacatagggccatcggtaattcttttgtttcatttgaatgtcttgtcttccgaatatgactgtatgttccttttgacgattatgattttgctacttgaggaacatgtcctcattgtactgctgctcacagcatccactgaggcttcaataacatttatagacagacgactcccaaattaggaagtcaacggatcaatatcccctttcattctgagttttcaattccagatttagatggtgtccttttctctaagtgtttaaaacactttcttagagaggcttctatgatatggaagtttaaaactctataaaagataaggaaaattggaggagaaagtggcaaataggaaatcatttgaaagaagagaagtgattcactggtttgggtaaacactgtaaatgacttgaacactgtaaacactgtaaatggccctctacaagagtgagctgtgccaacatagactttgagaagtgacataaaagaaactgtgggaaaggatactggaatcctctgtaaagaatgcctataatagccatacaaagaacatggctgccttccctactgctggtaagatagcttgtttttgaagttcattacatttagcaagcatgatcaagaattctatcagtgcactactttcacaaatacacaagaaactacctttttaacagcagagtttaaaaccaagactcagccgggcacagtggcccacacctgtaatcccagcactttgggaggctgaagcgggtggatcacttgaggccagaagtttgagaccagcctggccaacatggcgaaaccccgtctctactataagtacaaaaattagctgggcatggtagcacatgcctgtaatttcagctactagggaggctgaggcaggagaattgcttgaacccagggggcagaggttgcagtgagctgagattgcgccactgcactccaccctgggtgacagagcaagactctgtctcagaaaacaaacaaacaaaaaacaggactcactcccctacagccaggagtctgaaaatataaaggtaaacaaagaagtactaaacatgagaatatgagaaaataaattctttaaacctctatagggagagttatctgtgatcactgcaatgaaatacaaattagggtgaacccatttgacattaggttttattacaaacttgaaacagagactctctgtttgagaaattctttcagtgtgagttttgcatcacaaggtaaaaatcctatcagaaattgacttggttttgtttttcagattgaaaccccaaactcaaagccagaatgaaaggacataagttagtacaagaataagggaagggaaactaatatttcttgagcacctataatgtggtttcatttactccatctctttcaattcttaatgagtcctgtgatgcaactcttactgtctcttttttacagatgagggcaatgatactcagcatctctcatcttcactgccttgcgtttgaactcagagctatccagctacaaagcccatgcattctttctgctatactatacctgttaaacttcataggtttggcatgtccatagctgttatgatttttctttatttttaaaattagagacaggatcgtactttgtcatccaggctggagtacagtggcaagatcatagctcactgtaacctcaaattcctggactcaagtgatcctcctgtctcagactcctgagtagctaggacaacaggtacataccaccacaactggctaattttttattttttttgtagagacaggggtctcactatgttgcttaggctggtctcaaactcttggcctcaagcaatcctcccaccttggcctttcaaagtgctgggattacaggcatgagccatagtgcccagccaagatttttctaaaacatggagaattctataatgattattgattttgtaatgtttctgcttacaaaattgtattttactttgtaatgaattttgaatggaaataagattttaatattgtgatgaaataaaatggagagaatataaattttactttggtgtcagtgtaattacaagcaacatgttgacatgatttgatgtctggtagaaccatcctttacatgtcttcgcacatgaatgttatgctttagatggtaaaacttatataggtaagggtcctacttgtatgcgccttgctctttttcagaaagcattttctgttcagtttgtttaaaaaacagttttgtagctgggactataggcacatgtcaccatgcccagcttggagttctaatttgaatttccctagggactaatgatgttgaatatattttcatgtacttatttgccattcacgtatcttctctggtgaagtgtctgttcaaatgctttgctcattttttaaaaaattgggttgcttgtttttcttatcattgacatactctgggagttctttatatattctggatataagcttatatcagatactatatatgatttgccattttcttccagcctgtagctcgtcttcattctcctcacaggatctttcaaagtgcaaatgtttttaattttaataaagtctgatttaccaatttgttcttttaaggatcaagactcttgtgtgtgtctaagaaatctttacctaactcaaggttacaaagattttctcctgcattttcatctacaagttttatagttttgggttttacatttaggtttatgattcattttgcatcaatatttgcatatggtgtgagatatagattgaagttctgtttttaaaaaatggagactcaattgttaaaacatcatttcatcctttgctcaccaaattgcctccatttacttaggtcttatttaatttctctcatccattgtcagaattatctttaagtgtttcatatttttatgctattataaacagaatggttttttaatgctgttgtaaacagtataaaattggaaattccaacttccaattatttgttgattttatgaagaaatacaactgattcttgtacattgatcttgtatcccacaatcctactaaagtcacttattagttctagaagcttatttttgtatatctctttatacagaaagggactgtaatctccagtgcagtgttgaagaatgaaagaaaacatacttttcttatgcctgacgttaggaagaaagcatcgggtctttcaccattaagtatgatgttaactataggtttttcatagatgacctttttcaggccaaagaatttcctttctatttttaggttgctgaaagtttttagcaggaacagacattaatctttgtcagaagcattttctgcctttattgagatgatcatatgttttttcttttttggcttgctaatatagtagattatattgatcaattttcaaatgttaaaccaaccttcttatattcttaagataagccccacttgatcatgatgcattgccatatgtatgttcatatgtatattatggacaactttggatatgttgtattaatattgcataaatattatcctcttaatatttatggactctgtattgatggcacctctcatattcatgatattggtgatttatatcttctcccttttttcctgataagtcaggctagaggtttatcaattttattgatctcaaagaatcagtgtttggtttcattgatttttctctattatttttctgtttccctttttattcacttctgctctaatctttattacttctttttttttttctggtcaagtttaacttactcttctttttcttgaatatttagctagaaactgagttcactaattgagacctttcctaataatagccatttagtgctattaatttcctctaagtacttcattcgtggcatcccataaattttgatgtgttgtattttcattcaacgcaaaataattgtcagtttatgttttcatttattctttggaccccaggttatttagaagtatattatttattttccaaatatttgagaattttacagagattattgatttctagtttaattccattgtggtcaggaaacattctttttttttttatttttatttttgagacaggttctcgctgtgatgcccaggctggagtgcaatggtgcaatctcagctcactgcaacctctgcctcctgggttcaagctattctcctgctccagcctcctgagtggctgggactacaggcatgcaccaccatgccaggctaatttttgtatttttagtatagatggtgtttcaccatattggccaggctggtctcaacttctgacctcaagtgatccaccccctcagcctcccaaagtgctggattacagggatgagccaccatgcccagccagggaacatattttttgtatgactagaatcattttaaatttattgagacttacactatgacccagaataggtatatattggtaaatggtctatttgaaaagaacatctgttctgctattgttgagtgtattctataaatatcaattaagtcaagttattgatagtgttgtttaagtcatctgtagctttgcttattttctgtctacttgttccatcaattactgagaggggagtattaaaatctctgacaataatttggtttcatctgtgtttttttgtagttgtacttctatccatttcagcttcataaatttgaagctctgttattcagtgcgtgaatatttagaattgttatgtctgcttcttgaccctttaacattgtaaagtgatcttccttattcctagtacattctttgctctgaaatctactatgtctgatatgaatatagacactccagctttcttttgactagtgttgcttggtatagctttgtccatctttttacttttaacctagttgtgtctgtatatttaaaatgcatttattgtaagccacatgtacttcggtctagctgttttgtccagtctgacacactctgccttttaattggagcgttcagaccatttttgtttagtacagttactgatggggttagatttaaatctgtcattttactatttgttttgtgtttcatctattctttgttccccctttcatcttgttctgcttgcttttggattaaatgagtttattttcttattctattttatctcctttgttggcttattagctgtaactctttgttttttattttagtggttgctttagattttatagtatgtatctttaacttatcacagactatcctcaaatgatataccatttcatgtatattattaaaacctgtggctgggcatggtggctcatgcctataatcccagcactttgggaggccaaagtgggcggatcacttaaggccaagagtttgaaaccagcctggccatcatgatgaaaccccatctctactgaaaaaaaaaaacaaaaacaaaaattagccaggcgtggtcgttggtgcctgtaattccagctactcgggaggctgagacaggagaatagcttcaacctgggaggcggaggctgcagtgagctgagatcatgctactgtactcgagcctgctctgtctcaaacaaaacaaaacaaaacaaaacaaaacaaaacaaaacaaaaccttacagtagtatactgccattggtcccctgccagtctttatgctactattgtcctactttttatctatacatatattatcaccccacaatacttgcttgtttaaccaattatatttaaagaggtttaagtaataagaaacagtcatatatatatttacctatatagttagtatttctgattccttcatgtacatttccatctgatataatttttcttctgccttaaggatttcctttaacatttcttgcagcataggtctgctggtgattaattccttcagctttttgtatgtctgaaaacatctgtttcaccttgttttgaaatatattttcactggctatacaattctaggttgacagttgttttttattcctttcagtactttaaagatgctgctccactgtcttctaacttgcatattcctcacaaaaaaaatatgctgtcatccttatctttgtttttatataaaacatctttttcctctgggtgcttttcagattttctctttatcactacttttaggcaattcgattattattatgtgcctgctagttttcttcatgtttcttgtgtttgggcttgttgaaatttcttgctgagttaacagttttcattaaattaggacatttttcagccattatttcttcaaatattttttctgttgtctcccttctcctattttttgagaagtccagtttcacatgtattgaccacttaaaattgtcccacagctcactctttattttattcctttttttctccatatatttcattttggatagtttctatcactatgttttcaagttcactagtcttctcttttgcggtgtctaatctgctgttaatcttatccaatgtattgttcttctcaggcattgtagttttcatctctagaagtttgatttggggctttaaaaggtatctcccatgtctctacctgattcttagaatatattaaagaccattatgataactattgtaatgcccgtgtctgctaattctgacatctctgtcagttttcgattgagttcagttgtttgatttgtcttgtcattatggtttctattttttcaattttttatatgtctggccatcttggattatatactaggtattttgaattttacttcgttgggatctgaatgtttttatatttctgtaaatgtttttgagattttgcgtttgttttagagacagagtctcactcagtcatgcaggctggagtggagtggcacaatcacagcttactacagcttcaacttcccgagctcaagtggtcctcccttctcagccccccaggtagctgggaacacaagcatgcaccaccatgctcatctaatttttgtatttttttgtagagatgggatcttgccatgttgcccatgctgtttttgaacgcctgacctcaagcagtcctcccaccttgaccgcccaaagtgtgtttttgagttttgttctgggatacagttaaattactttgaaatagtttgatatgtttgggtcttgcttttaagatttgttaggcagaaccagagcagcatttagtctagggctaattattccctactattgagacaagacccttctgaggactctacacaatgcttgtaaattatgaggttttctaatctggctggtggaacactcactattcctggccctgtgtgagcactgacctactccccttcaattttttgacatgatctttccccaacttcaagtagttttctcacatacatgcatgatcagtcatccacagaatattctagggggaccatccacagatctccagagttctctctctctctctttctctctctctctctctctttctctctcaagtgctctcctattcagtattttatcctgggaactctgaagtttcttagactctcagttccatcttcttttttttctttttttttttttcttgagatggagtctcgctgttacccaggctggagtgcagtggtgtgatctaggctcactacaacctctgcctcccaggttcaagcgattctcctgcttcagcctcccaagtagctgggattacaggtgcccaccatcgtgcccagctaatttttttatttttagtggagacggggtttcaccatcttggctagcccagtctcaaactcctgacctcatgatccacccgcctcagcctcccaaagtgctgggattacaggcatgagccaccatgcctggccccatcttcttaactcaggcagtccacctgcttctttctcatttcctccatctatgctatggcctggaaactctcaaggcagtaagctggggtaaaggtagggctcatttcatttatttctgtcttcttaaggattactgtcctgtgttgctgatgttcagtgtcttgaaaactattgttttatatgttttgtgtaggttttctgttgttgttttagacaaaaagctaaatgagggccttgttacgccatctttgctggaagcagaaatctttagaaagcattttaagtggacttcatatctagctaatccacacattgtattcaaagaccaatttaacaatagaaacctctatttcttgagggccttctgtgtgccaggcactgtgctaggtacattcacacacaattcatccatatggcatatttattgaacagctattaggtgctagggactattctagacattggaaatacatcactgtacaaaacagattttaaaaatctgtatccctgtggtgcttatattctagtggggaaagagagaagaaacaaaatcaataatttagttatattgcacattaaagggtaatagctgctacagaaaaataaagagcaagataagggggttttagaagtgctggactgaaaataaatgattgcagttttaaagaggatggtcagggaaggcctccctgagaaggtaagacatatacacaaagacctgaaggaggtgacggagtgagctgtagctatagagatatctggaggaagagcattttggctgctcaagcagccagtattaagaccctagaacagaaccatgctagtatattcaggaaagcataaggaggccagtgttactagagcaaagaggccaaggaggagagtaatagtagatgaggacagagtggtaaccaggcccaattgtgtaagggttttcaggtcattgtaaagactttggcttttgctctgagtgaagagagaaaaggctcatgatctgatacatgttttaaaagaatcactctggctgctctcttgagcagagattgttggatgacagatggaagcagggagaccaattagggagctatgaaataattcagatgagagatgatagtagtttagactggggagagcagtagagatagagagaagtggttagattttgatatatttcaaaggtagaatgacctgcacttgtggcatattcaatgtggactgtaaaagaaagagtcaaagatatattcaaggtctttggcctgagcaactggaaagatggaattaccaataacgagatttaaaaaagactgaatgaagtgagttttagggaaaatgattgggaattcaaatttggacatgttaggtttgagatgtctagtagatacccaagtggaaatattaaaataggaagttggatatatgaatctagagttcatgggagaggttcaggctgataggtcaagtaagataaagactaagaactgacctaaatttagcaatgtggagatctttggtgagtttgacagcagcatttttggtggaacggtggggacaaaagcctggctggagtgaattttaagagaatgagaggagaggaattggcaacagagcgtcaaacaattttctcaaagagttttgctgcaaaggaggaatagagaaatggtgcaataactgtcaggagaggatattttacaaagggggaaataactccatgtttgaatactgatggaagtaatccagagagagaaaagaactgatataggaaacagaagggaaattgctagagcacgtcctagaatagatcaaaggggatggatctaggtggcataagagaaggtactggctgtagataggagtatagatagttcatctatggtaatgggcaggaaggcagaatgtgtagatgcagatgctattaggagcataagtgtggtggtaggagtttatggaagttcttaactgattgctgcatttttttttttttttttttttgagaaagggtctcatttttgtcacccaggctggagtgcagtggctagatcatggctcactgcagccttgacttcctgggctcagatgatcctcccaccttagcctccggagtggctgagaccacaggtgtgtgccaccacacccagctaattttttgtatttttagcagcgagggggtatcgccatgttgcccaggctagtctcgagctcctaggcttaagcaatccacccgcttcggtctcccaaagtgctaggattacaggcatgagccaccgtgcccggctggattgctgcaattttgacagtaaagcaagaagcagggtcatcagctgaaagtgaggaggaggggaatagtgtcagaattttgaagggagagtacaaagtgcaaaataatgacctaggatagtgggaaactaaatggacaaaggaaatgtaagtataactgccagatgtcattaagagtccacttgaggttcatagtcatgaatttaaagcaaagccagtgaggatgcttgtgtgctgtctctagccacattcaggtgcacaggtgcagtcatggaccaggcagagagctggatttaacaaatacgaggaagtaagagagggacaaggaagttgagggtgtatgcaagggagtaattacaatgataagtcatgaaatttaagctgagcaagaaagaaagataaatattagggaagtgggatagtgacatggtgataagatcagtgtgggccagtgggactgaagagtaccttctagaaagaatgagctgtgaaagataggaggggttggtcagagattggctagagttgcagtaactggtaaagataggtttggaggagtgccactcaatgagtaggccatggactggtgccagtctgtgaactgtgtgttactgatctgcaaggagataagttcagaaattgaaaataaatgtttagaaacactgctgcgacatccaagcatatgatcagtggacttgtatttggaatgcctttgtgtttttaatctcatttttgtgactatattttacaaaagtattggtctgcaacagattagatacaaacaaagtctggtcctcccccacagtggaagcacatgctctcacgagcatgcatgggagtgtatctccaaaggtggaggacaaggtcactggaggagaggagtgaacagtgaactcaccatcatctctagtcttccaagatagcaggctgcctgactgcacagctccaggaagcaccattctcattgtatgttacatgaacaatacaactccaggtactgtatgaatggtgctcttagaatgttcaaggagatagctagtgttatccccatcttacagatcagaaaacaagctcagaaaggttaaataattgcctaaactcatacagctactaaggggaggagccaagatttgaacctaggtctgtctgctgtgctaaagctgaactctgtccacaataccactctctttctctgtcacatgcatgtagcacagccataagcctcatgagaactggggaaaaataccttttaggaatgtgttatggtccatgtgaccaagccaggcatttcaatttattttagagtcatgactcattacagctgctgtgggaatccatacccagtcgctgcttagacccctatctctccagtttgtctttgttgaaccaaggggctgaagcacctcaggaatacagcatccactatcaccacaggatttcctgcagtctgttcttgtgctttagtaattgcatatgtattaaaagcaaattctaaagagacatttatggaatggtaagattatgagtaattttaatactttaatctttttttttcaaaattcatatgatggatagatacattacttttctgatcagagaatgtctagtatagatgtatactttaaaccatcttgctcatggttcaagtcttagactctaaaactcagggctgtgatgagggctgggaaggccccatctctcactgagcctgagtcccagatacactgggagcctcagcatttccagaaaagttggtgtttgttgcttcctgctctccccaggtgcatggagtttctgagaaatccgtaaacaacgtaagcattgatctcttaggatttcctaatttccttcatttcttgcctatccagtaggcctcagcaagtacagcaacactaaagttaatttgtaaagcttatctgggtgttactggacttgtgaaccctgaggtaacccactgcttctggaaagccctcccatgctccaagtctgtatattcacccaatgcataggatacagcgtaggaattgggggtttctgtgtccatatggcccatcaagctgcccctgtgaaggcatggtctatggcacagcacaggacctgacacacagtgaggagtggctcagtaggaacgagttggacaagtcaatgaacaactgctgcccagcgtgtgtaggtatttttgtggtgatgtctttaatcttttctaccttgagaaatttactggcattaatatatattaatgtattgtatatgaaaagaacttttgggctgactggtataagacttattattacattcagacacatgacttttcacctagggaagatatagaagaaatgaatccaccaaaataagcaaatataactgggcagggtaggacatgttcaatccggttaggtttaaagaatcaaaatagaaaataggaacagaattttactttgaaaaatagtactgtaaatcacagttttggtgctgtggtaagacgaatcattaaaatacttgaatatggtaaaatgctaatcatcacagttattaattgagagtaactaaaaacctctggttggcctcataagcattagtaaagttttcaaatgcatgttactaattattgttattaatgtgaagttttaaacctgatcccctttgggagactaagtgtcagtgtgggtgaatttttcactatgcctaaaaaccaagaactaccaaatgaaatttgactcttcttttcttccatcttaccaaattgctcatttcatcaatatgaaaagcaactgatatgccaggcagtatagatataagctgtctcacatcatttatttttataaatttgtgttccagtcaaatgtggaatactttggtttcaatatgtaccttattgatgttaagggtctagaatcattataatgactacggtaaagataagatatttttctctagtttgtctacaaaaacctataaaaactagcaaaaaggttaactattttatttaagtagagaattcttcttctagatttgaatactaaataaaacacagaagacagttacatcctattttttattataccttttgaaataatttgtatataccttttaaataatttcaagtgccacaaaaaaataatgttaatagctcaaaatcaaaatttaaaaaaaaccctatgtataatttttaaaatctttttctcctcaagcgttttacgatgggataatgagacagatgtctctcaactggaaggacattttgacattgttatgtgtgctgactggtaagtacataaaaatcacaaaactcctgttagaaaaaaatagctttgctggagtaattgggctgtgttgcttagctgacggctaagcaaagtcaacaaatgaagcacaaagccaccttaacctcaacaaattaatattcatctccatgtgacagttataaggtagtcttctatcacacagtaacttctaccacattatttcccaaagattgattttgagaagcatttccattttctggaattgcctctgtttcatgcttgacgtatcagtaaatggacgacttaggcaaattgcaaataattatggctcggagaggaatagtctggagaaaaaggagtttatcaacacaaacagctcaattagcttacttcttaggagagatctgactattgatataagggaaaatatatgtgtgtgtgtacacacacatactctctagcaaataaacatatctgtggaatatctttggggaaatagcttttcttaaaatatatgtttgctatctaatgttttcagtgtattcaattataatagttaattatacctaaaacaaaaattataaaattacattttattcttatgcaaataataacatgacaatctctgtcaggtgcctgccttttaaaaataatttacattcggtattttgccctctattttagcccaatctacttatttgttaatgaaagtctgatcgtaagttacaggataaatatgcatcagaccttaataattatttcaactaatcttatgtatttcttcatgcagtttgaataataattatttcagcttatgggaaacattgacaattcacaagtattttccctgttaagagtaagatcttgtttgaggttttatcatgatgtttattaggacactttagatttgaaaacacattaagttcagattctgaagaagttctgttatattgataaggccaatcataagatccagaactcagggaagactttccctagaggagaattgaatgaaattttcaggaagtgggttttgttattattattattttaataagattttcaatggataacttttctacaaaagtcattggaattaggtttgctttttttcttcagaaaaaaaaacacttctccatgaaaaataaatattttgtctattcttagctgagagtttctagtttttcatagcccttttagtctttttgcacccaatttcagaaaatcttgttccaaaaataggagaaacctggatttctgactaatcaatgataatgtgcctcaatgctgcagccctcatctaatcaaaaataaggagctaaaacctcaccgtatgattcgagcaagtaatttagtaaatgcctttcctcaccaaatatgagaaagaatcctccaggtttcattgcacagatgaagataatgctggcaggattagatcagattaagcatgaaagtcagatcagagagcagcggcaaaagggaaggggcagcatcttcctgaagctttagacaagggtcacacgtggatgggctctgattatatggggaaggcaggtctggccaggagatttagagttaaatttgtcccttacgcaaatatcaaaacagcctggctttgtcataccttgtgttatggacactctcaccatgtcatcctatttgtaccagagggaaaagcagaggaagtaagatttaagctcttttctgattaatgttctcaggttaaaaatagccacacaacatgtttggaaaacattcttttttccctagccgacaacagggtcacgtacactgatatacataatgcatattcaatttaagacttacattacacacacataacataatattatatgtatacacacacacatagatacacatctggtagctgtgtgagaatttatggcttcaaatgaactaaatacaccaagcttcattttataaatggcttttccatgcatgaattgtttttttttttcccctgggtgttgtaaatgccagaatgtcagcctgtttatactttcccatttgtaaatgtgaaacattaagctactctcactgcgatgctgatagtatttccaaaagaaatgctttggtaatggtctctcttcatattcgcggggatgggtaagctgcttagaaacttagaaagtacagtaatatttctaatatgcacgttgtgcatgtagcagtgaagcacaggattccacgagttctttatgtcctgttggtgtggtgtttctctgtaagagttattgcatggatgctgcttctaggggcaggcaggcaggcaggcaaaccgtgctacatatttttaagaatgtcactggggaggaaaagaaagctctctttagacactacctccaagacgaaacctgaaatcctcagtgtcaggaagaggtgccacacataaatagatcacattaagtctcacaccatcctttagtcattgtcagcaatgagatctggattaggccacaggaatatgaagcaagagtcggagttcaaatattaggtacatggattaaaatcttattgaagcgtttccagcaagggtggcattgtctgattccctgaatagctaaccagtggtactgcttgatcccatttacatgaaaacaagctctattcacaaacctattccaaacccacattgtggttcaagtaaaatgcacatgattacaacaaatggtgatatgtttatgttcttaaatcattcatatattcagatatttacattcaaacattcaaaaacctgtaggcagtgggggaaataacttatttcccagaagagacagtctgttagttcacaactaaatttagtagctcaactagattataaaataaagaggcaaactgtgaaagctagtcattatttcaccattcagcatttttgacaatgaaaaatagtttcatggttcagcagttcctaaataacttgtaaaatgtcaactttgaaataaacagaaggaaaaaatgaggtgcagccatacctgcaaaaggatgctattgacaaacatcaaaatattagaatatttaaccacaggtgtagaaaaaaaacctgcctattaagttcctcagttgacttgtttaatgttgagtttaatataaggattcctttctgctggaatgcagtccagcctggtccttgctgagttagaatagtgagtgattgttaattttaagcctgcctttccagactcctgttcaatcacaatataatctaagggtctggaagtaagatgttttttatccaatgaacgctttcattcagtgtttgaacggccctccagtttattgtagctctgcaaaaatagaaatgactctgtgcatttgaattctcaaaaggcttagaaagcatatctgaaatgccacccataccctgaccggcccattgagctgggtatgcaggacaatcagcacatctgtgtgcctgcagcccgagactttggaaagaaataagggaaagtacattggcctgtagcaacccaccccgattgctctctcagcgtttttgcacttgctatatactctaaattgtttcttttttttagtcctttttactttgctctaaatgatgaaaaatgtttgatttttaagctgattttgtgaaaatttttttccctcaaaatggaaatactgtaggctctagaatttgttttctttcagatgctgtgatcatggacagctccaaatcacaactcacggaagtttacacctgaaaatatctttcgcccaaatatagtcagccctttcacctgacacctgagaagactcagtcccagagaaaatacatgaatcacccaagattgctcaactaaaggggtagagccaagtaaaattagaatacagcattattctgagctctcataaaaatcagttggtaaatactgaaagaggtcattcctttgctgaagttaaatctaaaacagtgactttaactcagcacatttcacattgaaaattacataggggtcttcctttctgtggctattgacagagaaaaatgtctccttgttctctgcactaattaacttccctatgagaggaattacagatgctctgcagtctgcatgaaactgattctaagggaggtgatgaaaatggtctggcacctttcctttgttggaaaatctgtgattcagatcaatggaagaaagcaagtgttgatccacaagtgaattatatagaggtctgtgtgtctgtgtgtgtgtgtgtgcatgggtgccctttaatggtcaaactagactgccaatgtattttgatcagtaactgaagtgagagttaaaatggtatctctgtccccatcactgacccactcagccttttttaatagatccacttaagctactgctgttctctcagcccattaagacttatttaaggggtgaattttcaggagattatatatcattccctctaaaacacattgaaattgctcagatgacatactctacaaagtgttataaattctgcatcagagctaagtagcaagtgagcttacttggaataaagatctattagagaactacaaagaattaattttgggaaatttgatttggagagatggagtagacagcattacctttcaaataagtctgtttggaatgtgtgccgtgtgttaagctgtgatgttaacatctttgtaatcctgaccaactttaaggggaaatagcactttataagggcatgtttgaagctcagttcttaaggtgctgttcattttttttttctaacgatcttaccggttttaggatgcacagatataaaccgagtgtggtcctttgcttaaatgccgcatgtcccaaccagccaggtttcccgtaggcctgggtaactgacagagatattttcctacaatcataatcttcttttaaaaatccagaatgcttaattattaaaactcaagatattgggccagacgcggtggctcatgcctgtagtcccagcactttgggaggccgaggcgggcagatcatgaggtcaggagatcgagaccatcctggctaacacggtgaaaccccatctctactaaaaataataaaaaaaaaattagatgggcatggtggtgggcacctgtagtcccagctactcgggagactgaggcaggagaatggcatgaacccgggaggcggagcttgcagtgagccaagatcgctcaagatattattgcctcactaaggaataaaatagagagtcctgaagagcgaatattttaaagacatacttatagtttgattcctttctcgttaattcttaatggttattaattactgtttaatatgacttaatggcaagtttgtgtagcacttaatttacatacattctgtgctccaagatttgagaatgtagttttgggaaagataaagtctttccatgggtaataatcaggtcatcatgagtgatggatggaatgggatgaggttccattctggacgtggtttctagctcatctgaggattcttttcccattgctcaaagtgaccttccatagaagaaccttccatggaacctgtgatgaccaaagacactcaagcaatgactttttggaaacttcttataagctgctctcctcagaggagaaaatcatcagatcggaagagaacctagtctgttgaaatatcctacctgaaagttggttcatccttgacagtatcagtaaaggagtgtgtactacccactttagggacattgaaactaacaccctacataagctcctcaattccaaggactgtgatgatctgccagtctgtccacaagtaactgccagtctgtgtgtacgctgtgctggaactattaatagtaaagcaaaatgaagacagaatggaagctccttgagaatgggaactttgtcttattcatagctcatccccagttcctaaatttgcccttagtatatagtagatgctcaacaaacctttatcaactaacatatcttattaatttgatgtccacatagtcatataggtgggtgtttattgacaaggaaactgaggcttcacatgaagtgacctgcccaaagtcacacagcagcaacatcaaagccagagctctttaaaaccctgaaccaagttcctcccttgtctgaagtacagctccacgcaacagccccctctgagcgaggacagcagccctcccactgacagctgatacccacccttagctaaaaagaatgatgcagggccctagagtaggtggtgcttactcttgctgtgtgaagagacaggaggccaaatcagaagggtctgacctgcagcattagaaatgggagtagggggccttacttaggcccctcatggagatggctgatgcacaaggttgctgagtgttctagcttaaggtaagggactcaccgttagagaagaaattcaagttgtgaatggaacagttttccatattactttccaaacaaacgtatttgaaatgctgttatgggttaagaggtttcaaaagtagttttgctgtcactgctttttttttttctctctctctcaagacaaagtctcactctgtcacccaggccagaatgcaatgtcacgatctcagcccactgcagcctccgcctccgcctccaaggttcaagcgaccctcctgcctcagcctcccaagtagctgggattacaggcacacaccaccacgcctggctaatttttgtatttttagtagagttgagatttcactatgttggtcaggctggccttgaactcctgacctcagatgatccacccaccttggtctcccaaagtgctgggattacaggtttgagccaccgtgccctgtctgctgtccctgctttttaaaaagacatcgttgtcaatttttattaagtagaagacagtccttttatttatttattgctttgcaaaagacacagcctagaactgatggctctaaagctgaagatgtatgtctcatacactcctcaagccatacactatcactatagtgactacctctacagcacggctgttcttccccaggaatcaacgttttcgtctactgtgtcctcagctgttttccaaatgttatgagagaggcaaagaaatgcaaagatgaggccgggcacggtggctcacgcctataatcccaacaatttgggagactgaggtgggcagatcacctgaggtcaggagtttgagaccaacctggccaacatggtgaaaccctgcctctactaaaatacaaaaattagctgggcatgatggcgcatgtctgtaatcccagctacttgggaggctgaggcaggagaatcgcttgaacccaggaggtggaggttgcagtgagtcaagattgtgccactgcactccagcctgggcaacagagtgagactcggtctcaaaaaaaaaagaaatgcagatgctctctgccttcaagaagcatagcagctgaatgagaggacagctgaatgagaggacaacaatgaaatgcagggacctgggagaacctccaaattctctacttcttgtactgagcttggaaaagggagagatcactatggatgcaagtaaacagggatggctttctcgaccaaccccgcctaactctagtcatctgatgacctccgtcttttgcctaaaccagtcagtgctctcttccgtacattatttcatgctcaggagtaattacaattagatgtgagaggcagtaccaagcagtggctcagagcacagactctgaagccaatatggtacagaggtgaatcccagccctgccaattagtagctgtgtgactccaaacctctctgtgcctccatttccttagctgtaaaatgtggacaataataataatgctaacagtaaaaactacctcataggattgatgtgaggattaaatgagctatgaaaacctcttagaaggtacctgttagctagtactcagctcagtgagtattaactgttttgttattaagacgtgtgtgtctctgccatttgtatttaacacgtgtccttgtgcctggcttacctccctgttatactgtaacctccgtaaggacaggcatagtgcccccttcttccttatctctttactgcttgtattagtccatcttgcgctgctacaaaggtacacctgaagctaggtaatttataaagacatgagatttaattggcttatggttctgcaggctgtgcaggaagcatattgctggcatctgcttctggtgaagacctcaggaagttgccttatggcagaaggcacaggggaagcaggcagtcacatggtgagagagaaggagcaatagagagaaacaggaggttctttcaaccaaccagatctcacgtgagctcattaccacggggagttcaccaagacaaggatgaaggatccgcccctatgacccaatacctcccactaggccccacctccaacactggggatcacatttcaacacaagatttggaggggagaaacatccgaacagtatcactgcttttcggtgctgtatatacaatttgggccccatggttttggcatcctggatattccagtactgttcagatttcagagattcagctgtactttctaagctcagttattatgacctcagttcatagttactatgttggtgcaaaagtaattgcggtttttgccattaaaggtatggcatggcaaaaaccgcaattacttttgcaccaacataatatcagatcacgtatcccaatatggggttcagaaaaaaagtccctatcaataggtatcattggcagcctctagcagctttgctttctcttggcagagtgctctagcaatgcccaggagcccttctgcagaggctggacaactctcctggtgtttggcagccagctctgttctgcatgccttcggcacaatatgctttcacctgtccccaccctaaccccacccacagaatcctttccttggttttaataaacttccagctgtcttcgtccattttctgctgctataacagaataccacagattgggtcattgataaagaacagaaatgtaattctcacagttccagaggctggtaaatccaagatcaaggcacgggcaggttggtgtctggtgagcatctggtctcttctgccaagatgacacctagaatgctgcatcctctggagaagaagaacacgtgtcctcacatggcagaaggcaggagggcaaaaaggagccaaactccccacctctcaatactgttgcattggggattaagtctccaacacatgaatttgggggaaacattcagaccatagcatcaggcatggccaagttaagtaacttgccacctactgccaagcaacccaaactcaaaggtctgcgacctgcaagttcagataaggaaactgtctcaagcttccaagataataactggtgaagacagagtcagactgacccaagcaaaggggtgacagagctgcatgaacagaaattctctaaagatcagggatggaaaatgaaaaatcaaaatgaactataaaaacatgaacctgggttgggtacagtggcatgtgcctgtaatcccagcactttgggaggttgaggcaggaagactgcttgagcccagtagttcaagaccagccctggcaacagagtgagaccctgtccctacaaaaaaaaaaaaaaaaaaaaaaaaagaactagctgggcatggtggtgcacaactgtagtcccagctacttgggaggctggggtgggaggattgcttgagccctggcatttgaggctgcagtaactggatgacagtgcaaaatcctgtctcagaaacaaaaaaaaaaaaagaaagaaagaaaacaaagaaaagaaaaaaaacaaaaaatcaatgtagaggcccagagaggaaaatccaaagttgccatggtctctgtgatatattgtctgagattgttctttgtttttgtagctgttcactcctaagtcagacgttgaatctaacctcagtgctgtttctagtcactaaactctattacctcctgagatatatttcatggtttgggtgtcatagggctggtggtttgtggtctgagggcagccacacagcacccttggtgggcagagggcccaggtctaagggagactaggctctaatgacaggaagttgccagagtgcttcatctcaaccagatggctaccccaaacagcagtttggaaattgtccctgtaacattaacacatggcccagtcacgtgtgaatcctggcccattgcatgttgacaacttggctttagttggataacactgaccacaatatcttctcccctcccaccccctccagtgagacacttgaatggtaggaaacaatttctcttttttagcgttgggtaaacatgtgtaattagccttgtacttatctccattagtatcattagacttgaaaacccagtttaatctggattctgctctcttctcaatgtcagcctgtttctggaccagtacagagccagccttgttgatgcaataaagagattactccagcccagggtaagtatgtttctattttctcctgaacactggctacagaataattagtctgtgcacaaagatggagagagtaatggaatggcaggattaatgtcatgtaatactttaatacttattatgtccaacttcaattgggtcttctgatctattagattctttcctaatcataactaggaaacttcttacccttggccttctgataagaaacacagtgggtagtgaaataaatgcagccgcttcaaagatagtgtgaggttatttttatcaaagaatttcttgagtcttttcccttgataacaatatcttcatattaaagttgaagtatgatattgaaagttttctgttgacttctgtcattttcaattccttcaatggcaacctttctcattggttatttatttattgcaaaataatacttttttctttttatttctgtttatattaaagaaaaaggacttcagatgaatctgtatattaatagttctttgctttaaaaggaagtcattatttacatattataaacattaggtcacaatgaagccaagcatggcataaaatattgtgcacatttttacatttatatatccatttatgccggtgagtaaattacagagtttgtatccactcttattttgttggactgttaaactaagctaggaggtcctgcagcctaaacggagagttaatatacatctatttaaagtaagaaaatgagtttaaagctcatgcattaaaaaaaaaaaaaccttataactatgtaagactcttgctgtgccataggagtttaaaataggttaacagtattaatacagtcgaagataggaacgcatatttatctgagaacactgaagtgtgtgtgtgtttctaaagtatttttttaaaaaggtccactctagtcttctgactcagtgagacttacagaccaatacctttcaacctttcttttatatcttttttataaccttcagtggttcccagagcaatctgataatcatcctttgccatacactgttgctttttattttgctatctctatgtagctcagaaacttaaaacaggtgtcttggaggagtagccatagcttcgtaagtggtagtcagtccaattcaattggcctcctcagttcccctgtgaaatgggcaccagatcttgaggcaaggaaggggcatgttccaagctattgacggccactgcatggttgaataggccacccaagttgaggacagaagaaggaattttgggtttcagcatccccccacccctgtcggccttgggtgattcttgtgggcatttgcaagactaggattttcaggggcggctcaagattcttgaatatgaaggcctctatgaaaatgtatcatacataaatataatgctttcaaggactcctgaatctcacactgtacaaatagtacttcactcatcaccaataccccttcaaagcccatttgtggcaaatactccattttgcagcagatttgcatgatttacctaggatctattgtaaatcattcgcatgatttacaatagaaaagtgcccaagctatgaatagacctaaacgcagattagactggaatccagcagctcttctgtaccctctaataaaccctgaacacactccctccatctgaatcgtggccacacgcagcagccccctctgagcaaggacagtagtcctcctgctaacagctgatactcacccttagcctagagaagggtgaggcagggccctaggggaggtggcacttactcctgctatgagaggaacagggaggccaagtcagaggggctcacactaacctgtagcattagaatggcagtgggggggcctcacttaggcccctcttggaatggctgatactcaaggctgccaggtattctagcctaaagtgtaaggagcccaccatcagaggggaaatcccagttgtggatggcacatggacttactgaaattaccacccaggaacctcatccccatcaacaggtctggggtagtgggcagttgtcctccctgagcctccacccaaatggaccacagaaggaccatgtgggcttgccagtgaagagcccagtcccacatcctgtgttgatgggctaggaggctgtccagagcatgggagcaaccagtagaaaactggacttttcttcttagctctcagggctggctgtttggcttctggaggacctccccctctgagtatacagtccaagactaagaaaatggtcaaggttttatttcattacaattagagctggttttagtgtcctcttgagcccagacaacaactccatggttttgtggcccagaggctgaaggtgtcacaagaagcccacaaagatggccgggcacagtggctcacacttgtaatcccagcactttgggaggccgaggcgggcggatcacaaggtcaggagatcgagaccatcctggctaatatggtgaaaccccgtctctactgaaaatacaaaaaaattagccaggcgtggtggcgggcgcctgtagtcccagctactcgggaggctgaggcaggagaatggcgtgaaccctggaggcggagcttgcagtgagccgagatcacgtcactgcattctggcctgggcgacagagcaagactctgtctcaaaaaaaaaaaaaaagaaaaagaaaaagaagcccacaaagaaacaacacaggggctacatggtggatcctgagttcttgatgattcagtgcaagatacagcaagttctccgtgcacttccagcaaatgcaaacactgcacttccagcaaatgcttcaagttcatagtgtggccccagtttctgaaggtctagtgtagtgggtggaaagagtcagaaaaatctgcatacaaaccccaagtctacattaactaccttgtctctctgagcctgcatttcctcacgtgtcaaaaggcaaggctagtgcccaccttgtggattggtgtgaaatatttacatatgtataaatccttgatctgtgcctggcttacaggaggtgctccttaaggggagctgcttctcttttattgctgtagaacttatcaaggttaatccacatgagatgtttatccagggggatgctggcttggctgatgggatgcctgagttccaggcctagtgtggccctaacaggctctggaaccgcctcttgctccattatccccaaagagggaaaatgagggagttcacctgtgctctcatagagttctatcagctctgaaatcctgcattctcctcgcagagagaaggtatacatgggctgtggaggcagaaagcttaggcccaaatctggtctctgccactgactgaattaatgtctggaagcctcagtttctcatctgtaaaatggggagtgaaaaagctgatgcactgtaatgcacatgattggctctgagtatctattcaaggctagctctggttactttggtaaatacagactatgggggctttttttttttttttgagatggagtctcgctctgtcacccaggctggagtgcagtggtgcaatctcagcttattgcaacttccgcctcccaggttcaagcaattctcctgcctgggcctcctgagtagctgggattacagacacgcaccaccatgctagctaatttttctatttttggtagagatggggtttcacctatgttgatcaggctggtctcgaactcctgacctcgtgatccacccctgccccgaccccttggcctaccaaagtgctgggattacaggcatgagccaccacgctcggccttatgggggcctttttccaagcattttcctggagaaatgctggtgggaggggaagacatgattttcttgacctggactttgagaatttctgcacataattggcacactgcatctcccctgcacatgtatcctgaacacctgtagcaggccctgtactggttctgggaggattgcctacctggatgaagatgacactttactatagacggtccccacggagtgggggagagtactctacattggcaagacagaagtaactgcaaaatgaaggttcaagtgtcaagctgtgggaacaaatgaattctgccatctaggggagtatggttgatttctaccttgagcaaatcagttgtctggagtcagagggtccagaagcaaagaaagtagatggagagggggagtttccctgcctttcattttctatactggagctatgaatgaagagaggtccccagagagaccttagccaccagggtgggctccttgcttggcccaggggtgatgtcagatcccaggctgagcttagattctcaaccaaacaggcacctgtgcctgaaaagtctttacaggaggccccaaattttagcagggaatatttgttaccacctgaaatgcaggctttcctcaacctgctagtctaaagaaactgtaaagatagttaactcctgtcataacactacaagggactctccagcaaacttaatagatgaaaacaatagaataggcatgaaaaaggaatgaaatcagcacattttacgcattccaagaagcaatgtccccctcaaccccccactcacttttccctctggtgagtggcttgttgttgctgatgattgatagggtgactcactgtcattgtattccttaaaagtccatgacaacagcagtgtccagtatcagaggacccaaacgtaatttaaaatataggcgcagcagcctgcaagttgaactttcgtccagaaatgacaaccaacaaatggtatctactaatattcctctgaaatgactttgggtacagggaggggagccaagccaaccagacagcatgagtttactcaggaccagaggatagaatattgacagtaatccagcttgttaccactgctaaccaactgtcaagaattcagaaatatcactgtggaattcacttaaccttcttcagaaattggccctacccgatcaccagattcccagagtcctgcctatctccaaggtgtgctataaatgtaaatcataaactctcatattataaaagcaattttttgggggggaggacagggtctcacttggtcaccaggctagagtacagtggcaccatcactgctcactgaagccacaaactcctggactcaggtgatcctcctgcctcagcctctcaaatagctaggactacaggcatgcaccaccatgcctggctaatttttgtatttttagagatgggcttttgccatgttgcccaggctggtcttgaactcctgggctcaagcaatcctcctccttggcctcccaaagtgctgggatgacaggcatgagccactatgcccagccaagttctttttgctcagatactttctcatctttttttttaaaaaaagtctaacatctctgcccacttctgtacaaacctttttgtttgcttgtttcagggaaattgccttgtgtatgtgggatcagtaccgtgaactgaaatggtgctgagacacttgggttcttatctgcttactgagtcagagacccagcgactcctcaccagtgcttggtgagaagttagctcctacagttgtaggattccccttgacacaagggttgtagcttatagagagtcctcagatggttttaagaccctcagtgcaggggcccagccctgagaagtccttttctaatatctacccagatgctgttcagcacatacagtaatgtgtgcttagcagagaataccaagacatgaggtagaatctctgcccccaaagacgttgcagtctggttgtggagatataacatacacacaggtagaactatagcagacaatgtaaaatacagcccagtgctatttttatttgttttgtgaatctttcgaatttacgccttagtattggactctgtcctgattcaacaaacatttgttgagcaactgctatctgcttggcactgacgccattcctatgcgctgaggaatgtgggctaggagaatgaatatgcactaggagcactgtgggaatctcatagtttagcaggacagatgaacacatgaactcccaggaattacagtgcaatatggtgggtgccaggaaagaggtaccaggagaaagcaccaagagtgactgcctgaggaaggtttccctagaggcagtggtgtctgactttggtcttaaatagtaagaagggcactttgagtgtgtggagtaagaaaaatcatggtgtgttttgggatcaacaagaagtttgctctggctggagtgtgagagtgtctgtggttttgaggttagggttggggaagggcaggaagatgaagttaaagagttatgaatggccatcgagaccatcctggctaacacagtgaaaccccgtctctactaaaaaatacaaaaaattagccgggcattatggcgggtgcctgtagtctcagctactcaggaggctgaggcaggagaatggtgtgaacccgggaggtggagcttgcagtgagcggagattgcaccactgcactccagactgggcaacagagcgagattccatctcaaaaaaaaaaaaaaaaaaagagttaggaatggccaagaacattgtgatgaagagaccaggctctactgtatgggtaacggagagccattgaaagtttttgagcagtggtgtggtcaggtgtaccttctagaaagatcactctgcccatagcataaagggtagattggagtaagggagagcttgaaagcaatgaagctcctcagaggtccagtgtggaccaatatccacctggaatcatccatttaggagctagtgaagacctgaaaatggagaagaggacaatgaatggatattcactgagcgttccactcagcaaacatttattgagtgcctctcagatgccagtcactgtgccaggccccggggatagagttagatatgacctaactctacactggaggggcttacagtctagagacaagcaagggacgatcacctggtggtgtgtgattggcacagcagaggtgtgggcaacccttgggggcagggagtggaggtggccaactggggaggaggcacagtagggaggccagagaagtcagcaaaggcgtcacaagggcagggagtctaacctgggtgctgagggatgagtaagagtaaccaggcagacagagaactggaggtgagagaggcattccactcaaggggagcatgtgcatgtttgaacacacaggatacataaaagaacagatgggggatgtgatgaggttggcctgactagagcccaagatgtgtatgagggagtggcaggagaccaggctgcgataaaggcatggggccggtcacgtggggctttgcctgccataccaagaaggtgggacctaagtcaaggttttcaaaccctgtttaaatggcagaatgttttggtcaaaattttttagccagcaccccaattacaaaacagataaaaatgatgcagctttagttaaactaaatgtgagactggtacttcctctgtcttggtcttcctcttatccctccaggccacccctgaagcaattcagaacacagtttgagaaccacctgcagtaagtgacagtgatgcaggtagggggatgtggcactgagaggtcttgaagggcaatgccatgtttcccaagtttccagctttatttcgaaagtgacagatacggaagtgcttggtacctaagaggtactcagcttgcatatctgagtgtatgcgtgtgtgtgtgctgcatttgatggatccttccctgggaagggtaggggttagcagtcaagaatattgagttttattttggacaaaatggattaaaggtattttcagaatacccacatgcagagatgtagtaggcacttgaaaatgtaggtgtgagccctgggcaatggtgaaagctatagttatagacttgggagttattggtctataagtgatagctgaagccatggacatcagtacaattgccaagaattagatggaacgtgatgaaaaagtaggcagagccctgaggaccactgacaattaaaagacaggtcagagaagagaagctacaaaaggagacagagagactgagagagatgccaggagaggaagcaagtgaaagctgcatttcagaaaccaggtaaagaaaataggctggacacagtggctcacatctgtaatcccaacactttgggagaccaaggtgggagaatcgcttgaggccaagagttcaagagcagcctgggcagcataacaagacctcgtctttataaatgacaacaaagaaatagaaaatcagcataagcttaaacatagaattggtatttaatagtttggttgctaggaagtgaaaaaggaacaaactaaatgtgagactagtgcttcctctgtcttggtcttcctcccctaatgcattttattggcatagcatattccttttaaaataaatctgaagctggggggagtggggagggatagcattaggagatatacctaatgttaaatgacaagttaatgggtgcagcacaccaacatggcacatgtatacatatgtaacaaacctgcacgttgtgccacatgtactctaaaacttaaagtataataaaaaataaaataaaaataaatctgaagcataccaattttttccagaagtacactccctttaatgtgtaagtatagattagtctagcaaaataacaacaactgagctcacaaggtaagcagtatctctgtggtttagtggaacttctccctctcctctccaggaataaatgaattctcttaaatttctgctcatcagtcaaagtgttacattcaattgagtattcattctgcgtttaaaataattctgcaacggaatgcttagaaagttgtgctttggcaaattgaaaataatttttctaaagtgatgggctaatttgaaatccatattccttttctggttttgatttgtgcagctgaaatcgtaaagcatatccctctgatggtactgttccccctgtgacgtgttctctcccctggggatactggggtctaaacccattcattatggggagggggagatgctggcactcagtagggctcagtgaatgaatggatgatgggctcttttccatcctaactattaatccacctctcaaaggtgtctgtattcaatgaactgaaaaagaaaacaaaactcctaagtagttagagattaaaactactgcccagtctttctctttctcgtgggtacagtgttgtgcacagaatgctgctctctaaaaccccatcatagcagctgactctgtaaaagcttctcgggaaaatcttttcaaaggaataagcaatagaacgtggcttttgaattcccaaagactcaaattctttagattactcaacttctggatttagtttattgtctcatcaaatattgactgagtgcttactatgtgctaggcactgagaaaacgtagtgaataaaacattagaagatcctgttgtcacggagtatgcattccagccagagaagacagggcaataacaaacaaggatacaatgtgtgtccctggtggtaagtgctaagaacaaaaataagcccggcgagggactggagagtgatggggcaggggctgcgttctgaacagggtggctagggaaggacaggtaaactgagagctgaaggaggaaagggatgtttaggcagagagtgctgtcacatgcttagctgctgtcacttacagcttaccccaaccagggcatgtggagatgcattgctttgtcaatgcaaggatcagcccaacctagaaacctgtagccttgtgaacatgatgatatgcagcttagataatagctgttaaaaaccgactcttcaagtgttactgtgagacaattttttgcaggtgacttttaaataaaacagcttccattattcaaaaatccagaatggcaaccagctcttagaaatgactaaaatgacctaccagcattccctgttgtttttttttttctaatggagacttttgctgtcctgccgagaccatgtattatatctagtttcacataaaaatgaatttttgctgctaagtttgaaaactgcctgaaaatagcaattaatattgaaaaagctgacagaaccttaagtgtagtggcatgattggtgctgctataattatgtgcctgagtgtgtacaggctgatgtaaacacagtatgaaaacacacttgatgctcaggacagtgtagccacgtattttcttacgggtaagtgagggcgaaggggagagggagagagaattgatagcatttttagagcactgttaggtggtgtagatctttctaatcttacatcagtataatctttctaattattttcacattctgtatttgatcctcacaatttgtcggggggaaaaaggcagggcaggctttgttcttcccatttaatggatgagaaaactcagtggatcagcgaggatgggttaaggttcttatcgacaaaatggagagattggactacattatttccaagcttccctctaactcaaaagttctatgattattttctgattgtcctgaggtgacaccgctgtttaatggtggagactccccttaagtccagtcctttctgccacagttcctccttatattcttcaaatccttcactgtatgtttaatcatctgtaaaatgcaatgtctactgtacaggttgttgagaagatcgctgaggggattaaaggaggatttgtgaagcacctagcacagtggtagctatcattatcattgtcatcactgttactaataaggagacatgtagtgtagtggagagagcatcagtgctggggcttctgatcattcactgacagagttgataatacctacaacatagggtggtttaaagactaaaggagggttgggcacggtggctcatgcctgtaatcccagcactttgggaggccaaggtgggaggaccacctgaggtcaggagtttgagaccaacctggtcaacatggcgaaaccccatctcgactaaaaatacaaaaaaaaaattagccaggcgtggtggactgtgcctgtaattccagctactcaggaggctgaggcaagagaattgcttgaacccaggaggcagaggttccagtgaaccgagattgcaccactgcactccagcctgggtgacagagtgggactctgtctcaaaaaaaaaatgtctaaaggagatgatgtttatatgaatgcctagcccagtgtctgactacactatacctacaacatagagtggcttaaagactaaaggagaggatattcatatgaatgcctagcacagtgtctgactaccaggtgctcaagaaatggctggctggtgtgaatgataaaccactcttcataagaaactcagatatattttcatgattccctcaaaacctaaagaggcatttcacagaggtgaagtgtaaccttgagagtaacagaagcatatagccatctttatttttttttttaaaaaaaaaaaaggagattctgaagtttggccattctgtacacatctgagagggaggaaaaatccgcatgcatccaatagttagcaaatggtcattgtgaagtttcatgtcagatggtcttctgaaatccagtacatactttattcagttcctcccattctccccactgcaacaatcacataagattgtgtggattatttagaaaaggctgtttaccctcattataccactttctttgaaaagcaatcatgtgaatactatgaggaactgcttggctatagtgatgaccatcatgagggattcaataaagttggaaaccaagatcctggagcctgtatctgacagcgtggtcacagaaaaggctagggcaggactgaaatatgaaaactctccaagaggaattgtggttacttgtctctatgaaggatttcttggtactgaattttcagggtgcaaaaaactaacagatgtaagcatctgttgtcacatgccccaggactgtgttggggaagcgttggcaggtgctaaggagtcacaaggtgaatggcactgccctggaccagttactctaaaatctagtcaatggcttaacccactggacctgagacaatgcatattgttcggaacaccggctttcaaccacattttgttttttataagtattatttgaaaaagataaaacacagcaactggccatttggatgtgaaatcgattcttatatgatatacatctctcctggaaattattctcactgtgaatgtccatcctgcatagacatctcaagaacaattgagtttttctacttgagagcagtacattaaatgctttgaccaatgtctgttatgtttggttaccttccagttttaaaatatgtgaatttcctttttactgttctaggggaaagcgatggtatttgccccacgccgagggaatactttaaaccagttttgcaatctagctgaaaaagctggtttctgtatccaaagacatgaaaattatgatgaacacatttcaaacttccactccaaggttagttttctgcttgtgttagataacactttaatccgcattgcattttgaagagatcatggtctttttggcaggtaacctaaatatttgattaaagtactccttagatgtgttgcttctgaacagctatttgtatctgattattttgtgtggtaaagccatcttttatctttgcatgtctagaaggattttacagaaaccattcctgtttactcttttctctgaaacaaactaatcttttcattcataatagactaatttgtaggatgtaaggggaggtggcatagaatgaataacatgcatttatattttaatgaaaaaccttcagcttttaagtaggttaaatgcttagccgcactgaaataaatagaaggtgaatgtctaattgtatcatgttggactgtaaatctttatctctgcttgctttatagctgggtcagttggcagtttgagactgttaaatctcatacagaatttcacagttgtggggttatatgtcagatggaggcactacaagatttaggtcaaaagcacttatctgagagtgatttctaagcctgcttacataaagcaatgttatcagcctttttattatttataggtatagaccaatataggacactgagaggcgagtgtttcactgaaaactttttaggattctcacgtttgctagtagtacatgtcacagtgactagtataacatgtattatttcagtaattttgtgccttacggaaatctcccttcactgagctagtctgaccttggcaagagactttaacttgtcatgatttcacaagttgtaactgcagaaaaataaaggcccgagcttaattttctcctgggacaatgtgaacagcatcctttattacccaggactgtaatataatgtagaagtgtgttggcttttggaaaaatatatgaaaaattaatctgatcttccaagcaagagaaagaaattctcactttctgaaaatgaatttatttatttgaatctttaaggttccatttagcctctgggggaaaaatggtgctttgtgaactgaaagagttacattacatcctctcactggtggagtcaggcccattgctcatgatcagaaaataaaaacaggatggtatgtgattcagatcttaccagcctctctagaatgatgttttccccttttcaatccctccccctaaaaaaaagcgggtctttacctggtaggaaaagggtccctcctggctccctggactcctccacccaaaggaataatgtggctttctctccagggtcgggctggaactacaaggatcagctgacagctgcttcaatgtcgtgccattcactttccccctagaacaacaaatgcttttagtttcccagtgacagctcaggagagcaaaggcttgggtttctccaccagcaaagacgttcagcattgtgcctgataccctccgtctcctccctgaaagacctgaggagcgttgggacatgccaggcacgcccacctctcctctgtctggaactttagagtgttagcgcctggtggccagcacacctcctctttttatttccaacgttgtacactaccctgctaagtgaagcacataaataagtggctttattttttctctggtcataattgctgaaaagtcaaattcacagtttgctgacattggtacattggactaagaaatagttgtcttcgtggttgggggtggggagagtgtagaaccctaggagaatattctgcagagttggcacatcctggataaaaggtataaacgggcgcccatgatatatatatatatatatattttttttttttttttaataatgagagctatttcagctggtgtggggttctgcttctagcaaaagaatgcctctggtccctcctgtacctgccccagcagcggggatactgtgtgctgaccgggctggcacgtgcagttgtgctcctttgcaggagaaggagctcgcccagaggccggagcagtgagccgggggccacgctggagggagcgggcagcgccgctgctcctcgcccatccccatgccctgcagcagggcgcgaaggcggaggcccaaggcagcacccctgcccctccagccctgcccgcccgcccggggctccgggacgcggccgccgggagcctccaccctggcggcttttgttggccgcgtgctaatagccagggcttaaaagttttccatcttgagcggcaatcagctttcttcctctccatctctggccaaagccccctcgtccctgggacgcgctgctccccaatggaggagcggcgttttccttcaggctgcgtgttatcctcttagccctactgtgttggaatagagcgtaaccagctggaggactgtaagacgcctgataatgccgctcttttccgctgtcccgtcttaatcttgttacacaaatggtcgtgaagagattcatgaattttaattttgccctctgcattagtgcctcgcgtcactcatacacagctgccttcgaagccgagtttttcacccctcctcttacaacaggggaaaaaattagttacttggcagtagtgcaaggtaaaaaaaaaaaaaaaatctacagatttaggcaaccacccatgaagctgattaacagtcagtgatcaggaggaacagctttgcctcttaaacttttcacctctcattgttaactgtgaaattttatttccgttaaaaagcaagcctgtaatcaaaacggtgccattccgcacttttctgccagtgcttttgttaaactgtgcccacaccatgcagccagtgtgctcaggaaccaggcagccaaaggtgtagcatgttttaaaaatattgcttttcagtccatccttgcaaggggagaaaaataaaacacttccctctcctccccagccttttggtctcctcaaggctgagaatcaaattcattgccctcatagtgtggttcaaaacctttcggatagtaagatagcaaatcgttttgtaaggtagagatgtgacttcgagattacagctggcttgatgctagttggtaaaaatactctcattcatgcaaatgttctttgaaatataattttacatgccgtgggttttttttttataaactttcgcaaaaccaccctgaagtgtttatttttctgtatttttgtacatagctctgaaaataggcttgggctgggctgtgaagtcagtacattgtgttaaaaacacggccatattgcacttctgcttatctattcaaaatgccacattacaagtggctggtgcttataatctgtgtggtgtgctgttgataattgtggatactgtaaagggtaaacagtctgaactccactcctgctgctgctgttcacgccgtagtaaggctgagcgtgttacatccaattatgaagtaaagcataatgctactaatagcagctatataatttagtttagtcctcaaagaccctgttttaacctctgaaattggaaaattattttattcatgatttgctttttcttcattttctttcaaggtgccttttgatatttgtcaaaattgtaattattaattgggcaaggaagtacagcctgggtaaatggaattattcttaaaactcataacattcccccatcgaagcaagtattggctaagagctttgtgtgtgttcaagtaccctcacataacagacttgcttgattcagaaatgatccagggctgggttatagtgttgcctttgagggttgtcagctcttccccattgtggaaaggtctcacaggcaagacggggctggcccctggcccctttcagcaacgaagcctccactttggcctccagaggtcagcatagaatccaagttaaaagtgatttctaacccatatttacagaagaattatttatcccacatattacctcagggactttataaagagctcatttgagtctctgtatattagtgcattgtgagtgagtaggtcagctgactgccactgagtaatcaactttcccttatccccaatccccaaggaaagaattgagctagcttggtcctctcttccctctgtaaaatacttcagtgagctccctctatcactagggcaactggcaacaaaagtatttacagtggtaagtcccggtcagtgggtatggactgggaagttggtgaagccattttctcagcattttctaaaattagactaaatagtaaggttggaggacctgtgtttaggcttaacactctcgctactttggtagcagcaaaaatccacaaggatcttcctaaatagacaacaaatcatctgtacacagaacaaactctgtctaagaaaacagaatgaagtcacctcagtgactgtaccaccatcagttcttgggaaagtagattggaaagtggattagaaattaaaggctgaattagctttatgttccccagcggaaaaggggaagtgggctcatgactcctgtccttaatagtgacagcatgtccatgtcatggtttgggaatatgatttagaaggaacatgcacttcgaaaagattcaagttaacatgccccagagggaccaacctgggagagtgtgatgttgaggccattcattttgctttagggtgggtggagtgggtggtgtttgactaatttaaacaataaaggaattgactccctgtataatttaaagaaatatttatttttttattcttataatctaaaaagaaattaacaattggctcataaattccaacttcaaaaatattaattttgtctttataaatagcaaatttttatttgctagaataaatataaatataactttaaaactattccagctgaatgaagaaaaagtgtacttcatatgtgagaaacctaactggattttaaaatcttatcacagaaatatcctcagaacttccctgcacagtatgaacaggaatgttgctagtctaattgttggagtatgttctcctcctcagagaaaagaatttttgagtgacttattattaatgttaaaacccctaagaagcacctggagagcctttgcagtgtcttgggccccacaagcctttccctgtgcccagatgttgccacggactccaagcagtgatctgaaatgcccgcctgcctgaatagtgtggcattggtcagaggcagagggtacagagagcagaaacttctatgtcaaatgcccagtcaggtgatgatgaatgagccccagctctgccttctgtcaagtgcctcacagtttatagaggtcaaagtgcagtttgggtatttatgaaaaaaaccctacccacccccaccaaaaacaatccccatgttaatgtatagaattgtcacattagtgccactgagaactactttgagttgcttttctgtgatttatttttccagaactatatattttggtgtaaaagtcatcatgatactcaacattaatattgactggtaaagatccctaattggagtccccttacctttttctttctattattgttttcagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaat

SEQ ID NO: 1910 - DNA, 144315 bp, Homo sapiens
atactattaatgacaagcctttttttattaaaatggcaagaatacaaatagtttatatcagtaaaatacagtagcattcaggctctaatatgaacattacatcaaagcctatggatagataaggtaagagatttaggaaattgggggaggaaggaaacatcacttatcttattactccagattacagacagctgccacagacaataaaataaaatcgcaattaagttgattgcagtacttgaaagaaaacttattaaaaataaagatttttaataaaatcttacattcttgacagatataccatcacctacctttctaaaagcagtagtagtaaacacaattgtagaatatgtatgttacttagtctttgagtggtacaatactataggttttaaaaccctgacaacactcctactttctgctgcttcaatatcagattatggcatggaattcatgtaaggttggttccaaaatggaatatcagatcccagaccagtatcagtaagttgtacccattttggcacagattttccagccatgaaaacacaaatcacaaagaaaaaaaattaaccaaccaattatttgagataccaagaaaggaaaggaaagcagttttgtaaaaacacttttccctgttttaataagcttctttatttactccagatagtgaacagaatagtgttcaatagtgaagtaagcagattttacactcactatcactgcatggatagaaagagccatatacatttttgtttttataagtcatctcagatcactgcaacatggcacattagaacagagattcagagacacaaagttaataaatacatttaacattgccaagcatttaaaagataaatgcactcatgtagcaaaaaaaaaaaaatcagtttgtaactttgacctttctcagggatgtgaagaatcatttcaggtgtcagaaatctctgtagcaaagattcctataagagaaaaaatcatgctgattaatatttttaattcaactttttcaacatgtgtaacaaatttattctagtaagtgtatcacttcagcaaaacgtaagatttttcttcatttctatgaaggaaaacaaaaaacaatatattttttcactcagttttcacaaactggtacattcataccatggaatactattcaacaataaataggaatgaactattgatacttacagcagcttggatggatctcacgggcattatgctgaatgagaaaagttaatctgaaaaggttatctcaaaacgacagaattatagagatggcgaagaaagtagtgtttcccaggagacagggagatgaagaaggtcagggctacaactataaataggcataatgagggagtgaattctttggtgctgatggaacaacttcacatcttgatcatagttgtgctgtgtgtggattgtaaaaaatatatatatacacatacaaacaaatgagtgcatctaaaaactagtgaaatctgaataaggcctttagactagttaatcacactgtgctaatgtcaatatcccagtttgtaagatactccattatagaagctggggtaaggatatgtgggactgtctgtggtatttttgcaactacttgtgagactataatcattctatttttattttttaattactattttttggagacagagtctcactctgtcacccaggctgaagtgcagtgacatgatctcagcttactgcaacctctgcccccaggttcaagcaaatctcatgcctcagccgcctgagtagctgggattacagacatgcgccaccacgcccagctaatgtttgtatttttagtagagatggggttttgccacgttggccaggctggtctcaaactcctggcctcaaatgatcctcccacctcagcctcctaaagttctgggattatagtcaggagccactgtgtatggccaagactataatcattaaaaaaaagtacctgtggtacatctatactatggaatactactcagcagttaaaaggaatatgtgacaactactaatacatgcaacaacctggataaatctgaaatatattatgctgggtgaaagtcaaccactagaggctgcatactgtatgattccatttacatgacaacctgggaaaggcaaaactagagaggcaggaaacagagcagtggttagaggaaagtaaattcaatgtgatgtctgttgtctagataataggtgtcagtcaaaggacaccatttgaaactgagagtaaaagattaagtgagaaaaaaggtgattaagggcattgttaatcatattaatagaaaggtaacaactaaaataaaataaactttcataaaagccaaaagaaatttgttaaaaagcaaagaagactgatcaaatgaagaaatacaacaaatatcacatagtacagaaagtaattataactattgatgtgacataacagtcatatcaataatgtaaaagattttaactcatctattttatttatactgttctattctatttttgagacagggtctcattctgttgcccaggctagaatgcagtggcatgattatggcttactgaagccatgaccttccaggctcagttgatcctctcacctcagcctaccaagtagctagaaatacaggcacgtgccaccatatctggctaattttttttgtgtgtgtattttttgtagagatggggtttcaccattgcccaggctggtctgtaactcctaggctcaagcgatctgtctgcctcagtctcccaaagtgctaggattacacgtgtgagcaaccacgcccagtgtaattcacctattttttaaaaagattttcaaaatggcagggtgtggtggctcatgcctgtaatcctagcactttgggaggctgaggcgagtggattacctgaggtcaggagtttgagaccagcctggtcaacatggtgaaaccctgtctctactaaaaatacaaaaactaggccaggtgtggtggctcatgcctgtaatcccagcaccttgggaggccaaggcaggtggatcacctgaggtcaggagttcgagaccaccctgcccaacatggcaaaccccgtctctactgaaaaaaaaaaaaaatgagctggatgtagtgatggacacctgtaatctcacctactcagggaggctgaggcaggagaatcacttgaacctgggaggtggaggttgcagggagctgagatcctgccattgcactccagtctgggggacaagagtgaaactctgacttaaaaaaaaaaaaaaaaaaggggatcgttccaagatggtcgaataggaagagctgcagtccacagctcccagcgtaagcgacacagaagatgggtgatttctgcatttccaagtgaggtaccaggttcatctcactgggacttgttggacagtgggtgcagcccacagagtgtgagccaaagcagggcagggcatcgcctcacctgggaagcgcaaggggtcggggaattccctttcctagtgctcgggacactcccactctactactgtgcttttccagtggtctttgcaaacagcacaccaggagattatatcccatgcatggctcggtgggtcccacacccatggaccctgcttactgctagcacagcagtccgagatcgaactgcgaggtggcagcaaggctgggagaggggcatccaccattgctgaggcttgatttggtaaacaaggcagcctggaagctcgaaccgggtggagcccaccacagctcaatgaggtctgcctatctctgtagacttcacctctggggacagggcatagctgaacaaaaggcagcagaaacttctgcagacttaaacgtccctgtctgacagctttgaagagagcagtggttctcccagcatggagtttgagatctgagaacggacagactgcctcctcaagtgagtccctgaccccctagtagcctaactcagggacacctcccagtaggggcaaactgacacctcatacagccaggtgcccctctgagatgaagcttccagaggaaggatcaggcagcaatatttgctgttctgcagcctccgctggtgataccgaggcaaacaggatctggagtggacctccagcaaactccaacagacctgcagctgagggtcctgactgttagaaggaaaactaacaaacagaaaggaatagcatcaacatcaacaaaaaggacacccacaccaaaaccccatctgtaggtcaccaacatcaaagaccgaaggtagattaaaaccacaaagatggggagaaaccagagcagaaaagctgaaaattccaaaaatcagagtgtctcttctcctccaaaggaacacagctccccaccagcaacagaacaaaactggacagagaatgactttaacgagttgacagaagtagacttcagaggatcagtaataacaaacttctccaagctaaaggaggacgtttgaacccatcgcaaagaagctaaaaaccttggaaaaagattagacgaatggctaactagaataaacagcatagagaagaccttaaatgacctgacggagctaaaaaccatggcgcgaaaactacatgacgcatgcacaagcttcagtagccaattcaatcaagtggaagaaaaggtatcagtgattgaagatcaaatgaatgaaatgaagcaagaagagaagtttagagaaaaaagaataaaaagaaacgaacaaagcctccaagaaatatgggactatgtgaaaagaccatatctacatctgattggtgtacctgaaagtgacggggagaatggaaccaagttggaaaacactctgcgggatattatccaggagaacttccccaatctagcaaggcaggccgacattcaaattcaggaaatacagagaacgctacaaagatactcctcgagaagagcaactccaagacacataattgtcagattcaccgaagttgaaatgaagggaaaatattaagggcagccagaaagaaaggtccggttacccacaaggggaagcccatcagactaacagcagatctcttggcagaaactccacaagccagaagacagtgggggccaatattcaacattcttaaagaaaagaattttcaacccagaatttcatatccagccaaactaagcttcgtaagtgaaggagaaataaaatactttacagacaaacagatgctgagagatgttgtcaccaccaggcctgccctaaaagagctcctgaaggaagcactaaacatggaaaggaacaactggtaccagccactgcaaaaacatgccaaattgtaaagaccatcgaggctaagaagaaactacatcaactaacgagcaaaataaccagctaacaacataatgacaggatcaaattcacacataacaatattaaccttaaacgtaaatgggctaaatactccaattaaaagacacagactggcaaattggataaagagtcaagacccatcagtgtgctgtattcaggagacccacctcacatgcagagacacacataggctcaaaataaagggatggaggaaggtctaacaagcaaatggaaaacaacaacaacaaaaagcaggggttacaatcctagtctctgataaaacaaactttttttttttttttgagaaagagtctcactctgtcgcccaggctggagtgcagtggtgcgatcttggctcactgcaacctccacctcccaggttcaagcaattctctgcctcagccttctgagtagctgagattataggcaagtgccaccatgcccggctaatttttgtatttttagtagagacagggtttcaccatcttggccaggctggtcttgaactcctgacctcgtgatccacctgcctcggcctcccaaagtgctgggattataggcgtaagctaccgtgcctggcctaaaacagactttaaaccaacaaagatcaaaagagacaaagaaggccattacataatggtaaagggatcaattcaacaagaagagctaactatcctaaatatctatgcacccaatcaatacaggagcacccagattcataaagcaagtccttagagatgtacaaagagacttagactcccacaaaataataatgggggactttaacaccccactgtcaacattagacagatcaacgagaaagaaacttaacaaggatatccaggacttgaactcagctctgcaccaagtggacctaatagacatctacagaactctccaacccaaataaaaagaatatacattcttctcagcaccacatcacacttattccaaaattgaccacatagttggaagtaaagcactccttagcaaatgtgaaagaacataaattataacaaactgtctctctgaccatagtgcaatcaatcaaattagaactcaggattaagaaactgactcagaactgcacaactacatggaaagtgaacaacctgctcctgaatgactgctgggtaaataacgagatgaaggcagaaagatgttctttgaaactaatgagaacaaagacacaacataccagaatatctgggacacatttaaagcagtgtgtagagggaaatttatagcattaaatgcccacaagagaaagcaggaaagatctaaaatcgacactttaacatcacaattaaaagaactatagaagcaagagcaaacacattcaaaagctagcagaagacaaataactaagatcagagcagaactgaaggaaatagagacataaaaaacccttcaaaaaatcaatgaatccaggagctggttttttgaaaagatcaacaaaattgacacaccactagcaagactaataaagaagaaaagagagaagaatcaaatagatgcaataaaaaatgataaaggggatatcaccactgatcccacggaaatgcaaacaaccatcagagaatactttaaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggactagacagattcacagccgaattctaccagaggtacaaagaggagctggtaccattccttctgaaactattccaatcaatagaaaaagagggaatccagatgcaataaaaaatgataaaggggatgtcaccaccgatctcacagaaatacaaactaccatcagagaatactacaaacacctctacgcaaataaactagaaaatctagaagaaatggataaattcctcaacacatacacgctctcaagactaaaccaggaagaagttgaatctctgaatagaccaataacaggctctgaaactgtggcaataataaatagcttaccaaccaaaaaaagtccagaaccagatggattcacagccgaattctaccagaggtacaagaaggagctggtaccattccatctgaaactattccaatcaatagaaaaagagggaatcctccctaactcattttatgaggccagcatcatcctgataccaaaggctggcagagacacaacaaaaaaagagaattttagaccaatatccttgatgaacactgatgcaaaactcctcaataaaatactcacaaaccaaatccagcagcacatcaaaaagcttatccaccatcatcaagtgggcttcatccctgggatgcaaggctggttcaacatatgcaaatcaataaatgtaatccagcatataaacagaaccaaagacaaaaaccacatgattatctcaatagaggcagaaaaggcctttgacaaaattcaacaacgcttcatgctaaaaactctcaataaattaggtattgatgggacgtatctcaaaataataagagctacttatgacaaacccacagccagtatcatactgaatgggcaaaaactggaagcattcccttgaagactggcacaagacagggatgccctctctcaccactcttattcaacattctgttggaagtgctgaccagggcaattaggcaggagaaagaaacaaagggtattcaaataggaaaagaggaagtcaaattggccctgtttgcagaagacatgattgtatatctagaaaaccccattgtctcagcccaaaatctccttaagctgataggcaacttcagcaaagtctcaggatacaaaatcaatgtgcaaaaatcacaagcattcttatacaccaataacagacagacagagagccaaatcatgagtgaactcccattcacaactgcttcaaagagaataaaatacctaggaatccaacttacaagggatatgaaggacctcttcaaggacaactacaaaccactgctcaatgaaataaaagaggatacaaacaaatggaagaacattccatgctcatgggtaggaagaatcaatatcgtgaaaatggccatactgcccaaggtaatttatagatttaatgccatccccatcaagctaccaatgactttcttcacagaattggaaaaaactactttaaagttcatatggaaccaaaaaagagcccgcattgccaaggcaatcctaagtcaaaagaacaaagctggaggcatcacgttacctgacttcaaactatactacaaggctacagtaaccaaaacagcatggtactggtaccaaaacagagatatagatcaatggaacagaacagagccctcagaaataatgccgcatatctacaaccatctgatctttgacaaacctgacaaaaacaagaaatggggaaaggattccctatttaataaatgatgctgggaaaactggctagctgtatgtagaaagctgaaactggatcccttccttacaccttatacaaaaattaattcaagatggattaaagacttacatgtttgacctaaaaccataaaaaccttagaagaaaacctaggcaataccgttcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaaccaacagaatgggagaatatttttgcaatctactcatctgacaaagggctaatatccagaatctacaatgaactcaaacgaatttacaagaaaaaaaacaaacaaccccatcaaaaagtgggtgaaggatatgaacagatacttctcaaaagaagacatttatgcagccaaaagacacatgaaaaaatgctcatcatcactggccatcagagaaatgcaaatcaaaaccacaatgagataccatctcacaccagttataatggcgatcattaaagagtcaggaaacaacaggtgctggagaggatgtggagaaataggaacacttttacacggttggtgggactgtaaactagttcaaccattgtggaagtcagtgtggcgattcctcagggatctagaactagaaataccatttgacccagccatcccattactgggtatatacccaaaggattataaatcatgctattacaaagacacatgcacacgtatgtttattgtggcactattcacaatagcaaagacttggaaccaacacaaatgtccatcaatgatagactggattaagaaaacgtggcatatatacaccatggaatactatgcagccataaaaaatgagcttatgtcctttgtagggacatggatgaagctggaaaccatcattctgagcaaactatcacaatgacagaaaaccaaacaccgcatgttctcactcataggtgggaattgaacaatgagaacatttggacacaggaaggggagcatcatacactggggcctgttgtggggtgggaggaggggggagggatagcattaggaggaatacctaatgtaaatgacgagttaatgggtgcagcacagcaacatggcacatgtatacatatgtaacaaacctgcacattgtgcacatgcaccctagatcttaaagtataagaataaataataaaaaagagtgtaaatttctcaaaaaaattcacaatgactcataaagcaaaactcaaatccatactgtatataagagatatatttaaaatgcagttactcaaaaaagttaaaaatatttaccatgtaaatagaaacaacaagaaaataggagtggcaacactaataccagacaaagtagagttcagcaaaagaaaaaaatctaaatgcatcagaaaaggacactttataaaagccacattccatgatgaagaatgacagttcagaatatcaatgcaacaaataaaacagcaaaccacctatataaagcaaaatttagaggatatggaaaaagcaattaaaacatactaataataggagactttagaacaccactcttgatataaaacaggtcagatgaacaaatattaaacagtgatataaaagatctgcaaaaaatgaaaaagtggaggtatttacaccacagaaattggcaagtgctacagatcagggcctccccctcctctctttggaaagccagtttaccagcacaccactgagctatccctacagaattaaaaataccacatagcctctataattaaatagtgtgggactgcacatgaataggcagatcaatggaatagaaatagaaagtccaaaaagagatctgaatgactgggacaaagagtcttttaaatcaatgatcttgcaacttgatagtcagttggaaaaagataaaattagatccatttctcaaaccatacataaaataaactccaaatgaatcagatatctaaatgcaaaaagtaaaaatatacaagtactaaaagaaaacattcctctactatctggggagagagaaagatttgctaactgtgaatagaaatccagatgcattaaaggaaaagctttaaaatctgactacacaaaaataaaaactttatagagaaaaaggcaatacagtaagattaaaagacaaatgacaaaaaagtgagaaaatattggtagcatatatcaccaataaagagataatttctgaaatgtactaaaaatttttttaacaaaaagatctaaagtccattagaaaaatagacgaagaaatgaatagctaattcccaaaaagagatataataatagcccttaaacctatgaaaagatattcaacttcactcacaataagagaaatgcaaattaaagctacactgaaataccatttctcatccaccacagtggcacaaattcaaaagcttgacagtgtgttctattagtgacgctgtggggaaacagtactttcacacattgctgaagggactgcaaaatggaggggaatgtggcactgtctaacaaaactacatgtgtatttacccattgacccagcaatcccacttctaggaatttattctgaagatactgcaacatgagaatacatatgtacaagattattcattacagccttgtttgtaattgcaaattattggaaactacctaaatgtccaagtttaggaggtgggttgcataactatggtacatccatacactggagtagtgtgcacctgaaaaaaaggactaaggagaatctctatgaatcaatatggagagatttccaggagatagtgttaagtgagaaaagcaaagtgcaaagaagcatgcaactttttgcataaacaaagaaagatatgtatctgtgtatcattagcacaaaaccacaaagaaagggggtggaggcatggctgatgggatggaaggcataaagagaaagtgacacttctcttagtattattttttgcagagtgttgaccttcaaaagcatgctaatctacatattcaaaaataaaattaagttgaggaaaaaactaggaagtggaaatatgaaaaatgaaagcaaattgaaacaaatgaatccaatgttacttacaatgaataccatgaccaaaataaaagatggaaaaaaattaatccaaataagttacaaactcagtatttaactaaatgctctcaagacttgggcaaggtagcatacaggcctaagaaggaagaactgcaaacagattctgagcttttaaaaagttggcctgttcaggagatcgagaccatcctggctaacacggtgaaaaccccgtctctactaaaaatacaaaaaattagccgggcattgtggcaggtgcctgtagtcccagctactcaggaggctgtggcaggagaatggcgtgaacctgggaggcggagcttgcagtgagccgagatcgcaccactgcactccagcctgggtgacagagcgagaccctgtctcaaaaaaaaaaaaaaaaaaaaaaaaaaagttggcctgtttattgtggtgacatcggtgaagaaattttgaaactattgtagatgcattctgggattgagcaaattagtaactacattgatattgttgagtaaacatgttaatgttgagccaaggttctcactgtagaagaaagaacatatatataagtaatggaagaaagcaaggatgaaacctgtgggcatggtttggagttttgtttatatttttaaatgagcctctgtgagtgtgtgtgcaagtgtgtgtgtctgtgaagaaacatgcaagcatgtgagcacatgagccaccacatgtgtatataagaaaacaaatggggtaaaattttttaaatagtgagtatgggtaaagggcatgtagatgttctttgtattcttatttttgtaactttttgaaaggttgaaattgtttccaaataaaaagtttttatgaaatttgtgatacatagaaatatatctaaaatattttcctctaaaaaacaagctgattactttcctagaacatataaattttgtggtgctataacaaccaatgttttgtaattaaatgaaagaagttaatgtagaaataaaaaggaaatcaaactcttaaaatacaatttatggggcagatggagtatggcagataggagacaggtctaacgtgcagctcccacatggaaggacagaacagtgttagagactcatattgtgatcttttgctccaagattcactgtaggaatataccaggaaaaccaaaagaattcacatatccttcgaaagaagtggcatgctgctgccaattccatgaaacaggtgaaaaactgtgagttcccaaagtgtgagagggaagaaaacctacctccgaacacgtccccactggggaatctaaaaatccacatcacgggagaaaaatttaaccttatctagagatgaaagagatttatggagtcacgtaaagtataaaagtagaagtagcagcaggaagtgccttgcacacactcccagtctccagctcaagcccagggaagccagcaatggcttctcacaggtgtccttgggaaggcagccagcagaattggggaggggtcacagagtgaaggaagctcccaactgaaattggtagtggttttgactgggcacaaattttcttgagcagagtccaggggacgagtggaagctgctgcagataggagccagggcaagaatagccagacagggaagggccaggttcaaatgctgtgcttgctttttcagtggggtagctcacggcctggggcaaaatctgagcaaggcactgcaggagcgaggctggccttgccaactacatgggagctgggcaaggcctcttgctactggctattccccacttctctggcaaactgtatgatacagcagaggtggccaagatcccctctataacataagcccattggcctgagaaccatacccccatcccccaaggtggccgtggcaagccctgcccaagtagagtctgagcccagacccacctaaccctgccccgacctaaagtgatgcatcactttcctgtcacctctactagagcaggtactggtatccatgctgttgccaggctgtagtacggtggtgcaatctctgctcactgcaacctccgacacccgggttcaagcgattctcctgcctcagcctcccaagtagctgggattacaggcatgtgccacccacctggctaatttttgtattttcagtagagacgggatttcgccatgttggccaggctggtcttgaactcctgacttcaagtgatctgcccacctcggcctcccaaagtgctgggattacaggcattagccaccatgcccggccaaagacaggtctttagaattagcccaatcagacaaagacaaaaaagaattttaaaaaatgaacaaatcctccaagaaatttgggattatgttaaatggccaaacctaagaataactagtgttcctgaggaagaaaagaaatctaaaagtttagaaaacttatttgagggaataattgaggaaagcctccctgaccttgctggacctcctccctgacctttaaatgtgcctctgcaagtatgtgtgtgtgcaagtgtgtgtgtgtctgtgaagaaacatgcaagcatgtgagcacatgagccaccacatgtgtatataagaaaacaaatggggtaaaattttttaaataatgagtatgggtaaagggtttggagatctagacctccaaacacaagaagctcaaagaacacctgggaaattcattgcaaaaagatcatcacctaggcacaaagtcatcaggatacccaaagtcaagacaaaggaaagaatcttaagacctgtgagacaaaagcatcaagataaactataaaggaaaacctatcacattaacaccagatttctcagcagaaaccctacaagccagaagggattggggtcccatctttagccttatgaaacagccaagaattttgtatccagcaaaactaagctacataatgaaggaaagataaagtcattttcagacatgctgagagaatttgccactactaaaccagcactacaagaactgtttaaaggagttctaaatcttgaaacaaaacctcaaaatacatcaaaatagaagctccttatgacataaatctcacagggcccataaaacaataacacaatgggggaagaaaacaccaaaacaaggtattaaggcaacaactaatgtgatgaacagaacaatacctaacatcttaatactaatgttgaatgtaaagagcctaaatagtccacttaaaagatacggaatggcagaatggataaaaattcactgactaagtatctgctatcttcaagagactcacctaacacataaggactcacataaacttaaggttaaagggtggaaaaagatattccacgcaaatggaaagtgagcaagagtagctattcttatatcagacaaaacagactttaaagcaacatcagtaaaaaaaagaaaaagagggacattatataatgataaaaggaatagtccaaaaggaaaatattgcaattctaaatgtatatgcacctaacactggagctctcaaatttagaaaacaatgactattagacccaggaaatgagatgcacagcaacacaataatagtgggagacttcaatactccactgacagcactagacaggtcatcaatacagaaagtcaaagaaacaatgaacttaaactataccctagaacaaacggacttaacaggtatttacagaacattctacccaacaactgcagaatataaattcttttcttcagcacatggaacaatctccaagattgaacatatgataggacacaaagcaagtctcaataaatttaagaaaatcagatttatataaagtatcttcttttttaacttatcttttgtaatttttttgtctcattttcattgagttctgctctgatctttgttatttcttttcttctgctgggtttaggtttggtttgttcttgtttctctagttccttcaggtgtgaccttagagtgtctatttgtgctctttcaaactttctgatgtaggcactaaatgctatgaacttttcttagtactacttttggtgtatcccagaggttttgataagttgtgtttcactattacctctcagttcaaagaagtttttaatttccatcttgatttcactgttgacccaaagatcacttaagatcagatgatgatgatgatgatgacaataataataataattattaatttttttgagatgtaatcttctctgttgctcaggctggaatgctgtggcgcaatctcggctcactgcaagctccaccccctgggttcacactattctcctgcctcagcctcccgagtggctgggactacaggtgcctgccaccacgcccggctaattttttgtatttttagtagagacgggttttaccatgttagccaggatggtctcaatctcctgatgtcgtgatccgcctgcctccgccccccaaagtgctgggattacaggcgtgagccaccgcacccagcctgaagtatcttcttaaaccacagtggaatgcaactggaaattacctccaaaaggaaccctcaaaactataaaaatacatggacattaaataatctgctcttgaggctggctgcgggggctcatgcctgtaatcccagcattttgggaggcgaagacaggcggatcacttgaggtcaggagttcaaaatcagcctggccaacatggtgaaaccctgtctctactaaaaatacaaaaattaaggctgggcgcagtgcctcatgcctgtaatcccagcactttgggagactgaggcaggcagatcacctgaggtcaggagttcaagaccagcctggacaacatggtgaaaccctgactctactaaaaacacaaaaaaattagccaggcatggtagcagacgtctgtaatctcagctacttgggagtctgaggcacaagaatcgcttgaacctgggagatggaggttgcagtgaaccgagattgtgccattgcactccagcctgggcaacagagcgagactctgtctcaaaaaaataaataaataaataaaaataaaaataagcccggcattgtgacgcatgcctgtattcccagctacttgggaggttgaggcaggagaactgcttgaacctgaggagcagaggttgcagtgagccgagatcatgccactgcactccagcctgagcaacagagcaagattccatctcaaaaaaattaataataattatcatcatcatcatcatcatctgatcttgagtgatctttgggtcaacaatgaaatcaagatggaaattaaaaacttctttgaactgagaggtaatagtgaaacacaacttatcaaaacatctgggatacaccaaaagtagtactaagagaaaagttcatagcatttagtgcctacatcagaaagtttgaaagagcacaaatagacactctaaggtcacacctgaaggaactagagaaacaagaacaaaccaaacctaaacccagcagaagaaaagaaataacaaagatcagagcagaattaaatgaaaatgagacaaaaaaattacaaaagataaatcaaacaaaaagctggttctttgaaaagataaacaaaattgatagaccactagcgagattaaccaagaaaagaagagagaagatccaaattagctcaatgagaaatgaaacaggagatattacaaccaataccacagaaatacaaaagatcattcgaggctactatgaacacctttacacatacaaactagaaaatctagaggagatggataaattcctggagatatacaactctcccagattaaatcaggaagacatagaaactctgaacagaccagtaagaagtagagagattaaaacagtaataaaaaaattgccaataaaaaaagtccaggaccagatggattcacagctgaattccatcagacagtcaaagaagaattggaaccaatcctatagaacactactgcacaagatagagaaagacggaatcctccctaaatcatcctatgaagccagtatcaccctaattccaaagctaggaaaggacataacaaaaagtgaaaactatagaccaatatccctgatgaacatagatgcagaagtcctaaacatcaaatttgctaactgaatccaacagcatatcaaaaagataatacaccatgaccaagtgagttgcataccaggtatgcagcaatggtttaacatatgcaagtcaaaaaatgtgacagatcacataaacaaacttaaaaacaaaaatcatgtgatcatcttaatagatgcagaaaaagcatttgacaaaatccagcatccctttatggttaaaaccctcagcaaaattggtataggagggacacacacttcacatagataggtaataaaagctatctatgacacacccacagccaacattatactgaatggggacagttgaaagcattccccctgagaactggaacaagacaaggatgcccactttcatcgcttctattcaacatagtatctgaagtcctagacagagcgatcacacaagagaaacaaataaagggcacctaaatcagtagagtcaaactatcactgttcactgacgatatgatcatatacctagaaaaccctacagactcatccaaaaagctcccagatctgataaatgaattcagtaaagtttcaggatacaaaattaatgtgcacaaatcagtagcactgctatacaccaacagcaatcaagctgagaaacaaatcaataactcaactccttttacaatggcagcaaaaaacaaacaaacaaacaaaaacaccaacttaggaatatacctaatcaaggtggtgaaagaattctacaaggaaaactacaaaacactgctgaaagaagtcactgatgacacaaacaaatggaaacacatcccatgctcatggagaatcaatattgtaaaaatgaccatactgccaaaagcaatatgcaaattcagtgcagttccaatcaaagtaccataatcattcttcacagaactaggaaaacaatcctaaaattcatatggaacctcaaaagaccccacatagcaagactaagcaaaaagaacaaatctggaggcatcacattacctgacttcaaactatactacaagactatagttatcaaaacagcatggtactgatataaaaataggcacatagaccaatgaaacagaatagagaacccagaaatgaagccaaatacttacagccaactgatttttgacaaagcaaacaaaaacataaagtggggaaaggacatcttattcaacaaatggtgctgggataattgggaagccacatgtagaggaatgaaactggatcctcatctctcaccttataaaaaatcaactcaagatgatcaaagacctaaatctaacatctgaaaccataaaaattctagaagataacattggtaaaagtcttctgaactttggcttaggcaaagatttcatgaccaagaacccaaaagcaaatgaaacaaaaacaaatataaatagatgggacttaattaaactaaaaagcttctgcacagcaaaagaaataatcagcagagtaaacagacaacccacagagtgggagaaaatcttcccaaacgtgcatccagcaaaggactaatatctggaatctacaaggaagtcaaacaatcagcaagaaaaaacaaaacaaaacataatcccatcaaaaagtgggctaaggacatgaataaacaattctcaaaagaatatatacaaatgcccaacaaacatatgaaaagatgctcatcatcactaattatcagggaaatgcaaattaataccacaatgagatacctaccttactcctgcaagaatggccataattaaaaaatcaaaaagcatagatgttggcatagatgtggtgaaaagggaatgttttcatttacactgctggtggaaatggaaactagtacaaccactaaggaaaacagtacagagattccatttagaactaaaagtataactaccatttgatccatctatccaactactgggtatctattcagaggaaaaaaagtcattatatgaaaaagatacttgcacacgcatgtttgtagcagcataatttgcaattgcaaaaatatggaaccagcctaaatgcccattgaccaacaagtggataaagaaaatgtggtataaatacaccagggaatactactcagccataaaaaggaacgaaataatggcattcatagcaacctggatggagttggagaccattattctaagggaagtaactcaggaatggaaaaccaaatatcatatgttctcactttaagtgagagttaagctatgaggatgaaagttataagaatgatacattgggccgggcgcggtggctcacgcctgtaatcccagcactttgggaggccgaggcaggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctggacgacagagagagactccgtctcaaaaaaaaaaaaaaaaagaatgatacattggactttggggattcagggggaaggatgggagaagagtgaggaataaaggagtacacaatgggtacagtgcacactgtttgggtgttggatgcaccaaaatctcaaaaattactgctaaggaacttatcggtgtaacaaaaaaccacctgttcccccaaaaccatggaaataaaaaaatatataatttatgcaaacagataaaatattagacctttcactttagtataatatatataattctaatttaattatcaaaatcctgtattttatatcaatatatcttggtaatcatgtttaaatatcactattaaagatagactattgagtttccttattaccccaaatgttcactatactagatactgctatttgatctcaagagaatggatccttaaatagactcactcttctaatgatcgatctaggcctcggtcaggagatcgatggtgagcacgttctggtgaatgacattttgtatttggcttcattgtagaactcatatgataagcattacttgaataattttggcggcgaagttcttgtacggccctctccctaaagcaaaatagtgatgctttaaattttatatccagcaaaattattaaaactatcataaaactagctcaattcatacttgaaaatctaaccatcatgaaagaactaaaacctcttgttacctaagaaacaatgctttccatgctgaaaagcattgtttttgagcttgcatagagataaacttacctttcaaagcgctctgttcctagttgtcttttggtaatgtctaaatcagcttccaattgtgtgacaacatttctgaactgggccacatctctactctggatggccctgtttaaaagaagataagagttatagttgactaaacttaaaatatggctatgattctggggtacatgaaaccatattgatagtggtttctcagctggatccaaatcacattgtgatttttatggccagatttattagtacatctaaaatatgcccatgttagacatagtaagtatgcagagtagcctacttgaaaagcctaagcaatcccagtcccatttaattagttaatccttctctgtttcagcttccctgtgggaacatattatacatcatctgtctatactacttactataaattgttttttatgtaagtacttagaggtattctataaagtagtggtatgatcaaataattaacaccggaattcactagctccatgattaatatggtctgttttatatatatctattcaaccaagtgccttataatgaaatttgacatacacaatcttcaatttaatagaatcttccttaaggctaaaaaatgcctcaaaaaacctgtaataaggcacaatatcatagggaagataaacattgatgaatgccactcacacagaacattctatcctcttcacttgctttcaggatagtatcatagactgctgaaatctaaactttagagactaataacaaacacttctcatgctaattctaagtgttagtatttaccagccagtctaaaacagagtatagcccttagggtggaagttttggcgtatttcacaaaaggtagatttccacctaccatcctgagaaagtgatcctgcaaaacctgttgaaggaatcataataggctagctacagtaatggaaaagaaggactcagtcaccgccactataacctgaaaacagtttctgaaggaaactggccctggctctgaagcccttgcctagtcaggggctcctaggagtggctgattgctgagaccatgcttcttatccttccccatgtcctgacctcagatgtgaggacagagtggaggctggatgaaaagtgttacagatgggacaggtaagaacaggggttaagggtcccccatcagtttttatgagagatgatcaagtttaatagaaaaaaaattcactatacagggaggcaattccacccaattctccagccaaatgtcttttaataaggtgctaggagtgctagagatcctaaagaaaagaaaaagaaagaaaagaagccaaaatcaatgtcctgggaagtcttctgtattttgtgaatgcaggtgttcttctaggtatccagtacatgcaataggtacaaaagaaaatatgatgtggcaaatgcaaacactaggttgcaatatattggtctaaatatgaaaattcttctggtttcaaactggttaattttttttctcattttgttatatttcctaaaggcagtattttagatcagacattctatcatactcaaaactctgttggaaagaatcagtagagatcattaaacttaaatttagataagaaaaacataatagaaaaagtaccacctcttaggcaaatcacagtatttctgatccttaggcaaagtatagaaggcaaattctctaaattctagcttaaaatttctactaaagtaccaaaaaattaagatgtatgactttactttatattgctaaacaactcacattttattttctgccaaacaaaggtgttctttaagaagctgaatttcagattctttttcttgaagtgctatctgagactgatattctttgtctcgattggccaccagcaaagcttctagattctgcatggagattctctcatttgccatctgactcctcaggagttcaatttcagaatgagcagaatctaactcattctccctctgttcaataacaagaagatatctacacttattcccattaattcacttaactattatattatcagggactcacaaaattttcataatctgttataaactggcaactacttttaatgtgatttgaaattgtgtccctccttcttaccaaataaacacaccacacatgtatgtatagtatcactttctccatctctctgatcatatcagaaaattcattaatttaagaaaaggcttattaatttcaaactgcaaccagtttctactaccagctttgatatttctttatatactcctgcaagactgacaggatgatatctgtgagcactgctttgtcctgagttaggtgagctacatgcttatagaatgtcattggactccataattaaggaatataaggagtaatctcttatattcttatataaagagtaatctcttatagtctcttaatataattaataattatatttaataatgtaattaaatataattataattaatataaggagtaatctcttatattctcttgcataaacttgtggaaagcttcctttagaaaattatcttgagccttaaaatatgctcagtgagacaaatgttttttaaaaaggaggaagaacagtcactagtatttagaaaacaattattccttatcttgtaatatacataacaaattctatatgcatttaaaagttaaatttgaaaaggtaagctttaaattccagtgaaaagaaataaaaatgaaattacatggaagggagataggtaggtagggaaattttctaagctagatacaatgcaaaaaaaagtttcatcacattaaaaaaataaacattttgatagtcaatataaacttaaccaaaatttgaaaggaaacaactggaagacaaataaacttagtaaatcaaattaatagcttatatctctactaacataaagaacgcatataaactgatgagaaatatgagctaaatgataatgatcagaaaatttacaaaaggagaaatacaagtaaattataaacgtatggggaaaatttacccttactagtaatcaaataaactaaaacaagatgctattactagttcagggcttcttacctcaacattactgatgttttgggttggataattatttggagtgggggcagcactatgcattacaggatgcttagcagtatccctggcctctgcccaatcaacgccaccagcattccccactctagtcatgaccaccaaaaatgtcattactaaatgcacactgggagcaaactctctttcagctgaactggaaaaactctaccaaagacactgttctagtctatctagtctattctagtctatcgcaaatttgttagtttgtgttaatgaacattacattgggcaatggcaatctcatatactttgctggcaggagtagaaaatggaccgtgatttttttgacaatagcttttttgaaatataattcacatgccatcaatgatttttagcatattaacacagttgtacaatcgttaccacaatctaatgtgagaactttttcatcatcccaaaaagaaactcaaggttgggcatggtggctaacacttgtaatcccagcactctgggaggccaaggtaggtggattgcttgagctcaggagtttgagaccagcctgggcaacatggtgaaactccatcgctacaaaaaattcaaaaacttagccaggcatggtgacataggcctgtagtcccagctactcagcaggctgaggtgggaaattgcttgagcccagaagttgaggatacagtgagccaagatggcaccactgcactccagcctcggccactgaaggagaccctgtctcaaaaaaaaaaaaaaaaaaaaaaaaaaaacacccaacacagaacgttctctggccctaggcaacccctaaactattttctactatttgccttattctgggtattccatataaacggaaacaaacaatgtgtatgcggtcttttgtgactggcttcctttattagcacaatgtttttaagagttatcgatgttttagcaggatcaaaacttcatcacttttattgcctaataatattccattgcatagataaaccacagctctattcatgagttaaaaatatttgacttattatactttgggactattataaataatattgccataaaaatttgtatacaagtttttgtatggacatgttttcattcctcttgaatagatagaagtgacatttatgagctgtaaggcaatctaatttttaacattttgaggaactgacaaaatgttttacaaagttgccttactattttacatttccaccagcaatgtatgagggtttcactttttccacatttttgtcaacattttttatcttctctctgattacagccatcctagtggttgtgaaatagtatggttttgatttgcatttttctattaatgatgttcagcatcttttcatgtgtttattggccatttatgtatcttatgtagagaaatgtctattaatatcctttgcctaattttttagttgggttattaagttttttgttttttgagacaaggtctcattctgtcacccaggctggagtgcagtggcatgaagatggctcactgaagtaaacctcccacctcagcccctcaagtctctgggaatacaactgtgcaccaccacacctggttaatttttgtattttttgtagagatgggtttttgccatgttgcccaggctggtcttaaactcctgggctcaaacgatcctcctgtctaggcctcccaaagtgctaggattagaggcatgaaccaccactacatattttgaatatgaatctcttatcagatatatggtttgcaaatgttttctcacatcttgtgcatcgtcttgccactttcttgatgatatcatttgcagcacagaaggtttttttttttattttgatcaagtctacttaatctattttttttgtttgtgtttttgatgtgtatttaagaaagtgctgcctaacccaaggtcacaaagatttacttctgtgttttcttcttaatacagttttggctgttacatatagccctatgattcattttcagttaatctttgcatgtgatccaacttcattcttttccacatagatattaggttgtcccaacgccatttgctaaaaatactattctttcctcattgaattgtcctagcacctgtattttgaaaaatcatttgggcacaaatgtataaaccatttctggactctgaattctgttccatcaacctctatgtctttccttatgctagtaccacattgtcttgattacttcagttttgcagccagttttgaaatcagggaagtgtgattctccaactttctttttctttttcaagattgttttggctattcacttgcacttccatatgaattttagatcagtttgacaatttctacaagacacctgggattctgataagcattgcattaaatttgtggatcagttttgggagtaatgccatcttaacaatgataagtgttctggcccatgaacatgggatgtgtttccatttatttaggtctcctttaatttctgttgacaatgttctgtagttttgtaaagtacaagtatttgtctttttttttttagacagagtcttgctctgtcaccaggcagagtgcagtggcataatcttggctcactgcaacctctgactccctggttcaagcgattctcctgcctcggcctcccaagtagctgggattacaggcacgtgccatcacacccagctaatttttgtatttttagtagagatggggtttcaccatgttagccaggatggtcttgatctcctgacctcatgatctgcccacctcggcctcccaaagtgctgggattacaggcataagccaccgcgtctggccgtatttgtccttttttaatgctaccctttttgatgcaattccgtttgatataatttttttttcagattgttcattgttaatgtatagaaataagaaatatgataactggatattgatcttgtgtcctacaaccctgatgctcattaattctaatacgtttttagtggattcttaggattttctatatttcagatcatgtcacctgcgaacagagatagttttacttcttttccaatctggatgccttttatttctttttcttgcctaactgccctgcctagaacctctgctacagtgttgaatagaaaaggcaaggtgggcattcttgtcttgatactgatcttagggcaaaatcattcaatcaccactaagtacagtgtttgctgtgggtttttcacaggtgccctttatgaggtcaagaaagtttctatttctagtttatagagtgtttttatcaggcaagaatgttggattttgccaaatgctttttctgcatccattgagaaggctgtgtggttttcgttcttgattctgttgatatgatgatgtattaattgatttttcagttgttaaaccaacccagcattcatggaataaaccttactagatggtgtaaatttcgttttatgtgttgttggattcagtgttatagtattttctcgagaatttttcatctgtattcataagagataatggtctgcagttttattttcctgtgaggtgtttgtctggctttggcctcagggcaataatggcttcatagaatgcattaagaagtgttgtcttctacttttggaagagtttgcaaaaatgctggatcaatgcatcttgaatcatttggaagaattcacaactgaagccatctgggcctcagtattactttatggaagtttaaaaatttctattttcacctctttaggttacaggtttattcagattttctacttttccttaagtcagttttaatagtttgtgtttttctggaaatttgttgatttcatctaagcatttaatttttggcattcagttgttcatgatattcccctatgatactttttttataaggttagtagtgatgtcccttctcttattcccgattttagtaatttggctctgtcactttgctaaagatttgtcaattttgttggtattctgaaagaacaagcttgtggcttctttgattcttgattgttttcacttagtttctgttctaatcttgattattattttcattcttcttgctgtgggtttagtttgttccctttttccagtgttctaagtggaaggctaggttagtgacttaagagttttcttcttttttaatatagataggcatttatagctataaatttccctctaagtactgctttagctgcatcctatatgttttgacacagtacatattcattttcactaatctcagagtattttctttttttcctttgtgatttcttctttgactcaccactatttgggaatgtgctgctcaattttcatatacttgtgaatttacaaaatattcttcttttatcaatccctaacaattccattgtgatgggaaaacatattttgcataagttcaatccttttaaatctattgaggcttatattatggcctaatgtatgatctattctggaggatcttccatgttgagaagactatgtattctactgtttttggaagagtgttttataaatttatgttaatgccaatttggtttttgtgttgttgaaatcttatatttccttgttgatgttctgcctagctgctctcttcattattgaaagtggggtattgacatctgcaactattactgttgaactgtttatttacagctcaatacagaaatgttattcctacatagctgtttttcttccttttctcactagtgatattagtcttacacttacatctatatatgtcacaagcccaatgatatattgttacaattattacttttaaatgttatagcttttaaagaagttgatagaagaaaggacaacaaaaatatacagtcagacttagtagctcttttttttttttatttttgagatggagtctcactctgccacccaggctggagtgcagtggcatgatctcggctcactgtaagctctgcctcccaggttcatgccattctcctgcctcagcctcccaagtagctgcgactacaagcacctgccaccacgcctggctaatttttttgtattttttttagtagagacagggtttcaccgtgttagccaggatggtctcgatctcctgacctcgtgatctgcccgcctcagcctcccaaagtgctgggattataggcatgagccaccacgcccggcccaaagcagctcttttaaatatgttcaaagaaataaaggaagtcatacttaaggaggtaaagtaaggccataaatggatgaattgataaagaaaacgtggtatatatacaaaatggaatactatacagcagcggtccccaacctttttgtcaccaggaactggtttcatggaagacaatttttccatggacagcagtcggggtggggatggttttgggatgaaactgttccacctcagatcatcaggcattagttagattctcacaaggagtgtgcaacctagatcccttgcatgcgcagttcacaatagggtgcacgcttttatgagaatctaatgccactgctgatctgacaagaggtggagctcaggcagtaatgctcactcacccaccgctcacctcctgctgtgcggctaggactggtaccagtctgtggtaacaggctatgggcccgtacaggtctgcggcccaagggttgggaactcctactatacggcctttaaaaagaaaaaaattctgtcattcatggcaacctgggtggaattggaggacatcatgctaaatgaaataagccaggcaaagaaagacaaatactgtatgatcttacttataagtggaatctaaacaagctgactttatagaaacagagagtagaatggtgggaggaggaaggatggagaaaggggagatgttgatcagagtccaaagttttagttagactggagaaataagttttggtgatttattacattgcatggtgaccacagttaataataatctactgtataattcaaaattgctaaaagaataaaattttaatgatatcatgcaaaaaataagttgataagttgattgatatgttattagcttaattaaacctgtctgccatacatacatcaaatctgtctacatacatagaccaaaacatcacattatactccataaatatacataattattatttgtcaactaaaaaaagaaagaaaaaagtaaaagaaggcctaataacaatgtctcatcaaatagagactaataataaggaaataataagctgctctaaaagacagtttcttttgtttgctttattttcctatggatgggctgcattttcctggctttttgagggttaaatttttgttgttgaaaaccagaaattttaaataatatattgtagcatctctaaatactgatcctccccatcttggggcttgttatggttggcttatttccttatttatttgtctggattgtttctatgatgtctgtttcccttgcggtatatagcctccgatgttgctcctcagggtatgcacatagttaccccgatcccttcccatgggcatttacacagtcattctagcccctcccgctaggatgcaatggatttagccaggctctctttgactgtctctctctgatctccctgttaagtgtctggctggtctgtccctactggtatcaaatccaactattagcctctattaattgctagctgactgttctatttattttgataatcaactgtgggttaccttgcttcacagtctgatccaattacatttgatccctttgcaggggtactacttcccaacccaagcgttgttgaggtacgattgacaaataaaaattatatatacttaaggaatataacatgatgttttgatacacacatacattatagaatgattgccacaattaagctaactaacatatccatcacctctcaactagttactgttgtatgtgtgtgttaagaacacatgagatctattcacagcaagtttcaagtatacagtatattaactgtagttaccatgctgtacattagatctcccaaacttattcaccttgtaactgaaaatttgcaccccttgtccaacgtctcccttcttcccctactcccctcacccccagcccctcatcaccaccattctactctctgtcaaactcacagaaggggtagttttgaggcaagtttttgaggcttgctctgatcccagaagggctcttgttagctgctgctgtccatggttctctattcaacttctaactggtctattgtttccatttttgttttcgtgatgtttcctcttaattgtgaagcagtggctttttgaaagctcgttggctgtatgtgccaaaatttccacttgtgggaatccatcttaaggatataatgcaaaatgtgataaaagttttacgtaaaaaaattttccatgttgttttatacaataaaaattttacattttttatacagaaatggtaaaaagtagaataatccatttaatatattattttgcaactatgcaaaagaacacaaaaatctggccaggaaaagaaaaggccagaaggaaatgtgacaaaatgtctatagtgggagaaagtaccttattctagttttaggttctgaaatccattgtagcctaaggtgatgactacatttttaaaaatcctttgcttccttcaaaaattatatgagattctccaaagcacttctcatattatgcctaaggaaatcacccataacataagcattcattaaaagatgctaaaggaagaatatttggaattcatgttctcaaaattccttgagaagagttagttaatagatatggtattaatttagagatagaaaatcaagaccagggtatattatatagtgtgaattatatatcaacaaatatatctcagtaaatgtatttaaaaaaaaagaaaagcaaagaaaactaagactgaacaaaaggtccagatagtgctttaaactatttttataggagaatgaaggtggcaatatagatatttttgaccctaacttctcttttcttatttaaaattacctgaatgatctcagggatggaaggctggttcaatattcaaaaacaattaatgtgatctatcatattaataggctaaataagaaaaatcattggatcttataattagatgctgaaaaagcatttgacaaaattcaatatcaatctatgataaaacctcttagaaatatgggaatagaggggaaatccctctacttgataaagaacaactgcaaaatactacagataacactagtggtgaaacactgaatgctttctgcctaatattgggaagaaggtaagatgtccactttcaccattcttaactgacaccgtgcttaagtacgaaacagtgcaagaaggcaagaaaaggcaaacagatcagaaaataataaaactgttcttattttcagatatagtggttgtttacctagaaaaccccatggaatctgcaggaaaactcctagaactagtaagtggatttggcaagttcataggacacaagataaacattcaaaaattaaaattgttggctgggcacggtggctcatgcctgtaatcccagcactttgggaggctgaggcaggcagataacttgaggtcaggagttcgagaccagcctgggaaatatggtgaaaccccgtctctactaaatacacaaaaattagctgggtgtgttggcacatgcctgtaatcccagctactcgggaggttgaggcaggagaatcacttcaacctgggaggtggaggttgcagtgagccaagatagtgccactgtactccagcctgggggacagagcaaggctctgtctcaaaaaaaattaaaattattggctgggcatgctggctaacgcctgtaatcccagcattttgggaggctggggcaggaggattgcttaaggccagaagttcgagaccagcctgggcaacatagcaagaccccatctctacaaaaatcaaaatattagccaggcatggtgacacatgtctgtagtgccacctagctacttgggaggctgaggtgaaagaattacttgagcccaggggttcaagactgcagtaatctgtgtgccactgcactccagcctgggtgacagagtgagacccaatctctaaaaccaaaccaaaagaaaacaaaaaacaaaaatcaattgtacttctacatactagcaaggaacacgttgacaatgacattaacactaaaataccacttacaatagctcaaaaaaagaatacttctttttattttgtaggtggaaatccaaacatgtacagaacttgcatgctgaaaactacacagttaacaaaagaaatcaaggaaaatctaaataagacataccacgttcatgaattggaggccttagcatagtaaagatgttaattctccccaagttaatgcaattttaatgcaattcctatcaaaattcaagcaggatttttgaagatataaaaagattattctaaaatttatgtgaaaaatcaaagagattagaatacctaaaacaattttgaaaaaaaaagaataaagcagatgaacctaaattaaagacttaatatataactacagtaaacaaaattctgtggtattgggggaaagacagatacataggtaaatgtaaaagaatagaaaaccaagaaatagacccacacaaatatacccaattgatttttcacaagggtacaaaatcaattcaatggcagaaagatagctttttaaacaaatggtacagaagaaggtggatactcataggccaaaaaaaaaaaaaaaaaaaaaaaaaagaacctctatgtcaacctcacactttacgcagaattaactcaaaatgggtcacggaattaaatgtgaaaaataaaactataaaacatttagaataagaagtaggaaaatctttgagatttagagctatagcaaataatttttagacttaaagccaaaagcacaatccataaaaggaaaatttataaatgcgacttcatcaaaattgaaaactttttaattgagaaagaccctgttaagagaataaaaaccacaagccacatacttagtgaaagaaaatatttgcaaaccacatgtctgataaagcaggagtccctaacccctgggccacagactgctaccagtctgtggtctgttaggaaccaggccacacagcaggaggtgaatggcaggtgagcccgcaaagcttcatctgtatttacaactgctccccattactcgcattactgtctgaactccacctcctgtcagatctgcagcagcattagattctcataggagtggaaccctattgtgttccacaggcaagggatctcagttgtgcactctttaaaggaatctaatgcctgatgatctgaggtggagctgaggcactgatcttagctctggggagctgctgcaaatatagattaacattagcagagaggtttgactgcacagagaccttaataaatcaattgcttgcagactcatatcaaaaccctattgctgagtggcaagtgaaaattaagttgcatctggtagtaggctttatagtggcaagtgagttgatgtgcttcaattgtacagttgcatctagtggcaggctttaagtcagaatctgacacttattttagtctgcatgtggcctgcccatttttttatttaccacttccatccgtgtctctttcctgcactgagtacttgtctcagtcatagttttggtaaacccacaagctaaccatagccaaaatgagtaaaaaacaaacatcactagagagctcctttgaaaagggcaaaagacccaatgatgagacagcagaagaatctaagactatcaacaaaaggaacgctgcatttaaaagaaaataccaagtcccacttaaattacgggttcattgcaacaggtagattcacattctccaagtctactttgtataatatgtagtgaccggctatccagtgaaaccatgaaaccttcaaaactgctttgccacttggagaccaagcaccctgtattaaaagacaagactttggagtttctcaaaagaaaaaaaatgtgaacacaaagaacagaagcaattattaaaggccaccacttcatcaaatgtgtctccactgagagcatcattcttagtggctaaacacattgctaatgctaagaagccctttgctattggtggagagttgatcctgcctactgataaggataatgtcataaaattttaggagaggctgaagttcaaaaggtggcacatgttcctcttttggctagcaccaataactagatgaattgatgaaataacagaggatattgtgagacaattgttagagaggattaatgagtcaccgtggtatgcaatccaggttgacgagtctacggatgttgacggcaaggcaacaatgcttgtttctgtgtgatatatttttcaggagcatgtgcatgaagacatgttatgtgcgcttttgttgccaaccaacatcacagttgcagactactcaagtctttgaatgactacacatcaggaaaactgaattggtcattttgtgtcagtatatgagcagatggcagtggttgccatggctggatagctttctgatttcattacttgggtcaaagaggtcgcttctgaatgtgagtctacacactgtgtcatctatagagaaatgctggctatccaaaaaatgtcacctgaacttaacaacgttttgcaggatgtgattaaaattatcagccacattaaagtacatgcccttaactcatgtctgttcgcatagctctgtgaagagatggatgcagagcaaacacgtcttctcttatatacagaagtgagatgactttctaaaggtgtatcactggccagagtttttgagttatgagagcaacttcagagatttctttcagaaaatgtcaccactggaagcacattttagtgacagagaatgggtctcaaaacttgcttacttgtatgacctatacagcctgctcaacaaactctatctgtcacttcaggggagaatgacaactgtgttcaagttggcagataaagtggctacattcaaaactaaactgctgtaatcccagcactgggaggctgaggtgggcagatcacttgaggtcaggagttcaagaccagcctggccaacatggtgaaatgctgtcttactaaaaatacaaaaatcagccaggtgtggtggtgggcacctgtaatcccagctacttgggaggctgaggcaggagaattgtttgaacccgggaggcggaggctgcagtgagccaagatcacgccactgcactccagcctgggtgacagagcgaaacgaaacaaaacaaacaaaaaaagccaaactggaattatgggggcaacgagtgaacactgggatttttgacatttttcaaacattaacagagattttgaaggagggtgagccagggccttctttctcccagttggtgtatgatcacctagctcagctttcaaaagagtttgagcattacttcccaatcacaaaagacccctgaacttggaaggaatggatctgcaacccatttgtgaatatgctaggtgaattgactttatccatgctagaagaggatcaactgcttgagagtgcaaatgatggtggctttaaaagtatgtttgagacaacttcaaatctccatacattctggattaaagtcgaggagttcaagaccagcctggccaacatggtgaaatactgtcttactaaaaatacaaaaatcagccaggtgtggtggcgggcacctgtaatcccagctactcgggaggctgaggcaggagaatcgcttgaaccagggagtcggaggttgcagtgagccgagatcatgccactgcactccagcctggcgacagagtgagactccatctcaaaaataaaaaaaataaaggttcaatagggtttggtaataacagaactttaaacatgaccaaaattttccactatttcaaatacactatgcatcttctatacatacccctttaaaattcgggctctatctctccagccacttcctcccatgcatgctacactagccattacaaagtacttattattcactccatacccttgtctgtgttgtttttccttctgaatgggatgcctcattcctttagagctcctgagtatctccttgtgtactcctccctgatattcctgggctgaatagaaatttcctctataaagcttttagtgtctcttattaatatatcattcattacaaattatttgtatgtcaatgggaagtccctgaggacaggaacctatatcttttgaatattatactccctgtggcaagtagaatgtcaggcacaaagtagatacaatcaactgagttacagttaaaagaacccggccaattagtaaataaatttagcttaaaagaatatcattaaagttacaatttagctaaataaacctcaacctcatggttctttgctgatcgctatgtcaatgtgttttatgattctgctggctaaaagtaaatgcaaattacatgctcaaaggaagagtttctgttacagtcttaagttgtctggaatacagctgtcataaactaacctcttggattttaaaaataaaatctaagttcaaagacatggattcatgtaatattacataaaaaagaacttacttttccaaaattatactaactttacagtaatagcaattttaaagatttttaaaatatattacataccatttctatttcttgatctttagcaaccagctgtcgattaagaagttctttgcttgagtcaagtttaatacagagttccctagtagaagacaaatctgcaagagcggacactttttcaaactgaaccttctgaagctcctcttccatttttacaacagatttatgtaaggtagaaatctgggacttgtaagacctttctgcatttaagtgctgtaagaataaaattatatatatgtatgtatacatatatattaaactggaaggaaactataacatggaaaaatgaagtggggcaaatctaagagtagtgcacttagattgtatgaagtttaaataatacaggtggtaacaatatgtacaaaacagtctaagataaattcaggttttgactttttttttttttacataaaattcatgagcaggatggtcaactggtcattctttttaatgtacttaggaaaaaaaaacctttcccacttaaaagtctccagccccaaaactagttgagatatatcatttgaccaacagttttacctatattagccagtttcaattattttataatacaaatgctattgttgttgttaaaaacaaaaatgctagccactgttttattcacaacatctgtttttgaattcttgactggcatgtcaatttcaatcataatgtcataaaatgaaaactgataactctttaacacttactaatacctctgagggaaagagactaagggcaagtataaattaagtatatatccacattataggaaataagagtgtgtttttaaaactatgagattcaagttacataaatgctttcgaatgttcaagataattccacccccacccttttctttcagaaaaatgtcttatgtaagtgcactgccacctacagagaagtatttgtttgctataatgtgaagacaagtagaactgagaggcaaataaatttatgtgtttttacaagtgattttacaagtgtaaagcactagaatttgctcccattataagttatttggccataattcactcctactttctctctatctcttcccttccttcctcactcactctttcttattctccaagccaactttttatccatccttccatccacccacccattcatcacatatatattgaatatactctatgttccagtcactgtggctaggtacatattcgatggtatgtggtatctgctctaatgaaacatccagactactagagaagtcatatattaatcaaataatgatacaaataactatataaatacatacaaagaaaatataattaataccctaagagaaaaaacaaaatggaattatataacatgctcgattaaaaccagaaaaggcagaagagcagctgaagactaaacaaacaaatgaacggggcaataaattaaagatacttataaatatgggaaatattaatccaactataattactttaactgtgactaatctatataccccaattaagacaaatggtcagagtggataagaaaacaagatctacttatttagctacgataaattaatattaatattcaaatgttaatgctaataaaaggaaagttggggtagctacattaatttcagacaaagcaaatttcagagaaaggaaaattatcagtaataaagagagggcatgacataatgattgtaaaaagttaattttcaaagaagacataacaatccttaatgtgcacattcctaacaacagagcatgccaacatacgtaagccaaaaaaattgataggatggcaaggagagatacccatatctactattctagattactattatagattattattggagaatgcaacacccatgtatcagtaactgacagatcaagcaggcagaaagtcagcaaggatacaattcaactgaacagcgttatcaatcaattggatctagatatttacagagtactttatccaaaaacagcagaatacacattcttttcaagctcacatgcaacattcactaagacagactacgtatgccctataaaacacatctaaacaaacttaaaagagcaaaaatcatacaaagtatactctcagatcacaatggagttgaactagaaatacattaacagaaggatagttggaaaatcccaaaatatttagaaatttaacaacatacttctaaataacacataggtcaaagaagaaatcacaaaaaaaatttagaatattttgaatgaaacaaaaattaaaatataacttaccaaaatttgtggcatgtagttaaagcagtacttacaagaaatttatagcactgagtgcatatattagaaaagaaggaatatctaaaatcaataacctggccgggtgtggtggctcacgtctgtaatcctagcactttgggaggccgaggcaggtggatcgcctgaggccaggagttcgagaccagcctggccaacataatgaaaccctgtctctactaaaaatacaaaaaattagctgggtgtggtggtgggtgcctgtaatcccagctactctggagcctgaggcagaagaatcatgtgaattcaggaggcagaggttgcagtgagctgggatcgcgccattgcactgcccctggtcaacaagagcgaaactccatctcaaaaataaataaataaataaataaacacaaaagaaagaatcttaagatctgtgaggcaaaagcatccagtaacctataaagaaaaacctatcagattaatagcagatttcttagcagaaaccatacaagctagaagggattggggtcctatcttttacctccttaaacaaaacaattatcagccaagattttgtctccagtgaaactaagcttcaaaaatgaaaaaaaaaaaagttttttttcagacaaatgctgagagaagttgccactaccatgtcagcactatgagaactgctgacaggagttctaaatcttgagacaaaaccttgaaatacaccaaaatagaatctctttaaagtataactctcacaaggcctataaaacaataacacaattaaagaaaaacaaagtattcaggcaacaagtagcataatgaataatagtacctcacatctcaatactaacattgaatgtaaatggtctaaatgctctacctaaaagacacagaatggcagaattgataagaatacactaaataagtatctgatgtcttcaagagactcacctaacacataaggactcatacaaacttaagtaaaggggtggaaaaacatattccatacaaaatgaaaaccaaaagcgagcaggagtagctattcttatatcagacaaagcaaactttaaagcaacaacagttaaaaaagacaaagagggacattatataatgataaaaggaagagtctaacaggaaaatctcacagttctaaatatttatgcatctaacattggagctcccaaatttataagcaattactactagacctaaaaaatgagatagatggcaacacaataatagtgggggacttcaatagacaggtcattaagacagaaagtttaaaaagaaacaatggacttaaactataccctagaacaaatgcacttcacagatatttacagaacattctaccgaacaattgcaggacatacattctattcatcagcacaaggaacattctccaaaacagaccatatgataggccataaaacaagtctcaataaatttttaaaaatcaaatttatatcaagtatcttctcaaaccacaatggaataaaactggaaattacctccaataggaaccctcaaaactataaaaatatatggacattaaataatctgctcttgaatgatctctggttcaacaatgaaatcgagatggaaattaaaaaattatttgagctgaacaataatagtgccacaacttatcaaaacctctgggatacagcaaaagtggtactaagaggaaagttcatactattaaatgcctaaatcaaaaagtctgaaagagcacaatctaaggtcacacctcaaggaactagagaaacaagaacaaaccaaactcaaaccccgcagaagaaaagaaataacaaagatcagagcagaattaaaatggaaacaaccaaaaaaaaaaaaaccactacaaaagataaaagaaacaaaaagctggttgagaagataaacaaagctgatagactattagtgagattaaccaagaaaagagcagagaagatccaaataagtccagttagaaacgaaatgggagctattacaaccaataccacggaaatacaaaagatcattcaaggctactatgaacattgttacatgcataaactagaaaacctagaggaaatggataaattcctggaaatatacaacccttctagattacaagcagcaagattcaaatggtaaaaaacaaaaaaaacaagaaacaaaaacaaaaaactgcctgccaatgaagaaaagtccaggaccagatgaattcacagctgaattctgtcattcaaagaactggtaccaatcctactgaaattattccacaaggcagagaaagagagaatgctccctaaatcattctatgaagccaatatcacactaataccaaaactaggaaaggacataacaaaaaaagaaaactacagaccaatatccctgatgaacatagctgcaaaaatcctcaataaaatactagctagccgaatccaacagcataacaaaaagataatacatcatgatcaaatgggtttcatatcagggatgcagggatggtttaacgtaagtaagtcaataaatatgatagaccacataaacagaattaaaaacaaaaatcacatgatcatctccatagatgcagacaaaacatatgacaaactccagtattcctttatcattaaaaccctcagcaaaatcagcatagaagggacataccctaaggtaataaaagccatctatgacaaacccacagacaatattaccgaatggggaaaagttgaaagcattccccctaagaactagaacaagacaagaatgcccactttcactacttctattcaacatagtactggaagtcttagccagagcaatcagacaacagaaagaaataaaaggcacccaaattggtaaagaggaagtcaattgtcactgttcgccaattataggatcatatacctagaaaactctaaagattcatccaaaagctcccagatctgataaatgaattcagtatacaaaatcaatgtacataaatcatcactgctatacaccaacagtgaccaagttgagaatcaaatcaagaactcaactccttttacaatagcaaaaacaaaaaacaaaaaacaaaaaaacacaacttaggaatatacctaaccaaggaggtgaaagagctctacaaggaaaactacaaaacactgctgaaagaaatcatttatgacacaaacaaatggaaatacatcccatgctcatggatgggtagaatcaatattgtaaaaatgagcatactgccaaaaacaatatacaaattcaaggcaattcctatcaaaataccatcatcattcttcatagaaccagaaaaaaaaaaacctaaacatcctaaaattcgtatatgactaaaaaagagccagcatactgtagaaagtagaaaagttaatcttcaaagttcgtcttgatttaaaaataaaataatagacactaggaataacagttccttactctaaagcctcctatcaactattagttcttacactttagcccagttagttgctttggcttactcaggcatgtctggacaggcccaggcaagtcttagctcatagcttatgccccttccttatttggaaatgttattgtttccttaaacctttcataagcaacttcctcttctttgttctctcttgcacttacctatttaggaaagttttaggttattagcaaattgggtatcagtttaagattgtgaggtccagctccagccaatggatgcaggacactgcagtaaggatgacccaaatgcataagagataaacatgtctgcttttcctttgctcaagtgtgctctcaccattgttccatctgcaatgggcaccctttctgcagaaagtaaaaatggccttgctgagggaattaaatttatgttcaagtgctatttctttgcgacaccagggaacaagcatttctaacaatacccaaagcaagactaagcaaaaagaacaaatctggaggcatcacttacccaacttcaaactatactacaaggctatgttaccaaaatagcatggtactggtataaaaataggcacatagaccaatggaacagaatagagaacacagaaataaagccaaaacgtacagccaagtgatcttcgagagagcaaacaaaaacataaagtggggaaagaacaccttattcaacaaaatggtgctgagataattggcaagctatatgtagaagaatgaaactggatcctcacctctcaccttatacaaaaatcaactcaaaatgatcaaagacttaaatctaagacctaaaaccataaaaattctagaacatcggaaaaacccttctagacattggcttaggcaaacccttcattaccaagaacacaaaagcaaatgcaacacaaagataaatagatgcgacttaattaaactaaaaaacttctgcacagcaaaagaaataatcatcagagtaaacagacagcccccagagtgggagaaaatctttgcaaatgacgcatccaataaaataataatatccagaatgtacaaggaactcaaacaaatcagcaagaaagaaacaaacaatctgatcaaaaagtgggctatgcacatgaatagacaattgcccccccacattttttttttttttttttttgagacagggtcttactctgttgcccaggctggagtgcagtggtactgtctcggctcactgcaacctctctggttgaaaatgacatttttatagataaacacaaacattttgaaggtttgagtcactcgctttgtgaggcttggccagtgttatattgttctcttcacagcctttgtgagccaagacaggtctttgagttgagatgtgctggggcgcaggtcttatgtggtaccacattctagaacagaaatgactgggtgcattttgttggccctggggcatcctaaaagggcccctcagtagggaagaaagcgctgtagacgggacatggccagcccatccagcagagagggcccagcaggtagcacggagaaggctggtcagctgtctggggctctgaccagacgagatttccctcacctcagtcaggctgctctttggccactgtgtaacatggcttgaagctgggtactgcagtaactgtctctaccgtcaagcctaggagtggaacaggagcagatctcttacaacatttggggcatagctttctgaacttctgtctgtgctatactgactacacatacatacgtatatgtgcaaaagtgcatatttacctgaaagaggtactgtctgcattgttttgtgagctttttttttttttgagacggagtcttgcgttgtggcccaggctggagtgtagtggcgtgatctcagctcactgcaacctctgcttcccaggttcaagtgattctcctgcctcagcctctcaagtagctgggattacaggcatgcaccatcatgcccggctaattttttttagtagatacagggtttcaccatgttggccaggctggtctcaaactcctggcctcaggtgatcctcccgcctcagcctcccaaagtgctgggattacagggatgaggccaccatgcctggccccattctttattttgtaagattgaggagaacacattttcaagcaaccagatgtcataattaacaagcaaaacttcaaagtaggcattaaaaatatgttcaaggacctaatgatgcatggttaatgaagtaaaggaagatatgatgacaatgtctcatcaaataaagattataaaaaaatatataaatcatttttttaaaagaacaaaatggaatgtctgaaacttgaaattacaataattgaaatgaaaaggtttcccagagggtctcagcagtggattctgaactggcagaggaaacaattaatgaatttaaaaaagattgatgaagattatgcaatttgatgaagaaaaaaagcagaatgaagaaaaatgaacaaacctccgaaaaatataggacactattaagcacaccaacctacatataatgatagtagtagaaggagaggatatagaaaggaccagaagaaataattgaaaaaataatggctggaaacttcataaatttcaaggaaaattttcatcttcatatttagcatgctaaataagcaagtaggataaaagctaagagatctacaatcagacacatcattataaaaatgctgaaagcaaggaaaatatcttgaaagcagcaagggaaaaatggcttgtcaattgcacaggaactccaataatattaacaactggcttctaagcagaaacaatggaatccagaaagcagtgatctaacatattcaaagagctcaaaaaacaaaacaacccaaaataccaagaattcttgtcaaccaagaagcctacacccaggagaactacctttcagaatgaagggaaaatctctacagaaatgctacaagccagaagagagtgggagccaatattcaacattcttaaagaaaagaattctcaacccagaatttcatatccagccaaactaagcttcataagagaaggagaaataaaatccttcacagacaagcaaatgctgggacattttgttaccaccaggcctgccttacaagagctctgaaaaagcactaaaattggataggaaaaactggtaccagccactgcaaaaacataccaaattgtaaagaccatcaacactatgaagaaacttcaccaactaatgggcaaaataaccaggtagcatcataatgacaggatcgaattcacacataacaatattaaccttaaatgtaactgggctaaatgccccaattaaaagacacagactggcaaattggatagtcaagacccactggtgtgctgtattcaggagatccatctcacgtacgaaaacacacataggctcaaaataaagggatggaggaatatttaccaagcaaatggaaagcaaaaaaaaaaaaaaaaatcaggagttgcaattttaatctctgataaaacagactttaaaccaacaaagatcaaaagagacaaagaagggcataaaataatggtaaaaacatcaatgcaacaagaaaagctaactatcctaaatatatatgcacccaatacaggaacacccagattcataaaacaagttcttaaagacctatgagagacttagactcccacacaataatagtgggagattttaacaccccaatgtcaatattagacaaatcaatgagacagaaaattaacaaaggtattcaggacttgaactcagctctggaccaagcggaccaggcagacaacagaactctccactccaaatcaacagaatatacattcttctcagcacctcatcacacttattctaaaattgaccatataattggaagtaaaacactcctcagcaaatgcaaaataacagaaatcataataaacagtttctcagaccacagtgcaatcaaattagaactcaggattaagaaatccactcaaaaccgcacaactacatggaaactgaacaacctgctcctgaatgactactgggtacataacaaaatgaaggcagaaataaagatgttcttggaaaccaacaagaacaaagacagaacgtaacagaatctctgggacacatttaaagcagtgggtagagagaaatttatagcactaaatgcccacaaaagaaagcaagaaaaatctaaaatcgacaccctaacatcacaattaaaagaactagagaagcaagagcaaacaaattcaaaagctagcagaagacaagaaataactaagatcagagcagaactgaaggagacagagacacaaaaaacccttcaaaaaatcactgatgccacaaagatactcctcgagaagggcaactccaagacacataattgtcagattcaccaaaattgaaatgaaggaaaaaatgttaagggcagccagaaagaaaggtcgggttacccacaaagggaagcccatcagactaacagaggatctctcggcagaaactctacaaaccagaagacagcagggccaatattcaacattcttaaagaaaagaattttcaacgcagaatttcatatccagccaaaccaagcttcaaaagtgaaggagaaataaaatgctttaaagacaagcaaatgctgagagattttgtcaccaccaggcctgccctaaaagagctcctgaaggaagcactaaacatggaaaggaacaactggtaccagccactgcaaaaacatgacaaattgtaaagaccattgatgctaggaagaaactgcatcaactaacgagcaaaataaccagctaacatcataatgacaggatcaaattcacacatgacaatattaaccttaaatgtaaatgggctaaatgctccaattaaaagacacagactggcaaatttgatagagtcaagacccatcagtgtgctgtatgcaggagacccatctcatgtgcagagacatacataggctcaaaataaacggacggaggaggagcaaatggaaaacaaaaaatggcaggagttgcaatcctggtctctgataaaacagactttaaaccacaaagatcaaaagagacaaagaaggccattacataatggtaaagggatcaattcaacaagaagagccaactatcctaaatatatatgtacccaatacaggagcacccagatgaataaagcaagtccttagagatctacaaagagacttagactcccacataataataatgggagactttaacaccccactgtcaacattagacagatcagcgagacagaaagttaacaaggatacccaggaattgaactcagctctgcaccaagcagacctaatagacatctacagaacactccaccccaaatcaacagaatatacattcttctcagcaccacaccacacttattccaaaattgaccacatagttggaagtaaagcactccttagcaaatgtaaaagaacagaaattataacaaactgtctctcagaccacagtgcaatcaactaaaactcaggatgaagaagctcactcaaaaccactcaactacatggaaactgaacaacctgctcctgaatgactactgggtacataacgaaatgaaggcagaaataaagatgttctttgaaaccaatgagaacaaagacacaacatactagaatctctgggacacagctaaagcagtgtgtagagggaaatttatagcattaaatgcccacaagagaaagcaagaaagatctaaaattgacaaactaacatcacaattaaaagaactagagaagcaagagcaaacacattcaaaagctagcagaaggcaagaaataactaagaacagagaagaactgaaggatatagagacacaaaaaacccttcaaaaaatcaatgaatccaggacctggttttttgaaaagatcaacaaaactgatagaccactagcaagactaataaagaagaaaagagagaagaatcaaatagacgcaatacaaaatgaaaaaggggatatcaccactgatcccatagagatagaaactaccatcagagaatactataaacacctctacacaaataaacttgaaaatctagaagaaacggataaattcctggacacatacaccctcccaagactaaatcaggaagaagttgaatccctgaatagacaaataacaggctctgaaattgaggcaataattaatagcttaccaatcaaaaaaagtccaggaccagacggattcatagctgaattctacaagaggcacaaggaggagctggtacctttccttctgaaagtattccaatcaacagaaaaagagggaatcctccttaactcattttatgaggccagcatcatcctgataccaaagactggcagagatacaacaaaaaaaggataattttagaccaatatccctgatgaacctcaatgcaaaaatcctcaataaaatactggcaaaccgaatccagcagtacgtcagaaagcttatccaccatgatcaagcgggcttcatccctgggatgcaaggctggttcaacatatgcaaatcaataaatgtaatccatcacataaacagaaccaaagacaaaaaccacatgattatctcaatagatgcagaaaaggcctttgacaaaattcaacagctcttcatgctaaaaactctcaataaactaggtattgatgggatgtatctcaaaataataagagctatttatgacaaacccacagccaatatcataatgaatgtgcaaaaactggaagcattccctttgaagactggcacaagagggggatgccctctctcaccactcctattcaactgttggaagttctggccagggcaatcaggcaggagaaagaaataaagggcattcaattaggaaaagaggaagtcaaattgtccctgtttgaagatggcatgattgtatatttagaaaaccccattgtctcagcccaaaatctccttaagctgataagcaacttcagcaaagtctcaggatagaaaatcaatgtgcaaaaatcacaagaattcttatacaccaataatagacaaactgagggctaaatcatgagtgaactcccattcacaattgcttcaaagagaataaaatacctaggaatccagcttacaggggacatgaaggacctcttcaaggagaactacaaaccactgctcaagacaataacagaggacacaaacaaatggaagaacattccatgctcatggataggaagaatcaatatcgtgaaaatggccatactgcccaaagggatttatagattcaatgctatccccatcaagctaccattgactttcttcacagaatcagaaaaaagctactttaaacttcatatagaaccaaaaaagagcccatacagccaagacaatcctaaggaaaaagaacaaagctggagggatcatgctactggacttcaaactataccacaaggctacagtaaccaaaacagcatggtactggtaccaaaacatatatatatacacacacaccaatggaacagaacagaggcctcagaaataacaccacacatctacaactatctgctctttgacaaacctgacaaaaacaagaaatggggaaaggattccctatttcataaatggtgttggaaaaactggctagccatatgcagaaaactgaaactggaccccttccttacaccttatacaaaaattaactcaagatggattaaagacttaaacgtaagatctaaagccataaaaatcctagaagaaaacctaggcaataccattcaggacacaggcatgggcaaggacttcatgactaaaacaccaaaagcaatggcaacaaaagccaaaattgacaaatgggatctaattaaactaaagagctctgcacagcaaaagaaactgtcatcagtatgaacaggcaacctaaagaatgggggaaaatttttgcaatctattcatctgacaaagggctaatatccagagtctacaaagaacttaaacaaatttagaagaaaaaaaacagacgaccccaccaaaaagtgggcaaaggatatgaacaggcacttctcaaaagaagacacttatgcagccaacaaacatgaaaaaaagctcatcatcactggtcattagagaaatgcaaatcaaattcacgatgagataccctctcacactagctagaatggtgatcattaaaatgtcaggaaacaacagatgctggagaggatgtggagaaataagaatgcttttacactgttggtgggagtgtaaattagtttaaccattgtggaagacagtgtggtgattcctcaaggatttagaactacaaataccatttgacccagcaatcccattaatgggtatataccaaaaggattacaaatcatgctactataaaggcacatgtgcacgtatgtttactgcagcactattcacaatagcaaagacttggaaccaactcaaatgtccatcaatgacagaccggataaagaaaatgtggcacatatacgctatggaatactatgcagccataaaaaaggatgagttcatgttctttacagggacatggatgaagctgaaaactatcattctcagcaaactaacacaagaacagaaaaccaaacaccgcatgttctcactcataagtgggagttcaacaatgagaacaccgggacacagggaggggaacatcacacaccggggcctgtcagggggtgggaggctacgggagggatggcattaggagaaatacctaatgtaggtgacaggttgataagtgcagcaaaccaccatgacatgtgtacacctatgtaacaaagctgcacattctgcacatataccccagaacttaaagtataatttaaaaaaaagaaaaaaaaaaagaaaaatacattcctagagaaacaaaaagtgagagcatgccttgttggcagatccaccatataagaaacactaaaggaagttcttcaaactgaaaataactgatcacagatggtaattcaaaaccacacacaaaaagcaaagaacaacaataaaaataattatgtaattataaaagacagtatagctgcatctcttttccatctgaactgattttaaaatcaattatataatattacataagatgatacaaatataattgtactattggtcctataacagatgaaatacaatatatttaccaataaatgcacaaagaacgtgggtgggagcaaagctttattggactaaggaaatgaaaagagacaaactcaaagccaaagtaacaatgaagacacccagaaatgggagggcgagggaaggctaacataacaaaaatctataaatatatagttgccctcatttttcctctcaggtttttaaaaagacacacaattgtataaagttataatagcaacaatgcattgttttgtagtatacagaaaatccaaaatactccaaaatccgaaacttcttgagcactgacatgacattcaaaggaaatgctcgttaaaacatttcagatttcagattttcatatgtattttgaaaagcgcaactagtaagtaaaattcaaatattccataatcagaaaaaaatccaaaatctgaaatatttctggtcccaagcattctggataagggattctcaacctgcaatatgtataacagtaatagaaaaaaatggaggaaaagggaatagaactatgtaacagtaacagttccatatatcatcagaattaagttagtataaacctgaagtagattctggtaagttagatgcatgtagcaaacaccaataattcacaaaatgcagggatgaaaatcacaaaaaaattttttaatgttttattagataatatacacttaatgcaaaaggaaacagtaaaggaggaatagaggaacaaaaaggcataagtcatataggaaaaagtaaaatggcagatataaatccaactacagtcatgtgacacataataatgttttggtcaatgatggaccagcacacatgatggtgggcccataagattataatatcatatttttactgtgccttttctatatttagatatgtttatatacacaaatactattgtattactattgcctatgtattcagtacagtaacatgctgtacaggtttatagcctaggcacaacaggctattccatatagcctaggtgttaggagattaaaccatctaggtttccagaagtacactctatgatgttcacacaaagaaactgccgaatggcacatttctcagaatatattttcatcattaagagacacatgactgtatatcaataatattaaatgtaaactgataaagcaatttaatcacaaaaactgaaaaactaagtaaataagcaaggttcaactatatgctgtctgtaagggacacactttagtttcaaagtcaaatagaatgaaactaaaaagataaaaaatatatcatgcaaagagcaacataagaaagctgaagtggttatgataatatcagagaaaacagactttttaaaaatgttactagagataaaggaggacattttacagtggtaaagggtcaaggccatcagaaatgcgtaagaatatacgtatatatgaactcagtaacaaagcactaagtaaatgaaccaaaaagtgacagaaatgaagggaaaatgataaaattcaatgctcatattcagacttcaatacagcacttacaataatgttaccacaataaggcagaagataacaggtaaatagaagacttaaacaacattataaaccaatcaggcctagaagacatctatagatcatttcatcaaacaaagtagaatacatatttttttcaagtgcacatgaaacattctctagaatagacactacactgggcaatacaacaaaatcaagaaatttttttaagctgtaaaaatataaagtatgttttccaaccataataataaaattaaattagaaatgaataacagaaaaaaaggggaaactaacaaatatgtggaaataaaaaatatagtccaaaataaccaatgggacaaagaagaaatcaaaaggaaaattggaaaatactttgagattacttaaaatgaacatacaacatacctgaacttatgagctgccgctaaagcagtgcttagaagaaaattgatgcaggtaagtacctatctttaaaaagaaaaaaaatctcaaatcaacaacctaacttcttaagacactaaaaaagaaaggcaaacaaaatctaaagcaagcagaaggaagaagaaataaaaatataaaggattggagcaaaaattataataataaagactagaaaaaatagtagaaaatatcaatgaaactaagagttgatttctgaaaagataaacaaaactgagaaaactttagccaaactaagaaaaaaagaagtctcaaatatacaattataaatgaaagaagagacacaacaagaaatacaaagaatcataagtgactactgtgaacaattatatgccaacaaattggataacctagaggaaaagaataattcctagaaatatacaacctacaaagattgaatcatgaaaaaaaatttttttaaagcctgaagagaccaaagcaagtaaggagattaaatcagcaataaaaataaatctgtcccagaactttgggaggcctaggagggcggatcacgaggtcaggagattgagaccatcctggctaacacggtgaaaccccgtctctactaaaaatacaaaaaattagccgggcgtggtggcaggcgcctgtagtcccagctacttgggaggctgaggcagaagaatggcgtgaacccaggaggcggagcttgcagtgagccaagatcgcgccactgcactccagcctgggtgacagagcgagactccatctcaatttaaaaaaaaaaattaaaataaataaataaataaataaataaatcttgccaggtgcagtggctcatgcctataaccccagcactttggaaggctgaggcaggtggatcacctgagctcaggagttcaggactagcctgggcaacatgcccatctctaccaaaaacacaaaaattagctgagcatagtagcgtgcacttgtagtctcagctacttgggaggctgaggtaggggaatagtttgagcccgagagacagatattgcagtgagccttgatggcaccactgcactccagcctgagggacagaagcagaccctgtctcaaagattaaataaataaatagtgtattcctgatagttaagatttaaaaaaaaaatcttacatcaaaaaaaagctcaagaccagatggcttcatgggtgaattctactaagcatttaaagaactaccaccaatcctcaaattcttccaaaaaattgaaaagaagggaagacttccaaattcattttagtggtcagcattatcatgataccagagcaagacaatgttttctacaaattttctacaagggaactacatgccaatattcttcctaaatacaaattcaaaaatttccaaaaaaaaaaaaaatactagcaaacaaaattggataacatgttaaaaggatcatacaccataatcaagtagcatttatccctgagatgcaaggatggttcaacatatacaaatcaatccatgtgaaaggccacgttaacagaatgaaggataaaagtcgtatgataatctcaacacatgtagaaaatgcatttgaccaacttcaacgtcctttcataataaacataaaaaagctctaaagaaactaggtatagaaggtatgtacctcaacacaataaaggctatatatgacaagcccacagttaacatcatactcagtggtgaaaagctccaacaaaaaatggttagaagtaataaattcagtaaattttaggatacaaaatcaacatacaaagatcagtagcatttctatacactgacagaatggaaatcaataaaatcaataaaacaatcccatttataatagcataagaaaaaagatgctatatgttcaccgaaaactataaaacactgatgaaagaaattgaagaagacacaaataaatggaaagatattccatgtttacagatcagaagaattaataatgttaatgttcatactacccaaagcaatctacagattcagtgtaatccctatcaaaattccaagagcatttttacagaaatagaaaaaaaatcctaaaattcatatggaaccacaatacaccctttagacaaagtaatcttgagcaaaaagaacaaagttggaggcatcacactacctgatttcaaaatactacaaaacaacagtaatcaaaacagaatggtagtgccataaaaagcagacatagagaccaatggaacagaatagacagcccagaaataaatccattcatttacagtcaattgacctttgacaaaggtgtcaagaagatgcagtggagaaaggacgatctctgcaaatgataatgggaacactgcctatggagaagaatgagattggacccttatttcaacatatacaaaaatcaactcttaatggattaaagacttaaatataagacctgaaacggtaaaactgctagaagaaaatggagaggaaatgcttcttgacattgaccagggtagtgattgttttggatataattccaaaagcataggcttcaaaagagaaaatagagaaatggggttggatcaaagtaaaaaacttctgcataacaaagaaaagtgtgaagagaaaatctacaaaatgggaaaaaatttgtaaaccatacagctgataagggcttaatattcaaaatatacaaggaattcaataggaagaaaacaaataacccaatttaaaaatgggcaaagagcctgaatagacatttctcaaaagaagtcatacaactggccaacaggtatgttaaaaaacactcgacattggtaatcattagggcaacattgctaattattaaagaaatgcaaagtaaaaaccacctcacacctgttggaatggctattacaagaaagacgaaagataaatgttggtgaggatatggagaaaaggaaccccttcccttgtacaccattggtgggaatgtaaattagtatagccattatgggaaacagtataaaagtgtctttaaaaatttaaaacagaactactatataatccagcaatcccacttctggatatacatccaaaggaaatgaaatcagtatgtcaaaaagacatctgcattcccatgtgctctgaattatttacaatagccaagatatggaatcaacctaagtgtccatcagtggctgaatggatagcaaacttgtggtatatagatatacaatgaaatactattcagccttaaaaacaaagaaatcctgccatttgtgaccacatggatgaccctagaggttcattatgctaagtgagataagccaggcacagtaagacaaacactgatctcgtttatatgtggaatctaaaaaagttgagctcatagaagcagagagtagaatggtggttacctggagctgatagggcagggtgaggtgagagaaagcttcagttagacagaaagaataagttttggggacaatagttaataataatgtactgtatgtttgaaaattactaagagggtagatcttaaatgttctcaccacaaaaaaaaaaatggcaagcatatgaggtgctggatatgttaattagcttgatttaatcatttcacaatttatacatatattaaaatatcacattgtacactgtaaacaatacaattttttatttggtagattataccttaataaaactggtgggggaataaagccaggcagagttcctactgccagaaagagagagggagagagagagaaagaaagaaattaacaaaacagccaggcagagtagctcacacctgtaattccaacactttggaaggctgaggtgggaagatcttgagcccaggaggtcaaggctgcagtgagccgtgattgcaccactgcattccagcctgggcaacaaagcaagaccctgtatccaattaacaaaaaaaaaaaaaaaaaaaggaagaaaagaaattactgaaataaagaaaataacaatagtcggccaggcgcggtggctcacgcctgtaatcccagcactttgggaggctgaggagggtgaatcacgaggtcaggagatcgagatcatcctggctaatacggtgaaaccccgtctgtactaaaaatacaaaaaaaattagccaggcgtggtggtgggcacctgtagtcccaggtactcgcgaggctgaggcaggaatatagcgtgaacccgggaggcagcgcttgcagtgagccgagatcacgccactgcactccagcctgggtgacagagcaagacttcgtctcaaaaaaaaaaagaaaataacaatagtcaacacaaccaagtaaccaagttagtttctgaaaagatcaactaaattgacaagtctgtagctagattgatctagaaaaaaagactcaattaatagaatcagaaatgaaataatgtagtaacgcaatccttacatactgcattagtagtaatgtgaccttactgaaatgaaatagattataaaaatacactataaacaactgtatgccaataaattaaatatcttggatgaaatgaacaaattcctagaaaacacaaactagcaaaactgtctcatgaaaaatagactatctgtatagatctataacaacaaagaaattgattagcaattttaatactgcccataaagaggtaattttaaaacttcccataaaacttctctaccagatggctttactggtaaatttttaccaaacctttaaagaagaatcaatgcaaattccatacaaactgttttgaaatacagaagaggaggaaacattttctaactcattctatgaggccagtctcactctgatattaaaaacagacaacacattacaagaaaagaaaattacagacgctcctagaaatacacaaaatccttcaaaaaaaaaaaaaaaaaaactagaaagccaaatccagcaacataaaaaataattacataccatgaccaagtgggatttatctaaaaatgcaaagttggcttagcatatgaaagtcaattaatgtaatatactatatctataaaataaagaaaaactacatgataatctcaatagacacagaaaaagcatttgacaaaatccaacaccctttttgataaatacactcttcaaagtaacaataaaagggaatttcttcagtgtcataaaggttttctataaaaaaccaacagctaacatcatacttgatggtaaaagatgaaatgctttccccctaaaatcaggaacaagataaggatgccccttctggacccttctattcaacactgtactagaagttctagccagggtagttaggcaagaaaataaaataaaaggcatccagattggaaaggaaaaagtaaaaactatctctattcacagatgacatgatctttgatatagaaaatccaccagcccaggtgacagatatagaaaatcctaaggcattcactaaaaacttttagacttaataaataagttcagcaaggttgcaggatacaagatcgatatacaaaaatcattgtatttttatacacttgcgatggagaatctgaaaataaaaataagaaaacaattctatttacagttgcattcaaaataataaaatacttaagaataaaattaacacaagaagacctaacttatactctgaaaacaacaaaatattgttgaaagaaattaaagatctaataaacgaaactacaccttgtgttcatggatcagaaaacttaatattgttaagacagccatattccccaaattgatctaccagctcagcatagtctctatcagaatcccaggtggtttctttgtagaaattgacaagctgatcctaaaatttatatgaaaattcaaaagtctcagaatagccaaacaatcttgaaaaaatgaaaacaaagcaggaggactttcacttttccatttcaaaagctactacaaagcaatagtaattatgccagtgtggtactgatataaggatagacatacagatcaatgaaatagaattaagagtctagaagaagcccatgtgtctatgatctattgatttttgatagaggtgccaagaccattcaaatggtggggggaggggagaaatagtcttttcaacaaatgttactaagataactagatggacacatgcaaaagaatgaatttggacccttacttcataccatgtgaaaaaaaatgaactaaaaatgcatcaaagacctaatggagggtttggtggtgataaagggtacagtgattcttttcaaagtgatgaaaatgttctaaaattgattgtggtgatcattacacaactctacgaacatctaagcactattaaattgtatactttaagtggataaactatatggcatgttaattattctcaataaagctgttacaaaaaatagcaacacaaaaatatgtagaatacagctaaagcactgtgtaggggaaaatacataccttaaatgcttagaaaagaagaatgggctaaaaccaatgacctaagcacctacattaaaatacgaagagaaaaattaaacatatattatttagaaggaaagaaataataaagagaagaaatcaatgaaatagaaaactagttcattaatagagaaaaatcaattaaattaatactccttctttggaaagataaacataaatgataaacttctggctagactgatgaagagaatagagaaatgctacaaattaccaataacaagaatgcaaaaaggaatataactacaaagtaagaacaaatttgcctacaaatttgacaacttagatgaaataggcaaatcctagcgaaacagaaattaccaaaatgacctaagaaatcagaaatcctggctgggcatggtggctcacgcctgtaatcccagcactttgggaggttgaggtgggtgaattatgaggtcaggagttcgagaccagcctgaccaacatggtgaaaccctgtctctactaaaaatacaaaaaatttgctgggcatagtggtgggcacctgtaatcccagctactcaggaggctgaggcaggagaattgcttgacccaggagatggaggttgcagcaagctgagatcacaccagtgtgctccagtctgggcaacagagtgagactctgtctcaaaaaaaaaaaataatatatatatatatatatatttatatatttttatatatatatatatatgcaatctaataatgtatgtttaaaaatacatcatgaccttgcaccacgagtgcagcctgggtgacagagctagaccatgtctcaacaaaaaacaaaaccaccatgacctactatccaggaattattttttaaagcaatgtattagccagtttaacaaactaaaaaattaaagtgatatgaccatctcaatagctgcagaaaaagcatttgataaaattttatacccattcatgatacaaactctaagtaaacttaggccaggcatggtggctcatgcctgtaatcccagcactttcggaagccgacgtgggcagatcacctgaggtcaggagttcgagaccagtctggccaacatgtcaaaaccccatctctattaaaaatacaaaaaaaaattagccaggcatagtggcaggcacctgtaatcccagctactcgggaggctgaggcaggagaattgcttgaacctgggaggcggaagttgcagtgagccgagatcacgccactgcacaccagcctgggcgacagagcaagactcagtcttgggggaaacacacacacacaactttaagtaaacttgtaagacaagggaatgttttcaacttgacaaaatgcttctacaagcccggccaacatggtgaaaccccgtttctacaaaaaaatgcaaaaattagccaggcatggtggcacgctcctgtattcccagctactcaggaggctgaagtgggagaatcctttgaacccaggaggcgaaggctgcagtgagccaagactgcgccactgcactccagcctgggcgacagagcgagaccccatctcaaaaaaaaaaaaaaaaaaagcttctacaaaaaacctgcagctaatatcatattcaaagatgaaacactgagtcctatttccttatggctatatatgaggcaaaaaatatccactctcaccacttttattcaatactgatatttgaagtactaggcagaagaaaaaggcgttctgagaagagtaaaagagaagaagtaaaactatctttatacatttaagtcataattgcatacgtagaaaatccttttaaaatctacaaaaacctactaggactaaaacattgaatttaaacaatgttacagaataaaaggtcacaaaattctattctacttttgtgtataggctatcaaaacctggaacataaaattcaagaataaaatatcatttttacaatggcattgtaaagactgagatattctataagagccataaaaaaccccatgagataatatgggatacatttaacaaaatatatttaatacctatacactgaaaagtacaaaacattgttgagagaaataaaagacctgcctaaataaataaatgagtggatacaccatgtttatggattggaagactcaatattgttaaaatctcaactcttcccatactgaactgtatattcaaaataatgctaatcaaaccccaagtaggttttttttctgtagaaaatgatatgctcattctaaatttatgtggaaatgcagaggacccatagtagccaaacatttgaggaaagaacacatttggaggatttaactaactcatttcaagatctaccataaagatatattaatcaagtcactgggttactggctaaggatagatgtatacccagaagagagtatagaaacagatccacacatatatgatcatttgatttttgtgaaaaatttgtagataattcaatgatgaaataagtcttttcaataagtggtgctggataccttcatatctgtatgagaaaaaatgaaccttgacccttatcttacatcatacacaagtattaattcaattgtagcatagatctaaatataaaatctaaaaatataaaattcctaaaagaaagtctatgcaccttggtgcatgcaaagatttatcaggacatagaagtacaaagtataaaaagaaaattggtaaactggacttcatcaaaaatgtaaaacttctgctcttagaatgattttattaagaaaacagaaaggcaagccaatgactgggagaaaatatccaaaatctaaagtgttcaaaaaatatctacaatttaataacaagaagataaacatgccaataaaaagatgggcaatagatttgaacagctacttcacaaaagaagatagactcatgaccagtaagcatgtgaaaatctgttcaacatcattagtcgtgaggaaaaggtaaactaaaatatgaatgtgataaccttactcatctattaacaataccaagtgtgggagaagatttagagcaactatcacacagtgcaagcgggagtgtaaactgatataaccactttgttttttgtttccatctcctccagcatttatcctttgtgttacaaataatacaattagactcttttagttatttttaaatgtacaataaattactgttgactatagtcaccctgttgtactatcaaatactagatattatttattcaatttgtcaggtttttacaaagttaagcatacttaccatataatccagcaattccactcctagttatttatccaagaaaaatgaaaacttacatgaacgcaaagacttgaacacaatgttcacagaaattatattcctcacggccaaaaactagaaacaacctgttatggacaaaactgtgtcccctccaaattcatacgttgaaccctaaccccctagtgtgactatatttggagataggacctttaaagaggtaattaaggttaaatggggttataaggataggatcctaatccaacatgactggtgtccttataagaatagggagagacaccaaggatgtgcatgcacagaagaaaggccatgtgagaatgtagcaagaaggcagacatttgcagaccaaggagagaagccccagaagaaaccaaaccttccggcactgtgatcttagatttccagtctccagaactgtgagaaaatcattcagagggaaataaacaaatccacagttacagaggaagattttaacatgtctttcagtatttgagagatcaagaatacaaatatagtaaggatttataagacttgactgacactattaacaagcctaatctgtaaatatatataacatacatatatgtgtccaccaagaagtgagcacagatgcttttcaaggtcatgtagaatattatcaaatattgattacataatctgccactaagcaattcttagcagataacaaagaattaattatcataagccattttatctgatcacaatattagaaacattagacaataagatattagacacaacaaagtaaaaatagactaataacctcaagtcccctgcacattggaaagttttttaaaacttcaggtcaagtgtggtggctcatgcctctaatcctagcactttgggaggttgaggtgggaggatcacttgaggccaggagatcaagaccagcttgggcaatatagtaagactccattgctacaaaaatattaaaaattagctgggtgtggtgactcacacttgtagtgttagccacttggaggctgagacagatggatcacctgtgcccaggaattggaggctgcggtgagctatgattgtaccactgcactccagcctaggaacagagtgagactctgtctcaaacaaacagacaaacaaactttagtaattaaaaataaatcataatgaaacgagatgatattaaaaactgaatggcaatgaaaggattatctcaaaacttgtgggctgcaggtggctgcacccaaaaaaatagaaatttccagtcttcaatgcatagaaaagaaataaaatcatgaaatctgatacatttattctaaaattcatctgagacaggttaataaggaccaagtacagtccagataatttgagggaacattaattcttccagatatcaagactcaacataaaattataatagctacaagagtgtgttattgacaaggggataaattgaccaatggagcagaatgtatgggaacttatttttatgacaaagtagacttgacttatatttcagagaagaaaggacaacggatatctattcacaaaaataaaaattatatgtctacttcgaactgcacaaaatcaatctcaagcaggttaaagtcctaaatgtaaatggcaaaatttcacatactttcaaacatttagaagaacttttaaatgaaaatataggaaaatatctctctggccttgggattgtataggatttcttaaagaagacataaaagtataaactatataggaaaatattgataataattctgagtatatcagaactgaacatgtctgtttatactgcaaggaaggtgaaaagacaagccacagacaaggacaatataattgtaatatctttaagaggattattatcaagaatacatagagaattccgttaaaaatcaatatgaaggcagggtgtggtggctcaggcctgtgatcccagcactttgggagggcaaggtgggtggatcatgaggtcaagagatcgagaacagcctggccaacatggtgaaaccccatctctactaaatacaaaaaaaaaactagttggccagggtggtgcgcacctgtagtcccagctacttgggaggttgaggcaggagaatcacttgaatctggaaagcggaggttgcagtgagccaagatcacgccactgcactccagcctggcgacagagcgagactccatctcaaaaaaatatatatatatgaaaaagataagctatgcaatagaaaaatggccaaagtttacaaaaatttcattcaagagaaattcaagaaaatgttcatagaggaagaatcctaaatggcaaagaaacatgaaaaggtcctcaatttcacttgcaatcaaggaagcacaagacaaaaagtatggaaaaaattgtctgacaatatcaagtattgattcacatttgagaaaataactcaggatttcttatggcagaatgacactttagagagcaatttgacaaaaacttagaagagctgaaattgcacatatcttggatctactccaggcatatagctttttaaaattcacttccaggcataaatatagggaaacatgtagtcaaggagaaatgtaaaaggtttgttgcagtgttttatcacagaaaaaagtgaaaaaaaattaactttccttcaatatgggaatgaattttaaaaagggaatatttatacaatgaatatatgcaactgtttgagtaaagcagtacactatatatatatcaaaatagatgtgtcaaaattataatattgagcaaagagggcaagttgcaaatgaatatctccaactatgtttgttttcacttaaataaaaaccaaaacataccaaataacattatacattatttgtgggtgtaagattgtagaaaaagtataaacatatgcaaaggagttagacacactgacaggaaagttatgcacaccagcaactagggaggtaggagggaaaaggatgagagaagttttatctgtaatgttttatttctttaaacaaggagacatttgaagcaaacatggcaaaatgttagtatccttacatgtgggagctggggatatgtttatctgttttgttacttttgcacttttatggtatgtttgaaatagtttctaattttaacaaatgctaatgattgttctggatgtagggtagataagagattgtagaagaatcaaagtataaggagaatggttagcatgctacaattcacagtacatttaaataatttacgtgtttgttcatacatttaatttatggaaggccaaacaaaactcttttaaatatgatgcaggatgtattataagcatatttttccaaacttacttgctcaacctctctgttgagggaatctactttttcttttaatctgttaccctctgcctcagcagtgataagttccagtttgagggtattgttatctgcctctgattgacgggctttattttcccagttttcagcatcttcattggcttttcgaagttgttccatcatttgccggttctcagattcctgaaaagcaaactttagctattactttaaaatgctgaacatatgataaaaattaaacattattatccaagtcattgggaattcacttgccatgagaagcgtttataatagaaccctgaggaaatatatctatactcttagtttagaaaacaggtcatcctgtaattaacaaagactgcaatcagcatctgccctggctcctgagtaacactcagtgaacactagtaaatagtaaatttaggtaaattactcttttcttcaagacctgaatgaatttgttcttatatttccttttgtttgaagtcctccacagcctgcttttcccatatgtctgcttactgactacttgctggtctggattctgagcctctgacctttcgtactggtgtattcccttgttcttgaccaatttaccgggctgtgctggctacagagcttctgagtacttgcatattttaaatgtcagcttctgataatttcctgtctggtgtctgccttttattcatagccccagccttaattatcttgatcatgaactgttctatgattatcttttacctgctagtctagtaactttccctgccagtctagtaactttcctgaaattgctcagaagtaaactatcaaacctatgccaataaacactagttgtaaatatgcattcatgtataaattgagcatacaataagaaccagattttttgaactttcaaaattctatcatgagcagagtaactgaagtagggtctgatttctagtagggaaataaggagggaaaaaaattcagctccacaaacaatataatagaccgagtaatcattattaggctatttaaaaaaatattttattatggtttggtgaattcattctaaaaaattagttgtaattttggtaattttttaaaaggcactagatctctttctctcctgttaataaatagtgcacgtccctatcagaaatcctgggctaaataaaatgaccaaattgcaataaataatgtctaatactcctttcaaatcagataagccatttcctgattatgtttactggtggaaattcagctaatattgccaccttgtggcctctaatgtgaaagatctttgccaagtctgtgttagtcaacaatatactaaactaccttattggctttcaagattcagatactccaactgtgtcagcaggaacctgatatgtgttttccatgattgtactaacaatcatagttgtgtacagagtatgtacttggagggtgcttgtacaatatacttaaacgaattgtattcacattgatctttaccctctttaactttgtgcagtacttactgtctatgtcattcacttaaaactgccttacagctttgtgttgctaggtgtggatgtaaagcctccctgataacaccttgtatttctctaaagcaggaaccatttttatattaaatttagttctgtgaccaggtagtacattattcaaagtgaaaagggattccgtagaatgtctctcctgtcctccaaccacccagtgctccctccttcttggcaagcagaaagcatattttaccctttttcatatcctcccatagaggccagagcagtgttgagcatgagaggcaacactataaagaaaatgaaactgttctttggtattctctatttcctgctttcaggatctctttacttctatatggtgcctcccctgtatccacagctccctctggccacccacaagtctcactgcaacactccgtaggcctcagctggaatcctttgcatttcttgcctaaattatggttacaacctcttctaactgctctctccacttctgattttgttacccttctggtttattcttgacgtttccaaaataaacttcctaaaaggcaatccttaaataacttatatgttttagttctaacaaaagcttctgaaaatagggttcaaagaaggtctttcttacctctcctttatcatccacttgtacacactactctacctacaggacctactttttcccctacacctttgctcatgttgttcccactgcctggcagtcattctgtttcctctccatttttcatctctggcactccagcacctagcacgctgcatgaatgagtgaatgaatgaagtactccacacttcttgatggtctatccctatcaaaatggatccgtggttcattctctccgggcctgcatccatccagtgttatgcaatctcataaacaaattcatactaggatgctaaaatccccagcacttcggaaggccgaggtgggaggatcacttgagcctaagaagcttgatgtgtgatgtctgaaaatataattctagaatctaaaagttataatccctaatggtggaatttcaggtaatgttactaacagacaagggagataaagggaagtgtttaacactggctgaaagcttactatgttaaatgttgctctggggtgagtgcagtggctcatgcctgtaatcccagcactttgggaggccgagacaggtggatcacttcaggtcagaagttcgagaccagactggctaacatggcgaaaccccgtctctactaaaaatacaaaaattagccgggcatggttgcatgcacctgtaaccccacctactcaggaggcaggagaatcgcttgaacatgggaggcaaaggttgcagtgagccacgattgcaccactgcactccagcctggcaatacagtgagcctgtctcaaaaaaaaaaaaaagtgttgctctggatattcatttatttatttctgacctattctagaatagattcagatggctcactgtgctaggtgttttaaattatctcacttacttgggtgttcttcccgattacagatgggaagaatcagagaggctgagtagcctgcataaataaaaagccttttgttcatttatggtattacattgctggaaccttaaaatcaggaagtgtaggaaaccacgtgcttttcctacacaggctgcttgctgcctgaaagcaaggattgcaatttagaaatccttagaatctcttctgtctcaaagcccttaacagtactatgcataccataaataaatgttcaagatatgtttgtggactgacatgaaatgataaaatagtataggtggattgattattataataggtatagtgttacctacataccactcaaaccattaatgggaacatcctccctcaattttagataatattttacctaatagacatatctaaaatcctcagtaaagctgcctgtttattcctgagttgccacacatgcaccacacttattggagtcatctgatgtcatgtacatgtgcctggtcaaatgattgctaacagagaagtgtgaggagaaccatctgccttgtggtcctaaaaaaaatagatggtcccataacagggtaaccaattctgatctgctacataatcaggtggaacctcttttgtcagaggtttataactggaaaccccaccactttcaattaattataagcgaggtcaaattgattttagccctttgtccatcatccagttaggaagattctgcttgtctagagtggcagagttgcaaaacaaaaggggcatattctccaggcatctttctgaacattctaaatatgtagttaacccaccattgtcaaaactaaaatatactatgtattaaagaaagctttgattcacctgtcgttctgagtataccaacttctaaattaactctagtgaaaactaagtatcatgagcaaaaagaaaaaaaaaatacatacttcagactttaatatattcttcagcttgttaacctccaaattagtatcttgaaccttctgttttatgtcattaagttcattatgagtgtcattcaattttttggacagtgcctacgaaaaaaagataggtatatttgactatgaaaaataaaaaatttctatatctcaaaaataccataaacaaatttttaaacacttggaacaaataaaattaacatacctaatatataaactcatataaaaaaagaaaacacataagcccaatagcaagtgggcaaatgacccaaataagcaattcaaaaaaggaagcataagtaggtaagacctgaaaaaaactctactagcaactgaagatatgctaattaaaacaacacattactattctgcttatcaaattaataaagatttaaagctattcagctatggtaaagaatgggcatttccatgtactactggagtaaatgtagatttgcagaaagcaaatctgtgatcaggaatctggtgatgtatcaagagacaatttttaaatgctcataaaaacaagaaagacaaaaatgttgattatttttgaaggtgggaaatggcacatggggattcattatatttgaaaatgtctatttacatttttttaatttaaaaaagaaacctcagctgggtgtttttcctgtaatcctggcactttgggaggatcacttgagcctaagagtttgagaccagcctgaacaacatagtgggaacccaactctacaataaataaataaataaataaataaataataattaaaaagaaacctgataatctgtgattcactctgaaatgaaatctaataaaatttaatgagatgctgtcattaaggcatttgttacagtgacaatatttattcacattaagtgaatcatgcagtaaataatagtatatctacatagtggcataaccacataatggaatattacatacctgtgagaaatgtttggaatgatttttaataatacagggaaatatttgcctatgttaagtgaaaaaaaaatcgtgctaaaacacaaaaatacctcattatcccaatttgttaaaaattgtggtatcaaggataaattttttttaagtttccactttctcgtcttctgcaatactggttcttaacctgtggtccacagagagagacctctcttctaccttgggcctatgaccataacgaagaaaaaactacttttgagcatatgtaaattgttatgacaacagttttcttctgattataaaaaatgtttacaaagtttgaacaaggcaggaaaatgcttacaatattatagtaagctaataatagctataaaatatttattgagtgatatactggacagtacagtaagtgctttccaggtatagtctcacttattaaccatttttacagatgctacagagactcagagaagttggtttatatgatcacacacgcagagagcaagattcaacccatgtgaatcttactcgactctactgcctcttcatgtagaaaaaagcatgatctaaagtgataggtgattttatcccactacattagaaaatgtgtataaaaatagtgttaaaatttttaagtgcactgtatagcaattaaaaaaatatgtcaaatataacagtaactgagtatcaaaaacatgggggcttttctaaactcttaactttttgtttagaaaaaagactttctataataagcttctatttctaaaccaatcaaaaaaatagaaactaaatttctaggttttcataaataagatatatccacctttagcccatatgctctagctgtaaagagtacacaaaggcaaaccttacaaattcccatgttttggtttttattgctattcattaattttttaaataaacttttagaatagttttagatttacagaaaagttgtgaagacattataaagggcacctctattgttaacattttacattagtatggtgcatatgtcacaattaataagccaatattgacacattattatctgaagtccatactttattcagatttctttccttttttacataatgtcctttttctattccaggatcccattattcatttacttttaaacaaaatactttaacatctcagataattttttatgattaacaaagtattacagctttatagctgtttaagtaaattaataatcttcaacagttaaagaacacagactttcaggatgcaaactaaacacactgaaagtgatacaaagtggggaaaaccatttggtcttaaaaattttgagaagggaagaaattttccaaataggatttttaaatgttcacgttaaaataaatgttattggaaatgagaactgcagattagacttaaatatattgccttagggagaaagagtaattataagaggaactttcctaaaaagaatcacagtgctaatgagaaccaaaaaacaaggcacagtccatacattcatacttaaaacagaataatatgtagtccatttttttaaaaaaaaaacacctattcttttctttaaggtttctcaaggtttttattctcattttttgattattcaaatatttatccttcagcaaggaagtactaagctttaatacaaatatagccctgttctctcttttctttaatatttaaccctttgtgtctgagaattccatttaaaaattatgtggcctattttgttattttttaaaaaaaagaaaaggctagttccagtgtctgagctcttctataaaataaaatgagggctgttcctcacaagaaattcatatttttttttcttggagaaaatgattctaggaacaagtgtacctggttttcttgtttagctttagcaaactgttcctggagattgtcattgtcatgagccaagatatctctttccctggcgatctgggccagctcatcatttgtctcatccaattgccgacgcattctggaaacgtcttgttcacacacaattagggcctcagtacactgtctattccacaaatcaaagagtacataagaagagacattttactgaaacagagcaacaaattctcacaagacagaagatggacagttagtatgaaaacatttgaagagattttaaacacgtttgaatttataggaataaatactgcaaagacagtgcattagagtttctcaatgttgccatcatttcgctatgaaaaggatacaaagtatacataatagtcaatgatttgccaaatatttcaaaacttcttacatcaagtattaggaaggctttcatcctacttctgttatggcttagtctcctttacagattcctcttcctctgcccacttaaaaattaatgcttttcagggctcaagccctagcctcccaattattctcactctaacccttctctcagacaaactctattcatatccatggttcccaaccccatctagatccaatgactccaaaataattatctccagttttagaccctctgttatactccagacttatatttaactgcttactagacatgtctacaataaggtcccaaaggttcttcaaattcagaggtaaaatcattttttctcctcatactttcttcatgttcagtatttgtccctggccagaaacttggcattttcctggtgtctctccctcatacaaaagcatttcactccttctgtcccacaactcctaaaccccaatttatcaccacctcttctgcttaggtatctttctaacacaaaattctcctcagaattctttaatgatttcttattgcccaaaggatataaccaatactcatttgtctgttacacaagcctctgcctgcctatttagtctcctcccttcacttctccccttacactctaggtttcaacaacactcacccacttgtaggtcaagaggcttgtcaacatgatctgtggttctttgctattctttctactttaaatgcccttcccttccccttattttacttggcaaacaccatcccctcttttagttccttagacagacttaggcctcctttgatgagagagttagcaccttacacgtatcattaagccccttgtttcttactatctttgtacctaacatggtacttggccccccagtaagagctcatatatttgttgcacgactgatttaccttgatgcctgttccatctcagcaatgatattcttcatgcctgaaatggtcttttccttgaaaaataatataagtattaaataaaaaaatcttaagctgttatttctgttaaaattgaatgaacaaaaagaaaatttccctttccctttaggtttccatttggttttaaaaacatgtatgtcctattcttttccacactttaaagcctagtatatcaatgtgaatatttgcactgggtaaaaatagattatgttcattaaagtaaaggctatacttaggtgtaattatgagatcagtatatcaaattctttgtcaaaagatattttatgcagtcacccagcaatacaagaaccctataaccacctgtttttggaggcaaaccaatggtttggcattggagtattggcattttatactgggatttagaactggttctcttgctcacattctttatgttataaaacccagagaagccaatcatgtatacctaaatttagtttttaagaataattttgattaagtgtattatttatattagccagcaacaaaatcttcaaaaagctgttccaatccaattacttatagaagtatactactgatatttaggtgagagctaataagaaggtaagcattaggcctcgagcaaaggtaagagaaataaactatattttcctttttcaaaggcgtgatgagggagtagaagtagtggagtcagtcaaggcagaaatgggtttgaatatcttaatgcctttaataccattcccacacctctttttaaaacttccattgaccctgaactagtccaactataaacagatacttagagctaacattagccctaaaaaagtaagaaagttatttcactaagtaataactagatttcaccttgccatttgaattttcaaattttaagtaactaagtaaaaagatttttaaaaacccaaacctatattttccaaccaattctgttcctgtttcttttctttttttttttttttttttttttttttttgagatggagttttgctcttgatgccccggctggagtgcgagggcgcgatctcggctcactgcaacctccgcctcccaggttcaagcgattctcctgcctcagcctcccaagtagctgggactacaggcatgcgccaccatgcccagctaattttttgtatacttagtagagacggggtttcactatgttggccaggctggtctcaaactcctgacttcaagtgatccacccacctcggcctcccaaagtgctgggattacaggcgtaagccactgcgcccggccgttcctatttctttagcgttagttttacacatatttgcgtgtgtgtgtgtgtgtgtgtgtgtgctatcttcctttattcatgtgctcttctccagggtatttttagctacagtttcccattctgctttctcatggaatggtacagattccacatctggcagtaatagatactggtgtgttgttaaaatatgcattaaaaaaaaagttaaaccccttcaagaaggacaagccaacgaaggaaaaactaaaagacaaaatactccataaaatggaatgtttacacatttttgaaatataatttaatacatttctaaacaaattctgaaaagctagttgaactagtgcttttgaaagtctttacttgaggccgaatgcggtggcttatgcctgtaatcccagcactttgagagggtgaggcaggcggaacacgaggtcaggagtttgagaccagcctgaccaacatggtgaaaccccatctctactgaaaatacaaaaattagccgggtgcagtggtgggcgcctataatcccagctactcaggagactgaggcagggaatcacttgaactcgggtggcgagggttgcagtgggctgagattgtgtcactgcactccaacctgggtgacagagactccgtctcaaaaaaaaaaaaaagtcctttcttgattaaccttaaaatatgtttgataagcctaaaaagggcttcactttatcaatataagtgcatcttaaaaaaaaatactctagaaacattgtaaagtatccagggcaacaaaatttctgggttgaatccaataacatatactcttagcctatttttctcttaatatgaccctaataccaccatttctcaaatgtgccatcattccttgtacaacctcagtatgttctaagatgtattccttgtacaacttcaaggtttaacaattttttaaaataatatttaatatttcttattcaacctcatatgttgtccaactagggatgtagattcatgttaactgtcaaaattcagtctggacaggatggtgctaagtatatttagaaaaaataaactataactttattcaaataattctggtttttcttacccaaaaatctatgaagttgccattgagttttctaattttaattggtagcaagtagtaaaacatctttttaaaccatggatactagaaaaaaatcactttattcactataatgtagacttttccatgctaatttatttctgtaatctctatatgaacagtattagttttcactgagtagcctttgttagttcagctctgaggtatcattatagagaacatttcctcttttgattgcctaatggtaccttgcaagttattttccctacagaggatggatgtgtttactttcataaaatcttatacaaagttcttgattttgaagtagacttgtaactcaatattgcttgtgaaggaaatataacattgttacggttcgcagaatggaagaaatgtgaaatattagatatagcacaagaaaatgagattttgaaagatgtgaagaattttgcttctaaatgttagtgttgtgaaaggaaatcatgcttaaatattcaaaaatgttttgaatataatgagaagcaaaattctacctaaaaaacctaaaatttcaaaacaatgagtcagccttttccacaagtatttaccatctcatgccctttgatgacctcaattatgttcatgattcccaaatctattaactttaattaaattttcctccaaacctaaaagtccaagagcctttaaatatttcaatatttcacctacataacccaaagacaattcaaactcaacatgtcaataactttcctttctaagcctgttctagttcctgtttcttccttcatacataggaactatccatgtgattcttaagccagaaaccataccttgtcaattttacttccttaagagacctatttctctcactgatactcctactattctaatatagctctcaacactgttttcttaactagtgtccctgtcactactctcatttccctataatccatcttttatacgaatttacaaatgccagaatatttgttataaaataaagacctaattgtaacatttcattatcattatttcagtgaccctctatatccatgatgatagatctcacactcaacatcacatgtacttttatgatttttttgcttaactatcccatctcttcatgtatctatatctctatgggatatagatatagatacatgaagagatgggttatatacatatatacacacacacatacacacactgtaaggttgcaatgagcatcacagcagagaagggactgtatgcctatcccatcttttctttgccctcccatatctatctctctacaacctgttctctggccatgctaaactatcaggaagtctcatgaaattctcatgaaagccactggactctcacttaagctgttcaacctgtctggatcaccctttctcattgtcttctttccctgactactatctagtcattctcctgactactatctagtcattcagtgactactatctagtcattcaaatattctcctgactactatctagtcatttttcagggtagtccaggcaccatcacttaatggaagatttttccagaccttcctcctcccttaacccaattcccaggctgaatcaggtgtgtttttgcccaattccaacaacacattgtgcatatgtcattatggcacttaatgtattctgtcataacagtatctttatctctctccttattacactagaggctttgagaaggcggaccattcacctttttttttttttttttttttttttttttttgagacagagtcttgctctgtcatgcaggctggagtaggatggcacaaactaggctcactgcaacctccacctcccaggctcaggtgatactcctgcctcagcctcccaagtagctgggactacaggcatgtgccaccatgcccctgcctcaccctcagtttctaacataacatctggtacatgtcaacaaatgtttgttgaaataatgaatggatggatggaaacataaattaatgaatgagttaccttagtaataaagtaaactaataaagcccttattccaatgatgctgcttttgcttaagatatttgtgaaaacagcttaggaactgctttcagaaatcagtttataagctagaaaataatatcagtatctctgccttgttggcaacaccttttatttattttatttatttatttttgagacagagtctcgcactgtcgcccaggctggagtgcaatggcccaatctcggctcactgcaagctccgcctccggggttcaagcgagtctcctgactcagcctcctgaggagctgtgattacaggtgcccgccaccacgcccagctaattttttgtatttttaatagagacgggggtttcactatgttggccaggttggtctcgaactcctgacctcatgatccgccctcctcggcctcccaaagtgctgggattacaggcgtgagccaccgcacccggcctgcacgcggccggcaacatcttttttcaacaacaaaaatgtgggatggaggttatcatccagctttattcaccagccctatatgatctattctcaaagcctgaggatgatgtaaaaatgtgctcctagggcagggtgcagcggcttatgcctgtaatcccagcactttgggaggctgaggtgggcggatcacgaggtcaggagattgagaccatcctgactaacatggtgaaaccctgcctctactaaaaatacaaaaaattagccaggcgtggtggcaggcacctgtagtcccagctactcgggaggctgaggcaggagaattgcttgaacccgggaggcggagcttgcagtaagccgagatcgcgctactgcactccagcctgggcaagggaggaagactcccgtttgaaaaaaaaaaaaaaaaaaaaagtgttcctagttctaaacacaattacaaagggtaactacctgaaaatatgcttttaagaagaaatcagtctcactactttattgtcatgctttatattttgatatctgaattagttcttgccaattgatattaattactaattcatgatagaaaaatcaacttaaaatattagctactagatttgtacacatgcttcctaagactatcttaaaatatttcaaagtcagattttgaagttccagcttctagaaaaacatttgagaaaattcaaatattttattcagattctagttcttttaaaccatagtttaacatttaacatttcatttaaacgtttcttataaaccacagttctcagaacatactttcattgccaaactctctccaagggatgcaatattctcagattttttatccaaacatgcttgcaggcattccttttctttagccagatcattgagggttccaccaagaatgctgatttcttctcgctgtgcaatattttgccttgtaaagttatctatgtatgcaatcataaaagtgttgttttaatcaaaataaaatcttttttctatttcaagcagattatcgtactttttgaacttctccttacttctaatatatattatattcaattactaacaatgagtactatatcccaaattaaaaaaatttttttggttaaaaactacagtgaatcacaaaactctaaatgatgcataaacacaaaagcacaataacaatgaattagaatagtgaaggaaagctctacatcgcaagctgtcaaagtagacttaatgtatgatgggaaaagagagagtgggtggatgaagtaagtggaatatcaaaacaatctgcggcatttctctcctgtagtttcccctcccctccctctagcctagaatcactgttgtatataaagttggtaagtaacaaatcttaataaaatattcaattaagtcatctttaaagtaaaatgtcttctaatattctggtatttctaaagtagtgttataaaaattcctaggaaaaaaaatcatcccaggaagtatgattcaatctgtgagaactcttgcaagccagtgtcaacgttgaaggcctgaatgattggtacagaagaatagttttcaaattgtggtttctcaaccagcaccatcagcatcacctgggaaatgtacattcttatgcctccactccagacctactgaatcagaaattctgggggagggcacagcaatttatgctttaaaaactccttctttccccagtgattctaatgtataatgaggattgagaaccactcgtctagaggagtttacctactctaggtattagatttacctacagaaactgttagagacacaaaagctctggttctagcctacttcaaggaggctggctccagtgatctttattagctctcaaggtgattctgacacagatgaaagtttgagaaccactggtctagagctctacaagggaagctctgttagacagacttctaggttaatccctactaggttaatacctgtgagggccatccaggagcagtgctatgggagataataccatattgtcatatgccaaaagcttgatctatatagtactggagaatacaccatgtctctttttgcaggcagtattgcctttaagacaacccgcatgttttgtgtgtcctgatatctgagttcattcccactggcaatcaaacaatcaatacatctctaaaatagctctagtatctcctagcttaaaaaaattatcaacctaacagcccactcaaactattaccttattttcttgctaccctttaatagccaaacttcttgagagacttctattcttttctgtcctgacttcacttcccatttattcctcaacccactctatcttctacatccaacactccattcaaacttttttttggtgttaccaaatcttccaatgtgccaaatccaatcaatatttttctttagcctcacttatttcacttctcaaaagtgtctgacaattgatcatatcctccccttttaaaaacacttcgctttctggtcttccaaaataacactcacttctgggtcttcttcctacttctttggcttcttgttactcagtcctggatcctcttctcattctctatatttccctaggtaatttcacggttttaaaatatcatttatatgctgatgtgtcccaaatatgtatctttctcttctgagacacaaacttaaatattcagctgcttaccttagatctttattgggacttaaaatacccaaatgtgagttctccttcaatattatcttttatatttctgttttaatatttcccggtttgataaatagtatctccatctacctagttggttataccagacattcttgaactatataatagcaagtgttaacaatatttcctctgctttaaaataggctcttctatagccctgaccaaaattttaccctgtaagattaagttaggaccatattttcatactgatcactaacaagaaacataaataagaaactttaaaaaagtaactttctctataaaccccagtaatatcatagacataactaacactatccccttggtgataagtgagttctcgctagacataactaaacatatgtacactttccaccaaaagtaatatataggtactgtttcattacagcagctatggacaagctacaatattacacaaaaaattcaaatttaagttatcatcgtaagtttacaaactgttgctgctgagtttagctattacttcattgataaattttaacttatcactaagtacttatggtgctaaatctaaaaaattttgctgtcaaagaaaaatgaatttctctactattttttattcataaacttagttaagggcttgtttccaagtttttctatgttatactgaagagaagaaaatacatctttgctaccaaacttaagaaaaactaaaagtaatattaagagaaaaaaactcaccaattttttcatccaagcacataattttctcctgagtaagctgtagctcatattttttcttagcaaggtgtcgctgagtatcagaaagatctttttctgtgttttcatacaaaagtctgcaaatattttaataataaaactaattctgaaatttttgttttgtcatcttgtagtgtgtttaaatctaaaaacttttaaggacactaatatatttatttcctcttaatatttttatacagttttaatattttcattataaaaccaggaagtttaaaaaataaagggtaagaagggatcttcaatccaccactccaacataagctactattagcattttggtcataataccttccttaggtcccctaatgccaaatcagagcaatcagattaggaactactatgttagctctggttggggtttgtctgtctcaatagcctagggttttatgttttaattcagaaacaagatgaggccatagagatgtctgcaacacaggaaatagaactaaggtgtcccatgtaaatatggagagatataccattagtgagaaggtcagactagagaaaaacaccttgtcaattgctgctaggctcaggaaaataataacaactgtaatgcctaaccttgttttttactaactctatttttaaattttccctttttgtctccttaactacctagccttgtttcccatataaataagactctcccttagctgggaaagccggacaaactccatttggccccttgatttacaagacattaagggctccttacccgacccccttcctcaaggagttaacctgtgtaagcagaccctcagcatttcaaaggagccaaattaactgataaggtactggaacaaacaatgtgtgaagttcccaggattttgctcaaaaagataacaacataaagccttgagtctgtgtccagcatagcatccatatctaacaaaggatttagagccccgcacctggttccgttgcttttttttgtaaccatttgccttttaaattgttaatctctctgtaaccatttgtttttttgattcttgcatgtttttacttctgtagaattattgcatttgagctcccctccccttcctaaactaaggtataaagttaatcaagccccttcctcgaggctgagagaattttgagcgttagccgtctctttggccgccggcttaataaaggactcttaattcgtctcaaagtgtggcgttttctctaactcgcttgggtataacacaacaaagagtcttaatctcaatctaagcatcaaaataaaatttggttcccgattggtcatataatcaggaaccccttgcaaaactctggaggcatgctctcaacccaagcacagaactaaccccagacaaaggcctatggaaaaggatctcataattcaaaatttaaaaatacatcaagaaacaatccaaccttagtgggagtcaaaagacacacaaactaaattagatccctaagaacttcagactacagcactatcaaatagaaacttagaaatacatgtgtttaaatacaaacacataaaataataggatatataaagaaaaaaataatcaacaaatttggaaaagaaccaaatagaacttcacaaaattaaactaacatcaaaattttaaagattacaaaactcagtggacaagttaaaaatacagaatagacactgtgaaagagataactggtaaactggggaaaaaaacagatcagaggtcctatattagagcacaaataaaacaatgaaaaaatacaaaatagaggttaacagacataaaagacagaataagaaggtccaatatttaccaaatcaaaatcccagtagggaagaataaagacaatattcaacaaaataatacctaataaaagatgaaatccaagactaaagaggtattaacctgtatctattaagacaattataaatgggggaggataaaaggacttaaaaggagacaagatttctatactttatgcaaactgataaaatgtgacaccagtggatcgtgataagtaagtacaattcacagagcaaccactgaaaaatctatagacactcaaaaatactacagatatcaaaaatgggattctaaaaaatgtcaagtaatccatgaaaaggcaggaaaacaaaaacagagacatgagaaacagaggaaagaaacaaacgaaaaacacccccaaaaaataacatggagaattgagccctaccaataattatattaaatgcatatggtctaccttatttttaacagccaaaacctggaaaaaatcaaaatgtccctcaccaggtgaatagctgaacaaattatggtacattcatactatggaatgttactcagcaatattaaaaagtagcaaaatttaatacttggctggatctcaatggcattattctgagttttcaagcgaatcttgaaaatcatggctgtatgactcttcctataacattcttgaaatgacaaaattacagagttggacaacagattagtgtcagatattagggatcatggtgggggaagaggagatgtgactgtaaaggagtagcatgagggatatttttgcggtaatagactttccgtgtcttgaatgtggtagtagttacatgaaactacatatgtgataaaatgacagaactatgcacacacattgtaccaatgtcaattttctggctttgatattgtactatagtgatataaaatgtaatcattgtgggaaagtgggtgacgggaatacatcgacttatctgtatatttttgtaacttcctacaaattatgaaattattttaaagcagcaaaacaaaaaaaagtcctagagttaggctgcacaattatgccaattaaattaaaatctctgggaatgagaattaacatcactattgttttttaaagctcctcatttgattctaatatgcagccaaggctgttaaggaatgcatctgatatggtttggatgtttgtccgctacaaatctcatgttgaaatgtgatttccaatgttggaagtggggcctggggaagagatgactggatcacgggggcaggtccctcatgaatggtttaacactatccccttggtgataagtgagatctcgctagttagttcacatgagatctggctgttcaaagaaatctgggacctccccttttctcttgctcctgcccttgtcatgtgatgcactggctccccctttgctttccaccaagatggcaagctgtctcgtgccctcaccagaagcaaatgccagcaccatgcttcctgtacagcctgcagaaccataagctaaaataaatttcctttcttttaaaatgacccacactcaggtatttctttatggcaacacaagaatagactaatagagcctcctgatgtctcttcatctagggtagcaaaaggtgaaaaactgacaaagcaggtgtatatgaggcagaaagtgatagtggttttatggcatcagcgtctctcccatccccccataccatgaactcaaagaggctgatattgttagtcacccaagagcattgttttacacaataacttatatctccatggcaaaatgtgtcccagggccaaaattataagacatttgagatggccagtcatttaaaaacgaaacaaaacccactgattacaaaatcaagcagaagctggtatattagaataagtgcatccaggccgggagcggtggctcatgtctgtaatcccagcactttgggaggccaaggtgggtagatcatgaagtcaggagtttgagaacagcctgaacatggtgaaaccctgtctctactaaaaatacaaaaattagccgggcacagtggcatgcacctgcaatcctagctactcaggaggctgaggcaggagaattgcttgaacccaggaggcggaggttgcagtgaggtgagatcgcaccactgcactccagcctgggtgacagagtaagactccgtctcaaaattaattaattaattaatttaaaaaatgcatccaaaaaagtaattagcccaaaaaaatttaaaagaaaggagaagccaggcatgatggctcatgtctataatcctagcactttgggaggccaatgtgggaggatcacttgaggctgggagatcaagaccagcctgggcaacataggaagacccccatctctataaaaatttttttaaaaattagtcaggcacagcggcacatgtctgtggtcccagctacttgggaggctgaggcaagagaatcacttgtgcctgagaggtcaaggctgcagtgagctgtgactgtgccgctatactccagcctgggcaacagagggcaatcctgtctttaaaaaaaaaaaaaaaaaaaaaaaaagttgtttttttggaggttctagaaaaatttaaaaaactaaaagacactgctagatattatcaatatgaaaaaagacaaggaaaaaagttacaaataacagttataagaaatgtagtagatgaagttaaaaaaaatacatgttgtaaatagtagaatggatacacttgataaatgaattagcacactgacaacaaattgaagaaatttcagtagaaggataaacaaatagaaaacaagaaataaatgtagaagacttaccaaagctgactttgagacttactacagtattcaagatggtatggcattagtctacggatcaacagactaataaagcagaatacagagcacagaaatagaccacagatatatggtcaatcgattttcaataaatacaccaaagcaatccaatggggaaaggaaacaattggtgctaaaacaactgcattgccctgagtgatgaaatattctgtacaacaaacacccatgacaggggtttacctacataacaaacctatacatgtacccctcaacttaaaagttgaaaagtaaaataaaatgaacaaaaacaaaccaaaaaacacaattgtattcttttgtggaaaaaaaagaactctgaccactacatgacaccatacacgaaaaacctaaccataaaatgtaaaattacaatgcttttggagaaagcataaacatgtatgttaaaagttttaaccaatcctggtaatcaaatccaaccaaatcagaatctactatgaccaagtggggtttacccaggcatgccaggttggtttacaatttgaaaactaaaaattaatcaataataactcatcatattaacagactgataaagaaataattatgatcatatcaacagatgcagaataagcatttgacaaaatccaatatccattcttaataagaacactcagcaaattacaaatagaagacactttttccaatctcataataggcatctatgaaaagcttattgctgacgttacaaagatgaaaggctgaattgctttccttccaaaaccaggaacaaaacaaggatgactgttctcattcttctgttgaacactgtaccagaggttctaccaagtaaataaggaaagaaaaagaaacacaaggcattaagattagaaaagaagcaaaactcttaattcacaggtgacatgataatctacataggaaatcctataaaatctaccaaaaaactgaggctagatgttcaagaccaccctggacaacagcaagaccctgtgtctaaaaaaaaaaaaaatttgggggccgggcgcagtgtctcatgcctgtaatcccagcactttgggaggccaaggagggcgaatcacgaggtcaggagattgagaccatcctggctaacacagtgaaaccccgtctctactaaaaatacaaaaaattagccacgtgtggtggtgggcacctgtagtcccagctactggggaggctgaggcaagagaatggcgtgaacccgggaggcagagcttgcagtgagccaagatcatgccactgcactccagcctgggcgacagtgcaacactccgtctcaaaaaaaaaaaattttttttaggccaggcacggtagctaatgcctgtaatcccgtcactttgggaggtcgaggcaggcagatcacctgcagtcaggagttcgaaaccagcctgaccaacgtggagaaaccctatcactactaaaaatacaaaattagcctggtgtagtggcgcatgcctgtaatcccagctacttggggggctgaggcaggagaatcgtttgaacccgggaggcggaggttgcagtgagccgagatggcaccactgcactccagcctcggcaacaaaagtaaaacgccgtctgaacaaaaaataaaaaataaaattttttttaaattggccaggcatggtagcgcatacctttactcccagctacctaggaggctgaggcagtagaatcactggagcctaggagtttgaggctacagtgagctgtcatcgcaccactactgtccagcctgagtgacggaataagacagtgtctctagaaaaagaaatactaaaattttttgttcatcaaaaacaaagcaattacaagcaaaaaacaagccacagactagtttaaaaaaatcatacatttcagataaacggcttctacaataatgcctacaaataaacaataaaaaccaccaagcaaaaaaatgagcaatagaactgaacagacacttaacaaaagaagatatataaatggcacacaaacaggcactcaacatcattaggaatcaagaaaatacagattaaaaccacacaattatacctctttacatccagtaaaatggctaaaattagagactgaaaacactaaatgttgctaaggatatggatggaacaaagtaaactcttatacaacctttctcacatggggttctgtgggagaaagaactagataaaattaattcagtgactattttctcaattctctcaaggatagcccaaagctagtacaattctagactcctatgaatctaagagagatgataattcggtgtagtagtcccctcttatctgtggtttctctttctgtggtttcagttacccacagtcaactgaaaacagagagaccacattcacatgacttttacaatatgtggttataattagttattgttgttatattttattattagttattgttgttaatctcttactgcacctaatttataaattaaatattatcataggtatgtatatttaggaaaaaacacatagtacatatagggttcagtattaatatctgtggtttcaggcatccactgagggtcttgggacatatcccccctcgataagaggggactactatacatacaataggtatcttagcaaattagaactcagttctcattctctctgaaaggcctgatttaaaagggctgcattataaattgttactgggactgtaaaatcacacaatcacgtggaaaactgatcattccttatgaaattaaatgcatgcttaccatgtaacccaataattccactcttatttattcaagagaataaaaacatatgcccataaaaggcatatgcaaaaattttacagcagtcttattcatgaattacagctaaaagtgggtgactaatccaaatatctatcaacaaagtattaataaaagcatgtggtttatctatactatggactactacttcacaattttaaaaaaggattgtggtggggaaaatggcagataggaggcaggactaatttgaagctctcactcagacgaacaaagcagtgtgtggagactcacgttgtgaacttttgcttcaagaactacagaaggaacatactaggaaagccgagagaatccacagaccctttgaaggaagaggattgctcctgcaggacctgagagacagcccacataatttgagtgcccaaagtgggaaagtgggaaatggggatcatccacccctgaacacacaccttcactggggaaagtgaaggtccagatcacgggagaaggatttgaccttacctggagctgagatactttagagagccaagcgaaatacaggagtagagtaagcagcgggaagagccctgtgggctctctcagtccccagggaagccatctctgacattgtctcacaggggtccttggggagggctgccagaggaactgggaaaagaccacagggagaaggaaacttccaactgaattttgtaacaattccaaccaaatgtgaactttcttggacagaactcagggaaagaggtgaagctcaagtgcagatgcaggcaggaggggtggcacaaaacctgaaagccctgcttgctttctcagctgggaggctggtagcctggggcaagttctcagccctgcttgcccactgcctggaaacaaacttggtgttgttggtggggagggcacagtgggagtgagattggccttttgggttgcatgggagctgggtgaggcctgtaattgctggctttcccccacttccctagtgacctgcatgacacaggagaggcagccataatcctcctgggagcataactcccttgacctgggaaccacactcccatcccccagagcagtggtagcaagccccacccaaggagaatctaagctctgacatgactaaccctgccccacctgagggtcttcctctatccacctggtagctgaagacaaaggtcatattctcttgggagttctggggccccactcaccacctgatcctccctatactaccatagctgatgctctcttgaaagtgccacctcctggcaggaggccaaccagcacaaaaccagtgcaataaacaacaataatacaaccaaggaccctcacagagtccatttcactcccctgccacctccaccagagcaggtgctgctatctatggctgagagaccagaagatggttcatatcacaggactctgtacaaacaccccccagtaccagcccagaacctggtagacccactaggtggctagatacagaagagaaataacaatcacacagtttggctatcaggaagccacatccctctaggaagagagagagaatactacatcaagggagtaccccatgggacaaaagaatctgaacagcagcccctgagccccagatcttccctctgacatagcctacccaaatgagaaggaacaagaaaaacaattctggtaatatgacaaaacaaagttctttaacaccctcaaaaaatcacactagctcaccagcaatggatccaaaccaagaagaaatcccttttagatttcttcttgccagaaaaagaattcagaaggtcagttattaagctaatcaaggaggcaccagaaaagggcaaagtgtaatttaatgaaataaaaaaatgatacaagatatgagggaagaaatcttcagtgaaataggtagtataaataaaaaacaatcacaacttctggaaatcaagggcacacagaaatgcaaaatgcactggaaagtctcagcaatagaactgaacaaacagaataaaaaactttagagcttgaagacaagattttcaaaataacccaatccaacaaagacaaagaaaaaagaattttaaaaaaatgaacaaagcttccaagaagttttggattatgttaaacaaccaaacctaaaaataactggcatcctgcggaagaagagaaatctaaaagcatgggaaacgtatttgggggaataattgaagaaaacttccctagccttgctagagacctagacatccaaatacaagaagctcaaagaacacctgggaaattcatcacaaaaagatcatcacctaggcacatagtcatcaggatatctaaaggcaagacaaagaaaagaatattaagagctgtgaggcaaaagcatgagctaacctataaaggaaaacctttcagattaacagcaaatttctcagcagaaaccctactagctagaaggaattgttgtcctatcttcagcctccttaaacaaaacaattgtcagccattaattttgtatccagtgaaactaagcttcatacatgaaggaaagagtctttttcagacaaacaaatgcagagagaatataccactaccaagccagcactacaaagaactgcaaaacgagctctaaatcttgaaacaaatcctcaatatacatcaaacagaacctccttaaagcataaatctcacaggacctataaaacaacacagtaagtaaatacatacatgcatgcatgcatacatacatacataaataccaaggtattcaggcagtaaatagcacaatgaatagaatagtgtgtcacatctcaatagaaacattgaatgtaaatggcctaaatgctccacttaaaagatacagaatggcagaattgataattcactgaacaagtatctgctgctttcaagagactcacctaacacataagaatccacataaacttaaggtaaaggggtggaaaaagacattccatgctaatggacaccaaaagcaagcaagagtagctattcttatatcagacaaacaaatttgaaaacaacagcagttgaaaaagacaaagagggacattatataatgataaaaggccttgtccaacaggaaggtatcacaatcttaaatatagaacagttactactaaacctaataattgacatagacagaagcacaataatagtgggggacttcaatactccactgacagcacttgacaggtcatcaagaaagaaagtcaacaaagaaacaatggatttaaactataccctagtacaggactatacccaaatggacttaacaggtatttacagaatattccacccaacaaccacagaatatacattctattcattagcacatggaatgttcttcaagatagaccatatcataggccaccaaacaagtctcaataaatttaagaaaatttaaattatatcaagtactgtctctgaccacagttgaataaaattggaaatcaactccaaaaggaaccttcaaaaccatgcaaatacatggaaattaaataatctgctcctgaatgattactgggtcaaccatgaaatcaagatggaaatttaaaaattctttgaagtgaacaataatagtgacacaacctatcaaaacctttgggatacagcaaaggcagtgctaaaagaaaagttcatagctttaaatgcctacatcaaaaagtctgaaagagcacaaacagacaatctaaggtcacacctcaagaaactagagaaacaagaacaaaccaaacccaaactcagcagaagaaaagaaataataaatatcagagcaaaatgaaatgaaattgcaacaaaaaacacaaaaaaattcatcaaaaagccagttctttgaaaagataagtaaaattgatagaccattagcgagatttaactaagaagacagaagatacaaataagctcaattagaaatgaaatgggagatattacaactgacatcacagaaatacaaaagatcatttaaggctactacaaacaccttcacacgcataaactagaaaacctagaggagacggataaattcctggaaatatacaaccctcctagcttaaaccaggaagaattagaaaccctgaactgaccaataacagggggattcaaatagtaatttaaaaattgcccacaaaaaaagtcaaggaccagctgaattctatcagacattcaaagaagaattggtaccaattctactaaaactattctacaagataaagagggaattttccctaaatcattctatgaagccagcatcaccctaaataccaaaaccaggaaaggacataacaaaacatgaaactatagaccaatatatctgatgaatatagatgcaaaaatccttaacaaaatactagctaaccaaatccaacagcatatcaaaaagataattcaccatgatcaagtgggtttcaaaccagggaggcagggaaggtttaacatacgcaagtcaataaatgtgacagaccacataaacagaataaaaaacaaaaatcacatgatcatctcaatagatggagaaaaggcatctgacaaaatccagcatccctttatgattaaatccctcagcaaaatcagcataaaagggacataccttaatgtaataaaagccgtctacggacatacccacagccaatataatacgaaacagggaaacactgaaagcactcctgctaagaactggaaaaagaaaaggatgcccaccctctccacttctattcaacatagtactggaagtcttagccagagcaatcagacaagagaagtaaagggcatccaaatcagcaaagaggaattcaaactgtcactgtttgctgatgatatgatcgtagacctagaaaatcctaaagactcctccaaaaagctcctagaactgataaatgaattcagaaaagtttcaggatacaaaatcaatgtacacaaatcagtagcactgctatacaccaacagcaatcatgcagaaaatcaaatcaagaactcaacaccttttttaatagctgcaaagaaaaaaaaaacaacttgggagtatacctaaccaaggaggtgaaagatctctacaaggaaaactataaaacactgctgaaagacatcacagacgacacaaacaaatggaaacatgtcccgtgctcatggatgagtacaatcaaaaatgtgaaaatgaacctactgccaaaagcaatatacaaattcaatgcaattcccatcaaaataacaccatctttcttcacagaactagaaaagacaatcccaaaattcatatggaaccaaaaaagagcccacatagccaaggcaagactaagcaaaaagaacaaacctggaggcactgcattatccaacttcaaactatactacaaagctacagttatcaaaaaagcatggtactgatataaaaataggcacttagacgaatgcaacagaataagaacgcagaaataaggccaaatgcttaaagccaactgatcttcgacaaagcaaacaaaaatatgaagtaggggaaaggacaccttattcaacaaatggtgctgggataattggcaagccacatgtagaagaatgaaactggatcctcatctctcaccttatacaaaaatcaactcaagatggatcaagcacttaaatctaagacctgaaaccataaaaattatagaagataacattgaaaaaacccttctagacattggcttaggcagtgactttacgaccaagaacccaaaagcaaatggaacaaaaacaataagtaggtaggacttaattaaactaaaaagtttctgcacagcaaaagaaacactcagcagagtaaacagaaaacacaaacagtgggagaaaatcttcacaatccatatatctgacaaaggactaatatccagaatctacacggaactcaaacaaattagcaataaaaaaacaaacaatcccatcaaaaagtgggctaaggacatgaatagataattttcaaaagaagatatacaaatggccaacaaacaaattaaaaaatgctcaacatcactaatgatcagggaaatgcaaatcaaagacaaaatgtgataccaccttactcctgcaagaattggccataatcaaaaaaattaaaaaccaacagatgttggtggggatgcagtgaaagggaccacttttacactgctggtgggaatgtaaactagtacaaccactatggaaaacagtgtggagattccttaaagaactaaatgtaaaaccatttgatccagcaatccaactactgagtgtctacccagaggaaaagaagtcattatacaaaaaagatacttgtacacacgtttatagcagcacaattagcaatttcaaaaatatggaaccagcccaaatgtccatcaatcaataaatggataaagaaattgtggtatatatataccatggaatacaatccagtcataaaaaggaatgaaataatcacattcgcagcaacctggatggaactggagaccattattctaagggaagtaactcaggaatggaaaaccaaacatcttatgttctcactcataagtgggagctaagctatgaggatgcaaaggcataaggatgatacaatggactttggggatttaggggaaaggatgggaggtggggtgagggataaaagactataaattgggtacagtgtatactgctcgggctatgggtgcaccaagatctcacaaatcactgaagaatgtactcatgtaaccaaacaccatctgttccccaaaaacctatggaaattaaacaaataaaataaaataaaaaataaaaggttcatattagaaatattaaagattgtactattaatacttttttaagtgataatgattctttaaaaaattctattgaaacaagccagatacaaaaaagtatatactttatacttaaaaaagtatatactttagtgagatttaactaagaaaagaagacagaagatacaaataagctcaattagaaatgaaatgggagatattacaactgacatcacagaaatacaaaagatcagacagagtttcgctctgtcaccaggctgtagtacagtggtgcaatctcggctcactgcaacttctgactctctagttcaagcgattctcctgcctcagcctccccagtagctgggattacaggcacacgccaccacgcccagctaatttttgtatttttagtagagacggagtttcaccattttggccaggctggtctcaatctcctgacctcgtgattcaccagcctcggcctcccaaagtgctgggattacaggcgtgagccactgtgcctagccaaaaaaaagtatattgtatcagtacgtatgtaggcagccccaactttgacagccatgcaggaccacaaaaatgactgtacaagctgtccaggcaaagtaatctttaataatcaatgagaaaaataatttttccataatttttaaattttaagtcaaaatataactttattactgtcatttataagtgtatagcaaaattttaaaaactagtatttattgagtacattgtaaattaaaacattaggtacattgagaattaacatgttttattctttataaaaagtttatcaagagtagtttgaacagtgcttgccgccccttatcaaaacaaaatacagagcaagcatgttttttatgtcttggcaagttgttatacacctttctaagtttggatcagcttccgtgttttaccctttatgctttcaatggcatgaaacatctcggagagttcttttaatgtgatggcttttgccaatgtcacgtctactgggctgccttcatcctttttgtcacaatcactttcttcaattatgttgataaggttgcctttattagtttccctggctgcatatctagaatctctttaatggcagcagtgtcaacatttccatgacagctatttcttccttaattccctttacatttgactcaaattttgcttccagtgttgtaactcttggtttctttgtagcattttcatctttgatggccaattcccccctttcaactatccattttataaaatgtcacatgttcatcactgggaaacgaggaggcaacagaaaacagactttgctatctaagcataaactgattaacatgtcactgatcaatcacccacacactttaaaagaagtgatgtgattggtcactggtcatgatttatatctgttattttcttagggatttgtagattaaagagctagcagtaagtttgtacttcatgcaattactcacagtaattactctggtaactgaaactgtgttggtagagaactgatattactaaactaaaccctactaaccaaattaatgcatatagaaaccatgcaaagtggggactccctctaagaaacccagatacaggcaaaatttacctatggtaataagtgtcaggcaatggggaggaggagaactgactggaaaggagaataaggaaactatctggagggaaggaaacgctctgtatcttttttaaagtatggttacacagttatatacaattgtgtacattcatcaaactgaccatatgttattgcatattaatgacctgaatctgaaaatatatatatataggaccccaaaaacttaaattcagacaaaattctaaaataaattctaaaggatattttttctaacagaaaataaaggaccccagatcactcaaaggcaacaaaaggaatgaagggcaatgaaaagaataaatgtacaggtaaatctaaacaaatattgactgagcaaacaacagtaagtgttttattcagtttatatatatagttatacacacatgtatgtatatgtgttattaaaatatttggctaaaaatggtacagaagttaagatgggtaaatggagttactgttctaaggttcttgcaattctcaggtaatcactaaaagaataataaatgagtttatgacttctagaatgatttctaagctgacagaaaacaataaaatgattttttaaataccccatcaatccaaaagaaggcaagaaaagaatcatacaattgataataacagaaagcatacaagacattagatttaaacccaaagatataagtaaataaaatacaaatggaccaaatgatccagttaaaatacaaaagatgtcagattaaattttaaaaacttaacatatgctatttgtgaaagatgtctaaaacataaggacactgaaaggttgacagcaaaagaaaatatttttcatgaaaatgaatactgaaagaaaattggtatagctatgttaatatcacacaaagaggtaagaaatatgagtagagataaagaaagtcacttagtaatagaaaaattgtaaacgtatatgcacctaataacataccatcaaaatatataatgaaaaaattgacaggtctccaaggacaaaaaatttttatacagaaaatagtaaatatcaaaacctttagaatatacctaaagaagtattttgaggataatttaaagctttacatgtttctattagaaaaaaaggcctagccgggcacggtggctcacacctgtaatcccaggactttgggaggctgaggtgggtggatcacgaggtcaggagtttgagaccaacctggctaacacgatgaaaccctgtctctactaaaaatacaaaaaaaattagccaggcgtggtggcgggcacctgtagtcccagttacttgggaggctgaggcaggagaatggcatgaacttgggaggtggagcatgcagtgagccgagatcgcaccactgcactccaacctgggtgacagagagagactctgcctcaaaaaaaaaaaaaaaaagaaaagaaaagaaaagaaaaaagaaaaaaaggcctaaaaagtaaaaatgtaaacattcatctgaagaaaattcaagaaaaaaagaaatctaaaaaaaatagaggaaaggaaataataagaacaaaagtaatgaaataataaaaacaaaaaacaaacaataggatcaaaaccaaagcaaaatgttggtctttggaaaaaactaataataaccaccaactgcagaatagaaaaacaggaaataactacagactctatgtacattcaaatgtccacaggatattataaataacattatactaaacatccttttaaatttagacaaaatgaaaactgcttacatatatatactaacttgcgtaagaaggaaattctaattatttctttaataaataaatgaaataaaaccttcccttaaagaagagatccaaatgactttattggtaagttctacaactccaatcttatacaaactgttccacaaaatgacagaagaaaaaatgaattgaaaagagtattatagtatgagtttacattaccttgctatcaaaatctgattttaaaaagccataagagacagctgggcgtgatggctcacacctgtaatcccagcactttgggaggccaaggcaggtggatcacctgaggtcgggagttcaagaccagcctgaccaacatggagaaaccacatctctactaaaaatacaaaattagctgggggtagtggcgcgtgcctgtaatcccagctgctcgggaggctgaggcaggagaatcacttgatcctgggaggcggaggttgcggtgagccaagatcgcgccattgcactccagcctgggcaacaagagtgaaactccgtctcaaaaataataaaaaataaaataaagccataagaaaggtaaattatcagccaatctaaattacaaaaatagatgtaaatatacaaaacaaagtattagttaacatagaccaacaataagtaacaagcataatatagtgtgaccaatctatatttattctaccctgtaaagttggtttagtattacaaaattaatcagtgcaagttcacattttaacagaataagggagaaaaataatgtgaccatctaaatacatgaataaaaattatcagatcaatttcaacattcatgtatgattttttagtatctgggcaaaataaaaataggagaaaattttcttaaatctaatattacatagttatcaaagaacctacaagaaatatattgaatagttaattagaagtaattcacatataacaaggcaagaaaaataaaatgtataagaattagagaggcaggaaaagaatacttgcagataacatgattttatgtacacaaataaaaaaacttctgtaggtgggttattaaaattaatgaaaagttagcaggactgttggataccacaccaaaatacaaaaatcaattttatttttacataacagccacaatttttaaaaacagttaaaatcatctcaaaatactgagtacctacgaatttaacaaaataaatgtaagacctctctacacacaaaaaataggaaacattatagagcaaaactgaaaaatatagagagatatacaatgcttatggtggcccagaagactcaaataacataaaaataaatgatttaaaaattaatctatgattcaactcaatgccattaaaatcttaatagtgtttttcttttttggggtggactttgaccagctcactctaaaatttatatgaaaattgaaaatgcaaagggccggcaatagtcaagactttcttgatgaataacaaggtagatttgttcttataggtttaacacttttacagttatagtaattaggaaagttttgtaatggtacaagaaccatgtaaaagacaaatggaacagattattgaccctagaaataaacacatacatagatatttatttttaagaaaaacatctctgcagagcagtgaaggacaatcttttcaacaaatattactgggaaaattgagtaatcatgtattaaaaagcaaaataaaacaaaacttgaccactgcctcacaacatacacaaaaatacactcctggtagggccgggtgcggtggctcacgcctgtaatcccagcactttgggaggccgaggcgggcagatcacgaggtcaggagatcgagaccatcctggctaacatggtgaaaccccgtctctactaaaaatacaaaaaattagccaggcgcggtggcgggcgcctgtagtcccagctgctcaggaggctgaggcaggagaatggtgtgaaccccggaggcagagcttgcagtgagccgagattgtgccactgcactccagcctgggcaacagagcgagactccgtctcaaaaaaaaaaaaaaaaaaatacactcctggtaaattacacatataaatatgaagataatataggaacataccttcatgatcttaaggtacaaaaatattttctcagttaaaaaaaaaagcataaattaggctgggtgaaaaaaaaaaaaaaagcataaattaggctgggcgcggtggctcacgcctgtaatcccagcactttggaaggccaaggtgggcgaatcacgaggtcaggagattgagaccatcctggctaacaccgtgaaaccccatctctactaaaaatacaaaaaaaatcagccgggcgtggtggcgggcacctgctaaggcaggagaatggcgtgaacccgggaaggcggagcttgcagtgagccgagattgcatgactgcactccagcctgggcgacagagtgagactctgtctcaaaaaaaaaaaaaaaaaaaaaaaaaaagcataaatcaaatgggaaagatgaataaatctgactacataaataacgtctgttaataaaaagatacttttatttttgtagagacaaggtcttgctatgttgcctaggcttatttcaaagtcctggcctcaagtaatcctcctcccttggcccctcaaagtgctgggattacaggcatgagccactgtccccagcccaagacaagctttcttggagaacatcaacagtaggctagatgaagtagaaaaaaataatttgtaaacttgaaggcaggtcattagaaaatacccagaggataaaaaagaaaaaagagtaaaaagaaatgaagaaagcctatgggatatatgggacactatcaagagagctaacattaacaaagaattataaaaacaaaaggagagagagagaaaagaacaaaaagataaagaactaaagattcagcctcaagaaaggaggaaattctgtcatatgctacaacgtggacaaacactgaaattatgctaagtgaaataagacaaccagagaaatactactcaatactccacttacaagatgtctctaaacagttaaactcagaaacagaaagtaaaatggtagttgccaaggattgactggagggggaaatagggagtgctgttcaaaggatacagaggttcagttgtgcaacacgaaaaactctagagatctgctttaccacactgttcttacatttaacaataccggattatacacttaaaattttgttaacagaattaaagaagtacagccatgttaacaaaaaggctttggatcagtttgtaaatttctctgagcagaaagaaaagttaataaagcgacaagaagagttagataggggttacaaatcgatcatggagctgatgaatatacttgaacttcggaaatatgaagctattcagttaactttcaaacaggtatccaagaacttcagtgaagtattccagaagttagtacctggtggcaaagctactttggtgatgaagaaaggagatgtggagggcagtcagtctcaagatgaaggagaagggagtggtgagagtgagaggggttctagctcacaaagcagtgtcccatcagttgagcagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgagattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcggagatggccaaagactttgtagaagatgataccacacatggttaattggaaaatactacttactggtttgggagttgtgtatagtaatatgattctcatacccagaactgtaaatataaacctaaatatttggccaatagttttcagacttaaagcatcatagtccttttatatttgtctttgtattttataagatactctgtaatgtcatgtttgtacttacagttttagaatttaatttcctgtacaactttttgtaaaatgttctgctcctattttaaatgttttgaaacatgctaaatattctttcctaattattttatcgcttatactgccttttttatagcttcaattaaataattggttttatgactaaaaaaaaaaaaaaaaaaaattgttaagaaagaccaggcccggtggctcatgcctgtaatctcagcattaataggagtgtgaactactatttttctttcttaagttccggggtacatgtgcagaacatgcaggtgtgttacacaggtaaacatgtgccacggtggtttgccgcacagatcaacccgtcacctagatattaagctattactatttttcaatgttcatagatgcaatgaaattcaaccttactgaatctgtagaacctctgtttctcacagcaacagatactaaaagtaaaaccactcatgtagaggtcttcaaaaactcattctcccaagcttattgctgtaggctgcttcaattgatacatcttcggcaaccatgccagtacacaggaaaggctaagtatagtacttgcattcaattaatagatgctccatcacgtgctcctatttctctgttacggcttttcattatattctaaatcaccctttttctaagcaactgccaaacctgtgctttgtgttttcttatactgttcatatccccaaacagaatttaaagttataaaggtaaacaatcaaagtcaaatatattctgtacccagaagagctttgtaaaagctatttcagttaaaagttgaagttttttacaaatgtaaagtaagattactagaagtgtgattcctagttaagtgtggcattaccagcctgtgattgagctcaggaaaattgttcactgtgtgccaagggttcctacaactgcttttcaataatcctctcagaaactgaactcaacaaataattttcattataaaatacactataaaaagcagagctatagttatagtaaactgttggttgtttaaaggtgatttagtttacctcaaagaattattctctgctttttgtctgccaagttcactttcggtatccattgcctttcttgctagtgatttcatttctttttccacagtgcttatggtttccttcatcaaagtcatatttgacatttgctccatacgttcatcatcaagctatacaagtagaatgacaaggttactgccatcactaaaaacaccttagtaatcttcctgaagggcatactccctctgtacaaactggtttatggcaagactgacaggatgagattatcaggttagacctgactgctgtagaaggttttacagataaggtgttgtgaagtaggaccaaggaaaagccactgcaaagtaaagcttatcacagtatatcagtctatatttttcaatctggttcaatttgactatagtataaatatgctgtttgcaaaagaatttatttgttgcccaacattaataaattacacatataatgtagaattatgaaaacaaaaattattttctcctgtctagtaattttttttttttttgagacagagtatcgctccatcgcccaggttgaagtgcagtggcgcgatctcggctcactgcaatctccacctcccgggtgcaagcaattctcctgtctcagcctcccaagtagctgggactacaggcgcatgccaccacacctggcaaattttcatatttttagtagagacagggtttcaccatattggtcaggctggtctcaaactcctgaccttaggtgatccacccgccttggcctcccaaagtgctgggattacaggcatgagccaccgtgcccagcccctatctcatatttttaactcattacaataaaacagtacagatgaacttataaatatattcaattatatttggtaatagaaagttaaattctcttatgtttatatagtgacaatatcatcaatatatattcgtagcaatatcaaatctgattaggaaaaaggtgatgtttcacatttaaatttagtttaaataaactttgcttataatttttatttcatcataattttctctccttatccactctttaggtagaataaaccattttctttacatctggcaatattatctttaacaaaatatggagatgagaaagtagataagatccctgaaaatgaatgcctaatgatttttttaaagtacatactttgcaacctaacaccaaaaaacatttactcacatttttagaaggaaataaacaaatgaaaaagtgacaatttacactataaaataccttaagtattttaggactataaacactatcttagaaaaataaaataacttctctgaatacagaaaaaggagaaaggggaaagccattgagtgtttatagccaaaagagacttttctttttttttttttttacattatgaactgtacactccagctcctctatcctttgttccaggtgagccttctcattaaatgctgtctcttgagcaatctgattaaaaagcaaaaacaaaataaagtgatttcaatatccctgaatttgtgtttcacatatattcacgtaaataaaatcctttccaacctttagcctctcccttagactatctcgttctgtggtcattcttcgtaaatcagtaaaggctacatctctttcagtctccactcgccggagaatagcatgtgccgttgttgatttaggactcttacagcttttcatcatttctcgtcgaagtcgggtaatttcttcctgtgcctattatttaaatcatagactttggttgaacaagctttagaacacataaacataaaaaattttatgtatctagccagttaaaatgcaaacctacatcaacatgcatgcagcagggtaatggtatcgcttttattttaaaataagcttatacaaataaatgaaaatgaatatatttaaatagaagttcatgttacaacatctttgccaaaagtctaaaataaaattaatttggaggaagtcattgcaacagagaatgttttgctaagaaatatatttggtatactccatttattcattttgtagtgtaaatttaaattcagcacaatttagacagactaccggtttaatgaatattatcatagtgtttcagtcttcctaaatataaatgcatatgccattcctatgtcttggctacttctgccctgacagaaaggcccaccaatccttactgataacccaacagagtctctgcacgtctgttcaaccatccttgggtcccaaatctattccaaacctgcagattatttaatatcacagttcgctgcacaggtctcttttcctcttgattttgatcactgtctattcagatagtctccaagccccaaaggaaaatatataacttcccaatttccacagctaagccttcaccagaaccccaaacctcatctcctaaagtgtcttctaagatctccctgactcaattataattatttcttctcatcttgaatagtaccctctccactggcactttctcccctgccttcagtcatgtacagtgctcccttatcttgaaaacctgtcacttgatcctgctgaccaatttaccatcctatgtctcttcttcctgcgacacattaaaaaaaaaaagtcccatggtctataactattgccaatggttccttaccatccattctatcaccccagaacaacctggctcccaccctcccaccttctgtggaatttcaactaaagacctaaccaaatataatggtcttttctcagttcctgttctccttgatatttcagtggtctgttgctgctcacaacatccttcttcttgagattccttcctcccttttaacattgttcctccctagctgtctgtcatctttgtctctttcaaaggttcccttctgcatcttgaatattataacttaacgtttctgctcctctatgtacagttttctcattcagagacttcatccactctgaaggctcgaagctcacctctaagcagatgacttccaaagctaactatttaactcttgcctctctctactccagtcccacatttcttacagtctgatggcaattacgacctgagtgtgctatcattatcttactctgtctaaaaacaaactcacatctttttcctcaaaccaccaatgactctcctattttttattttattaccacattgctgagtcattcaagacagaattttagtcactgtcatgcaaccctccttcttcctaaaagcaaatcatgtcaaatcttccttcacagggtcttttgcatctgtccctatatttatctccattgaaacacccttgcttagtcccttaatgccttatatgtgcactagtgtaacagccttctaaagaggagtccatggtctctccctccatcaattctctcaaaggagaaattgttaaataagaagacagtatagaaagattatgtgagaaataaaaatttgccataaggttaaaattgtaaaattgtaaaaatgatactttgttcatattttgcctgcctttaaaaaaaaaagattgtttgttgcttatgaagcaaaatataaaccccatataaggcccattgaacagcctgtaccatttagtccagaagtcagcaagctatatataactcacaggccacatctagcctgcctcctgtaggtctgtaagtggagaaatatttttgcatttttaaatggttggggaaaatatcaaaagagtattttaaaacaagtaaaaatgatgtgaaattcaaatttcagtatccataaagttttactgtaatacagccaaagttattcatttatgtattgtccaaagctgctttcaccctacaacaatagggctgattagttacaacagagaccacatggcttgcaaagcagaagatattttttgtctgggccttacagaaaaagtatattgattcctgctctagtgcaatcttacctttcaagtcttagctctctcccttctccactgacacataccctctattctagtcttaaaccaatttatttatctgctgattttcctacctttatcctttgcctcataccattcctttagtttggattgttccttctagcccctttcagggtaatagaaactccattcatttttcagggctcacactttgtatcttttaataaagatttccttgatcaccatatctaaaaatgcccacttcttttgtttcttataatatcttctagaccacttaataaaaatcaataaatacaatatactttatctccctaactagactgtaaatttataggaaaacatggtcagcatcttatcatttttctatcccttagagtagtgagcctagaaccctgtgtatagtagctataatttgttaaaaaattgtgatacttttaaaagaagttatatgggtgatttataggatttaatacttgttgggttaaagaaggtatttgattaataaaagctatgcaattctaagctagaaagcagagataaactacatacttcttttattctctaaaattaagcaaattatataaaagttcctaaagtgatgtgataaggtgtggcaagttcaaggtaaaaaggtcaggatttgatctttttaccttgaactcataacaacttatcatttaacggtttcttcatatcttattccaaaaataagactatttttatacatgtgtatgatttttggctatggggataacatacgtgtgtactcacatacctactgtattggaaatgtactacatttcattaagaatatcttaaaaacatatgtaatccccaaatgttagattaacttgatttgcaggtttaagcagtctcataaaactcaaagaagaattacataactctagaactcaatgttattacttatataatttgttttttgtaagtttacctgttcataaagaaggaagatcttgtctctctcagatttaagaaccttgacattaccctgaatttctgccaaatggcgctcatatttttccagcatgcatttaagttcttcacgatctcttgttgttgtcttcaaaagttctacatcacagtttgcaccctataattatataaggaatttgaaatcttctttgatatatagtactgatagaaaggtgctactgatggtagtgcccaatttctatttaagaaaataagactatataatgaaaggaaattataaaaaataagtttaaaaaccacatctttttaaaacagcttcattccaaattattccacatttgcctgattacctcccaagtgctaattatgctgaggataaagaaccaatatcagtagtctactgtgccatcaaagagacctctgtctctcaacccctttgaaacagcaattcacagcaaatcaaaacaaattattttcaaattaggtaaaacaaagaataaaagccagtgtctgggcaacaaactccaaaatatttgtaagtttataaaacctacccgggcagttggtgatgggcgtcttggacttttagacctacttcgcatcatctttctcaaatgttgagcttcactcttatagtgatctttgtctgcttccaaagtcttgacaaaggaatcaagtctagaaggagatttattttgtgctttttcagtatctaaaattatcttgccaaagaggaaaaaattagaccattatttcaagctaaactatagcatcattttctaagtgaaattgaaaacaaacaggatccttaaaaacatttaatttggtattttttaaatacaacatttaaaaaattatatatcagtaatttttaaaaagcagttagatatctttcttttccaggatttctgggtatgctatattttaactgaaagataattttggagaaaaaatggtaaagaaattttagagaggccagaaatgtccacagacctagcacacatcctagaaatggcatggatttgctttagaaaaacatatgctactaggctgggcatggtggctcatgcctgtaatcccagcacattgggaggccgaggcgggcagatcatgaggtcaggagttcaagaccagcctggtcaacatggtgaaaccctgtctctactaaaaatacaaaaaaattagctgggcatggtggcgtgcacctgtagtcccagctatttgggaggttgaggcaggagaatcatttgaacccgggaggcggaggttgtggtgagccgagaatgcgccattgcactccagcctgggcaacaaagcaagactccatctcaaaagaagaaaaacacatgctactactaaagcaactgttatagcatctaagttttgtccaatattgttcaatgcgtgaataaattaactgaatgctggatattccatacttgtaagcattcccacaaatttgcattcactttcatatatttagaaacacttctttgacaacatttatttaacaatactttattgggagaaaattatagatatactttcagatagagggttttaaatattttaaataacactaaaatgtttaaacagaacagttttcatttcacattgttagataaataaaacattgtttggaattatgtaacaaaatttatggcttaaaagtatttactattaagggggataaaagttaatgtgtaaacaaacttcatattttgagaattattcagtcatcattttaaatcaattaacagataaggacattaataaaaccaaccaaaagttgttctttgcctctaggaaacaaaggaatagtgatgaaagcagcaaaaaaaagtcactcttacagatgggggttcccctgtgtccctagcagttggtgcagattttagaaaacaaacatattttattcctcacaaaacgtgtgagagccaaagatataattttttatagcttactgaccaaataaaaatgattccgtaacacatatttatgaaaaatgtacttacagatttaagcctttttattgtatcttccaatactataatattattttgctggcaaatgagatcaatctgaagaaaaagtaaaaaaaaaaaaaattatttctattaaagatgtttaaactaattggaaaaagaacatcaaaaaaaaggaagccacttaaaataaaaacatgaaggcagtgaatattttaaagaagaaataacctgtttagcaacctttgatgataaaagataaaagatgatttacccagaatgaaataacaattctcttaaattcaatcttttgtataaaatgttaattgattgtattttaccaaattattccccataaactggaacaaaatgttagtactaattacaattctgaagataataggaaagcaataaaagaatgactagaataaaataagttgacccaaattaccccattcagaaaagattgctttctcttctgaactcaactgcttagttcaattcaatccacaaaatactttttgtatcaatttatgacagtgaacatacccagtcttataagataggtacctatagtcatatatttagcatatgactacattatatgttcctacaggacagtgactaagtttttatgcaaagcagtaaagttctttgctaatagcatattcacttaatgtattttgcaattcatcaacctttccctcattattctaaactgcatcctgatcttgcctactacatttttaatttgaattctctggaattattgtacttcatttgtcctttagaccaacgttctcttctacgatttttctggcagtcatattttaagtttatgaaatattaaggggtgctattatttgcaacgtttttctcacaagtgaagtacttagaaatagaacataattacatagagtttggataaccttatgtatagccttgaatagacaattttcaatgttttaatgtatactactaagtagacactaaaaagatacaggtctactctgaatgtgttaagatttccacattaagtataaaaattcactctgcaaaacagagtatctggtatgacacattctcataaaaaataaatttatacgcagacatcctacatataaacataaccaaataaactgaagattatgtctaggtataacaaggtatgattatggtagatgttattttcttcatttacttttctatatggactaaaattttgtataataaatatgcattaattttacagtgatttaaaaaaatgttgattccactctgaaaaacaaaataactggcccaaatgaaaaactgctaactcagtgttttcacttacttaacaattaatgaatgcctactacctgcctgccattgtgttatgtgctgggtaaagtaatgaataaaaaaggtaaaaatctctgccctcatgtagtatatattctagccaaaaaaagaaaaacaaaagataatagtcaaaatatgttagtgattgcatccctcaaaaaaataatacaaggagcgctcacgttctaagcacttgagttaagtaaacaagagagacaaagatttctgcctttgtggattctacattccagctagaatagacaataataaacctaacaaataattatatagtatactagaaaaagaagagcagagttaaggatactgggaatatttatggaggaacaggttggaattttaaatagggtggtcaggaagtcctcattgaaaggtgacctttgaccaaaaacttcagaggaaaggaagtcaatcatgtgaaaatctgggcaaaaaacattgcaggcaaaagttacagctctaacaaaggtcctaaggcaaaagaaggtctggttggttctaagtatggagaccggcatggctggagcacagtgagggaaggggaaaggaacagcaaagtgctacagggaaaaataaagcgaaggagaaagacagggagtgtgtgcagggaatgtggggatgggtatttcagagcccgctgtgtggaagacattgtgtaaagtctttgttgtcccccaccccaccctttgtttgtgggggacaaacaaagactttacacaatgtcttccacacagcgggctctgaaatactttttattgaatcacacacaaaagtaacaataatgataaggactatcagagatccagtccagtaacatagcccctaggtcaattaaaaatataaattataggaagaaataatggtaaaattttaattctgcttcacatttcatagtgtcatgttcaattatctgggaaatgccatgttaacacatgaatgataaacaactcaagatgagagaataaacgaaggcatatagttgaggtggttttaatgtatgtccacaaattctaatactccttccttcaatagctggagcttaatttccctcccctagagtgtgggttatacttagtgactcacttttaaagattagaatatggaggaagtgatgagatataacttttgagactgggtcatgctaagccctgcagatcctccttattatctcttggattgttggctgggggagaggggaaggtggagggagaataaacttccacaaagaatacatgaagcaaccctagagagaggtccacctagcaaggaacaggcctcctgccaatagccaaaagccatctgagtgagccatcttagaagtagatcctccagtagcagtcaagccatgactgtggcaatcagcttttttgttgttgttttttgagatcgagtctctctttgtcatccaggctggagcgcagtggcgtgatctcggctcactgcaacctctgcctcccgggatcaagcaattctctggcctcagcctcccgggtagctgggattacaggtgcccaccaccatgcccagctagttttttgtatttttagtagagaccgggtttcatcatattggtcaggctggtcttgaactcctgacctgaagtgatctgcctgccttggcctcccaaagtgttggaattacaggtgtaaaccaccagccctggccatcatcttgataacaatttcctgagaaacagtgaaccagaacaacccagctaagccactcttgaattcccaacccaagaacctgtgaggtatcaatatttgttgtttgaaggcattaaggtttcaaagtaattacatagcaatagccaatagttaatattgaaaatattttaatgaagtaaatcatggaagaagttactgttgacctttaaaaataagactaaaagtaaatacttcccagtgaatacatttaatactatctcaattccagacaaactaacagtagctttagcctcagactctacctccgcatacccagagtataatcttaaacactagaaacccaaatattttttctcagcaatcgaattagaaatcttgtttcaagtgccaccccacaaattaggcaaggaatctctcccacataaatataaacctaaaatgcatatctaatgtcttaggatgatgacaacacacactggagttcatatccccagtgttggttttgcatctttctaatccccattctacttggggacattcacttaactgaggttggtgatttcctcatttcagggcattctaccaacccaaaggcctatttccattttgttctctctttattaagtttctgatgtttttcctgtgtcagcaatggtatctctactccaagacttactgcttacctctttttcacccaatagctttccaaccctcaaatacacccaacattccacattatttatgaagatctattttctagaaatactctttgccaaaccaggcaaaattccacctgtaaatttaatacttacagttttaggtaaatcctagctcttatattttagatgttttccattccaaaaattcttccttttgaaagcagagaatttaccctgacatagtacttactctctctagaacataaaccctaacaaccctttaaaagtgatgtgatgacttctaaacagggcattctcattgttggaattcagtcaacttggtttcccgcagtctgggaaggagtgcagttaatttttaatttgaaaacaaaaacaaggaagacatactaaaactcttcaatattgatatatatatatttttttgagataaagagtctcactcttttgctcaggctagagcgtgacgtgattttggctcactgcaacctctgtctctcaggctcaagctattcttgtgcctcagcctcccaagtagctgggattacaggcgtatggcaacacgcccagctatttttttgcattttagtagaaatggggtttcatcatgttcaccaggctggtctcaaactcctggcctcaagcgatccacctgcctcggcctcccaaagtgctgggattacaggcataagccaccatgcttggcccaattttgataatttttataattaagacagatggaaatcaatttaccattaaactgtgaatgttactttaaaaaaagtaacaatacattccacctgaagtggcattaaaaaattaagttaaaaaaaattttaaagtaacaatacaaacaaaagtattgaaaaatgtttaaaatattcaagctacttttaaatatccttcaaatactttaacagcatccatttgaagataaataattcaaaagttaaaaacaaatcattcttatctagtatttcaagcagttctaaggacctgttccagacaacatggttaaagaagactgtatccttaaagtaataactcgtgtatttaaatattgcactattatggccaggtgtggtggctcatgcctgtaatcccagcactttgggaggccaaggtgggcggatcacttcaggtcaggagttcaataccagcctggccaacatgatgaaaccctatttctactaaaaatatgaaaattagatgggtgtggtcgtgggtgcctgtaatcccagctactcgggagactgaggcaggaaatcacttgaacccgggaggtggaggttgcagtgagccgagatcgcgccactgcactccagcctgggtgacagacggaaactctgtctcaacaacaacaaaaaagttctattatttgactttccactaatttaaactcatccattaagcagtctcaatgaggttactgcataaaaatacatacaatcctagaggtcatcaattggactcatatttcaaattactttaacagtgacttcaataacgtttcacctgataatttaattgctttattatttgctataagagtcctgttacattaaaagaatgtttaagaaataacacgtaataacaattagctttgggaaattactctgttacagacacaatttactaatttggtgattaataaaatcaagacaaataagcatgttcacaagctatcatttaaaaattcaacaggttgttttttggccttcaaatatgctctatcttgcttatcagccattaggcagcaatggagaagtgagactgtcattttataattacatttaatctctagtttctaaatttcatggcaaagtactcaatcaagaaaaaaaatgttgatcaaaatatcataaagctacagtaactaaaacaatgtgatggtggcacagaaaaaggcaaatgaatcaatgaaaacaaatagtccagaaagtcacagatatctgagaatttagtatctgttaaaatgatatgtcaagtcagtggagaaaggactaggcaaccctacctcatattagaacaaaaagaaactagcagtatcaacagaaggaaaactattaaaaagtattaaaagaaaactttagaaagtatatctgtagttcttgaggtgaaaaaaaaaccttcctgaacaagaaccaaatctcagacatcagtaagaaaaaaaaaagattggcaaattttcaaatgttagttaaaaaaaagttttaaattgactttttattgatacataataatggtacatgtttatggggtacatgtgatattttaatacatgcatcaacgtatactgatcaaatcagggtaatggggatatccatcaccttaaaaattatttctttgttctgggaatactccaaatcttctctttcagctatttttaaatatgcaataaattgttaatgatagtcaccctactgtgccatcaaacactagaatttatatcttctctataactgtatttttgtaccaattaaccagccttgattccatatcttggctattgtgaatagtgctgccataaacacggaagtgcagatacctctgtgacatactgatttcctttcttttggatgtatacccggctgcggtgttgctggatcacatggcagttctatttttagtttggtaaaaatcttttttaatgggtattgaaatcaattacatatgtgaaaatagacgaaaataaatgtatctattagtttgtagatatctctgcagaggagagaggaattgggaagtgggagcaacatttagttcacggaacattcctgttgctttcaaattttttacaatgactgcatattacttaggaaatgttttgagtagaatttgttaaaagaagtaaaatgtgagaaacaatttaatccttagaacagacatttaaatatactgtcaaatctaaaaagcttccaaattatacaaatgagaatgctactttttccattgcatttaaaaattacatgatgtttaaagtaaaattaaaatccttatccgtggtaaatctggtaccttggcttcttcaagttccttgttggcggaatccaccacaaaatttttctctttttcgagttgctctgctagttggtcaattttaatcaattctttacaaagatgctcattgtggctggttaaatcatctacttgactgcttaccacctccttactatccaagagtttcctaacatattcttccaagccatgatttgtctgtttgagatcttcaatctgttattatcagaaaaaaaatcacattaaaataattccttagcttttttctggggagcagctgtgtgactggaatcaggaagggagatttgcttccctggcaaagaaacttaactctatacctttttgtgccttctgaattttgtaccatgtgaatgtattacctatttgaaaaaatatattaaataaacattttaaattttatagcaatatctttcaagacaatttatagtttattttaaaaagaacttaattactattgatttttagccaatctattagaaaaatggccaaatatttatatctgcaataaagaaacttcaatagctttgaaattaattttaataccattaagagttcttttaattaaatttctaattattgttattaaaatatattaactcttttaggccaggcatggtgactcacacttgtaatcccagcactttgggaggctgaggcgggcagatcatctgaggtcaggagtttgagaccagcctcgccaacatggtgaaaccccatctctactaaaaatacaaaaatcagccgggcatggtggcgagtgcccgtagtcccagctacttgggaggctgaggtacaagaattgcttgaacctgggaggcagagattgcactgagcccagatcctgccactgcactccagccttggtgacacagcaagactctatctcaaaaaaaaaaaaaaaaaagtatatatacatatatatatacgtatatatatgtgtattattaactttttaaaaagtccttttgaaagtatcagtaacttacttgactaagctaaatatcaaatcaatcaagtatttgctgcctaatgtggaggaacacagctttccttcccagcccactatcaaaccatcaatggatgaagaaaagggccttttctatcacaaaggtatccaaatgcctttaaaggaaaaaaaaaattagacccattgaacaatgattatgtcaggaactatattaaattccaaaaatacaaagataggttagatacctgccctcagggaactctttgtttacttgaggaaatacaaagacaacatgttaagtgcaataacaaaaataactacgaggtaaagtcatggtacaaattcttttccatagtacttgtctctcattgtgtatttaacaaatatttattgagcacctattgtgtctaagatactgtgttagtaccctgtaaaagatgcattaaaaacaacagcaacaaaaaaaaacactcgcacacagaagtttcagtctgtaaggagcatctgaaattgctaaatacctgacctcttagttctagcattattcttgccctgaggttgcccttttcaaacagctatagagttatcgtcttccaaaccattaaaaacaaagttgtcttcaaaaaaactttataagttgtcactacataaaaatatcctaagtcatgaattatttttaaatatgctacaatgccatttattgtacccagtaaatagcccaccaagaggcataattaaagtcattattttaatccagtgtctcctactctcttctcttttggccttctcccatctgctctcaaaaattcttcgaaaatgcaaatttgaggtcattcctataaccttatgttgcctcatgacactgagaatgaaattttaaaatgccatttatgatccaactcgacttagctgtccaacctaacttcccaccaccagacacactataaaaaacaatctcattaaattcatttaaaaacttcttttaggggagttattgaaatgtacacacttgaaattgaagtgttatcaaagaaccctccttatgagaatcctcaaggaaaaccctacttaggcttcaatttcaggaaaatacgtgccttttttggaaacctggtttgttcttaccctaacaatcattaattatttaactaatatttctatttgcctttgcctctagaaattttaaagcttaatccaaagcccacctctagcaacatgcacagaaactaggtacaatgatctgttcgttattgtcatcccaggctttcactgtttacttattttaccctacccttattatttcagctactttcttttaaaacaaacagacaaactacaggacgtgaaacagataaacttcaagttgtgtttttcatctttgttcgtggcttttcctatgccatgtttctcagcaacaagagcacactaaaaatgtctgttaacttcccactgcaccaggagatgttcttggtgcttctcctttccagtatgtgtgcccataaagcctcttatataagtttatctcaatattttataagatgcattaaaatcatttatttccctgtcccttctactagattctaaacaacttaaaagactgtattgtctcatttctgtatcaacacatcacttgtttctgcatcatttattacgtatctcacatataatcctcaaattattaagtaagcaaataaaacaaattattagtaatataaatgaacactcccctcccttctctcatgaactttacttttactcaattccaagacaaaagtactttagaagaggcagtctggagtaacacaaaggatatgggctctggacttcggcagagttaggtttaaatcctgttgtagttctttaccagttatgtaattggggaatttaccatattttcttgatcctagaagatgcacctgacttaagaaaaaaaataaatgagagtctcttgagtttcttctgttaaagggacagaatgcctagaatttgcagaattgtcattagacattatataagagctcaagtaaaatttccagtattataggtactcaattagttttgttaaaaatttttatttttaaataagattcacaggaagcaaatgtagtacagagaagtctcatacgccctttactcagtttccgctgatagttgtgtcataaacaacatagtatatcatacccagatacaccatgtgcatggtgttctatatgatttttctcacatgtgcagatctctgtaactaccacctcaagatatagaactgttccattacaacgagaccattcttctgctgcccctttatattctccttccccgccctcaattcttcccaccaatgtgtacaattttgtcattttgagaatgttacataaacaaaatcatagagcatgtgatcttttgagattgctttctttcactcagcacagcgtcctttagatccacgcaagttgttatttgaaccaaataggatcattcctatttattgctgaataatattccatggtatggaataccacagtttaaccattcaccaattaaggaaaactggttgtttccagtttgggaatataacaaagccgctatgaacaactgagtaggatataagttttgagtagatataagttttcctttctctggaataaatgcccaggagcacaactgctgggttgtatggtaaatgtatgtttagtcttaccaaaaactgccaaatcattttccagagtggctgtaccatttcatattcttaccaggaatggatgagtgatccagtttctcctcatccttgccagcatttggtattgtcactattttttattttagttactgtattgttatttcatcatggccttaatttgcattcccctgatgtttacagaggctgaacatctttttctagtataccagacatccttctgtgaagtatatatattcatatatatatatgtgtgtatatatatttgagacagaatctcattctcacccaggctggagtgcagtggtacaatctcagttcactgcaacctgcctcctgggttcaagtgatcctcccacctcagcctctcaagtagctgggactacaggcatgcaccacctgcctagataatttgtgtaatttttagtagagatggggttttgccatgttggccaggccggtcttgaactcctggcctcaagtgatccatccacctgccaaagtgcagggattatagccacgagccaccacacccggccaaaaacttcaattttgattaagtccatattaccaatttttccttttatgagtcatgcttttggtatcatatctaagaactttccatccaagcctaacttcctgcaaattttctcctatgttacctcctaaaagtctcatagttttatgttttacatttacatctatggtccatttaattttttatgaagtgtgagatttaagtggagggtaactgttttccctgtatctaaatgctccaacaccacttgttgaaaagactatcttccactgaactgcatctgcatctctgtcaaaaaatcgtttggctgtacttgtataggactatctctagattctctgttctgtaccattcatgtatgtatctatccctcaccaatatcacagtcttgattactgtagttataagtgttgaaatcatgaagagttttgtttttggtgccttcctgtggattatctcaacattttttagaattctacgttgatttatttatagtgtttctgagtgtaactcttgtttgatctttttctaccagttgttctaggcattacattatatatacagaacttatcatagcctacattttaacagttcaagtgaaagtacagaaaccttacctgttagctccctttactctcccctattaataaaataatttaaatatttcctgtacatgcatttaaaaccacattcgacagttaaatacaattttgtaaaattaaaaaaaaatttgaatcggagtagtggctcacatctgtaatcccaggactttgggaggctgaggcagtggatcacttaagaatgggagttcaagacaagcctgggaaacatggcaaaactccatctctaccaaaaaaaaaaaaaaaaaaaaaaaaaatcagccaaccatggtggtgcatgcctgcagtcccaattacttgaacggctgaggtaggaggattgcttgagcccaggaggccaaggctgcagtaagcagagatgatgccactgcactacagcctggatgacagagcaagaccctgtctccaaaaaaaaaaaagaaagaaagaaattctgtttcatttacccatattttttgctctatatattgttcttccttcctactgctccaagattacttcttttatcacttcctttctggttagagaaatacttttagctattcttttagggtagctctgctggcacaaattatcttaatttttctttatctgagaatgtctttactttccctcaaccttcaaggatactttctctggatataaaattctgagttgacaggtttgcttttttctagcacttgaaaaatgtcgtgccacttccttcttacctccagtttttcagatgaaaaataactgctgtcacttgaattggtgttcttctatagataatgcatggtttctctctggttactttcaggatttttttagtgtcttggcatgcatttctttgggtgactcctgttaggtattccatcaccttctttcatctgttttatgtctttgtgtcaaatttgtgggaaattcagccattatctcatcaaatttttttagcaccactttctctcacttttttgtcgaacatagttttacctgtctctgaggctctattcaaatttttttccatctattttctctctgatgttcacattaggtaattatttttctagtctcgtgttcactgattcattcctctcctccattctattgagaacattgagcttttattttcagttactttatttttaaagcttgttttattgtcacaaaatatatatacataattttcattttaacatttttaaagtatataattcagtggcattaagtatattcacaatgttgtacaaccatcaccactacctatttccagaatttttttattcccctcccccaaaaaactctgtacccattaaacaacaattctatctccataatttgcctattctaggcagaggtggaatcaagcattatttgtcttcctatgtctggcttattgtacttagtatgtttttgaggttcattcattttgcagcatgtatcagaatgtcattcctttttgaatctgagttatattccattgtaagcacatgccatattttgtttatccattcatttgttgacatttgggttttttctacctcttggctactgtgaataatgctgctatgagcatttgtatatacgtatctactggagtccgtgttttcaactctttaggatatatacctaggagtggaatagctggatcatattattagtctgtctttaaaattttgagaaaccatcaaatgattttcaccaaggtggctccattttacattcccatcggcaatgcaagtgttccaatttcttcacatcctcaccaacacttgttattttccattataacaaccaccctaatgggtatgaagtggtatctcatggttttgatttgcatttctttaatggttgatgatgttgagcatctttttcatgtatttattgacatttgtatatcttctttggagaaatgtctgttcaagtcctttgcccatttttgaattagatttttctggggggaaaggggctaattgtaggagtcctttgtatattctagatattaagcccttttcagatatgtaatttggaaatattttctctcatgtagttaacagactaagtttttggagtagttttaggtttacaaaaaattgattaggaagtacaaagagttcccacacactcctctctctcttcctcaacacagtttcctctattatttacattttgtattaatgtggtatatttgttacaattgatgaaataatactgttacattatatatatatatttttttgagacagaatctcggtctgtcgcccaggctggagtgcagcggcatgatcttggctcactgcaacctctgcctcccgggttcacacaattctcctgcctcggcctcctaagtagctgggactacaggcacccaccaccatgcccggctaatttttttctatttttagtagagacggggtttcaccgtgttagccaggatggtctcgatctcctgacctcatgatccgcccgcctcggcctcccaaagtgctgggattacaggtgtgagccactgcgcccggcctactgttacattattaataactagtatctataacttaccttagggttcactcttggcgttattcattctgtgagttttgacacacataggatgacatgtatccactattagtatatcatacagaatagtttcactcccctaaaaatcctgtgctccacctattcatcccctctccctccaattcctggtaactactgctctttttatggtttctatagttttatcatctccatatagttggaatcatacatttcgtagccttttcagctttgtaacatgttttcaaggttcactctgggtcttttcatggctacgtagctcatttttaaaatacactgaatactattccactgtataggtgtacaacagtttgcttatccattcatctattgaaagatatcttggttgcttccaagtttttggcaattataataatgctgctataaacattcataggctgatttttgtgtggaccagttactttattttttagttccaaaatgtccatttggttcttctttacatctcttattttttcctgagacaacttttcttcattcgtttccagcatgttcataattgcttgctgaagcatttatatgactgctttaaagtccttgccagataattgtaacatccgttccatttcagtgttggcttctcttgtcttttctcaaatcttcctgattctttggattacaatgccttttttaaaaattgagacctagcattgtaagactctggatcttatgttttagcaggcctcctgtgacaatgctccaactaaaaagaagggacattgccttatttctgttagatcaaagtagaagtccagttcctctacttggcatctgttgatatctggaaagggtggtgttcctagatactgctaggcaagaatgggagttcaggctccccactaggcctctgccattaccaccagcctgggaagaatcccagaggtgcctcattacagttccctacgtgtcccccactgacaccatggatgggtggcctttactgctgataggtggtagaagttcaggtctccaccacagcaagaaggagtgcctcttactataaagtaggagtagatggcttggctcctcatgttgtctctgctgacatcacggggttcagggcctccttatcccctggtgaggataaaagtcctagtttcccacttagccttctctgatatcaccctggtgtgggaggagtgggtaggtgtaggcacaagtggggcacaagtgtgtaggtgaggcacaagtggggctccttgttatagtctggcaagcgtggaaagtgtaggctctttacttggcctgagctggcaggaatggggctgtagttttttctgtggtatttgcttggagtggatagttactctcttaaaagttgtctgccttgataggctgctcctttcctggtccttttcttcggtctttcttttgtgcctattgttatttctagttgccagtttttctagcagctgtctgcgacatacggagaaaaagaaacccaggaacaaacatgttgttctttgtgtcttgagatccttagccaatgttccttctcctctccacctttcaaagtcttaaattcttttatacataatgttcagagtttttagctgtacttagcaggaggaataaaaaaaagtaagtctactctatcttcctggaaaaagaaatctcttttaatagcctttattaatagctatattacatgtcaagcatcaggagaacaggaacaatactgaacttgaagttcagagaattgagttcaaatcccggctaacacgggagtttggagaaatcgtagttctgtcacttgttactcaagtgtcataattatttaacctcttagaacttcagcttccacatctataaatggaaacggcatcactttttcgcaagttggggatgattaagtaaaaactgtatacctgaaaacatctgacacaacacttgacacgtagtttgcactcactgactctgactctatgtttatcaaaatggttaagataaaaattgaatgattttagacccataacatttaaatgagctctgaattagtagttatttattctctatcttcttgtttcaaaataggctcccaccccaaattaagtcaggaaaatatgttgtaactaaacgcaacctgtaatttcagtgtcgagatgaatctatcttggtttctcacttcttgttctagctggagagtattctggtagttttcagcttcagaaactggagcccctagaccaaaatcatattctttggtggtaacctagtacaaagaatgggaaataatacagaggcattcagtttaaaacagctctgtgatttcttacatcaatacattttgaaaattgataatattcttagattttttttaaccatttcccaccagctaagaggatttcatcaaactttaccttcttaaaatttataaaactttttctgtgtgttgtccaaatggtactgaacatgcttttcaaagacattccctacactatccttttggtaatcatggttctacagaaatatggatcagtagcaaattaaagagtctacctctaggcttgtgttgtccaaaatagctattagtgagttacgtttgctgttgctactctatacaagaaaaaaggtttgcaattaatatcacaaagagtgaatttcctgaatatagaaataatccctagaaataaaaaagattaaaaaagtactctaatagaaaaattggcaaagaatgtgaacatttacagaaacggctcctaaatattaagatgttcaatctcaacctttagtgacacaaattaaaacactgagatacccccttttaaccatcacatggcaaagatcagtaacatggatatagcgtccttacgtatcaccggtgggagagtaaactgatacaatatttatggagaacaatggtataaaatctatcaacatgacaaatgcacatagcttctgttcaaataatttcatttctagaaatttatactacagctatatatatgtacacttatgcaaaataacaaatgttagagatttttcactttagcatactatacatactattctgcatcacgctattttacttgacaacatatcttagagactgtgtaacttaggaaaacaattttttctttccttgaatcaaggctaccattgtgttaaaaaagaatttgttatgagcatcttagatctttcctcaaaacacagctgctgttctccaaaatcctacctagggaattacagaatcaggatctccccagtcactgaccttatgatgcactctgtgtaacccagcacttagacaggccggcagatttatttcccttttttctcttctctaaacaagacacaactcttcttcattgcaacagttactgccccacctggaacctcaacattagatctcacagaatatttcaaattatgaagcatttaaacccccaggggctggactgaactcctaactaccatttcttacatggtttctgttaaaaatgtattgctagttataaacatgatttagaataacagaatgaaacgactcctcactagagcagtactgttcaatttttactgaatttaagaatcatctgggaatgttgtgtgaatgcagattcttatttacaggctgagatttgacatttctataaagctgcttggagatccctatttggttggtacagagaccacatgttgaatcatgctgtgctgtaatttctgatttatttgaatagcaaggatctatttaagtctaaacccatccaatattcagagtacttctgtaattttgtcccttcctacttctccaaatttacctcctacttgatacctccaagaatccctctatgaaagacaaactatgcaacacttaagggtctcaccctgtcacccaggttggcatgatcacggctcactgcagcctcgaaccccaggcccaagcaatcttctcaccctagcctcccaaatagctgggaacacaggcatgtgccaccacaattggctaattgttttaaattttgtagagtcagggtctccctatgctgccctggctggtctttaactcctgggctcaagagatcctcccgcctaggtctccctgggattacaggcatgagccactgcacccagccaacacattcttaatacatatattcaaaagtattttatcatctgttcaatgagccttgccctcactattttctccatttaacttaagacatttttaaggctcagctggaattccatattctccaggttttctctgtcttctccactgcataatgatcatctcttaattgatatttatatatatagaagaatttatgttctaaatttttctggatgtcttcctcacacatttattagactcttaagaacaagcaatgtccaaaaactctctctatccccattaacctgcacagttatttacgtaataaaaagtgtcaaaaaatttgttgaggttgataatgaagcagtgtgataaagcatacaaaattaaactttcttcctcctctttggtaaaccgaataaagtggggcttttgcaaaattacctatcaggcccagctaggaattaaaaatagcaagagaccacaagtccacctgacaatcctaaccaatcatgctggagttgctatcctccctccaccagctttgggggcaatatcactagaggaaagacacatcagtgtatctgaaattcccatgcctggtctgccagcttccctacctcaggccacataaatatcctcaaccttgctgcaatctcatcattagaatggaacttgtgctcctgtaccgttctcagagaaggcaagtgaaacaatgttccttcttaaaaaaaattattttttcttttttatgctatccctcccctaggcccccaactccctgacaggccctggtatatgatgttcccctccctgtgtccatgagttctcactgtttaactcccacttatgagtaagaacatgctgtgtttggttttctgttcttgtgttagtttgctgagaatgatggtttccagcttcatccatgtccctgcaaaggacatgaactcatccttcttaatggctgcacagtatccatggtgtatatgtgccacattttctttatctagtctatcattggtgggcatttaggttggttccaagtctttactattatgaacagtgctgcaataaacatacatgtgaatatgtctttagagtgacttataatcctttgggtatatacccagtaatgggattgctgtgtcaaatggtatttctgattctagatccctgaggaatcgccacactgtcttccacaaattagttgaatttacactcccaccaacagtgtaaaagcgttcctatttctccacaacttctccagcatctgctgtttcccgactttttaatgatcgccattcaaactggtatgagatggtatctcattgtggttttgatttgcatttctctaatgaccaatgatgagctttttttcatgtttgttcgctgcataaatgtcttcttttgagaagtgtctgttcatatcctttgcccactttttgatggggtcgtctgtttttttcttgtaaatttgtttaagttccttatagattctagatattaaccttttgtcagatgggtagattgcaaatattttctcccattctgtgtttcctgttcactctgatgatagtttcttttgctgtacagaagctctttagtttaattagatccatttgtcaattttggcttttcttgccattgcttttggtgttttagtcatgaagtctttgcccatgcctatgtcctaaatggtattgcctaggttttcttctagagttgttatggtcttatgttttatgtttaagtctttaatacatcttgagttaatttttgtataaggtgtaaggaaggggtctagtttcagttttctgcatatggctagccagttttcccaacatcatttatgaagtagagaatcctttccccattgcttgtttttgtcaggtttgtcaaagatcagatggttgtagatgtgtggcgttgtttctgaggcctctgttctgttccattggtatatatatattggtatatatctgttttggtaccagtaccatgctgttttgattactgtagccttgtagtatagtttgaagtcaggtagcatgatccctccagcttcgttctttttgcttaggattgtcttggctatatggggtcttttttggttccatgtgaaatttaaggaagttttttctaattttgtgaagaaagtagatggggacagcattgaatctataaaatactgtgggcagtatggccattttcacaatattgattcttctgatccatgagcatggaatgtttttccatttgtttgtgtcctctcttatttctttgagcagtggtttgtagttctccttgaagaggtccttcccatcacttgtaagttgtattcctaggtatgttattatttttgtagcaattgtgaatgggaggtcactcatgatttggctgtttgtctattactggtgtataggaatgcttctgatttctgcacattgattttgcatcctgagactttgctgaagttgcttatcagcttaaggagattttgggctaagacagtggggttttctaaatatacaatcatgtcatctgcaaacagagacaatttgactcctctcttcctatttgaataccccttatttctttctcttgcctgattgccctggccagaacttccaatactatattgaataggagtggtgagagagggcatccttgtcttgtgctggttttcaaagggaatgcttccaggttttgtccattcagtatgatattggctacaggtttctcataaatagctcttattattttgagatacattccatcgatacctagtttactgagagtttttagcatgaaggggtgttgaattttatcgaaggccttttctccatctattgagataatcatgtggtttttgtcattggttctgtttatgagatggattatgtttattgatttgcgtatgttgaaccatacaacttcatcccagggatgaagccgacttgatcatggtgaataagctttctgatgtgctgctggatttggtttgccagtattttattgaggattttcacatcgatgttcatcagaaatattggcctgaaattttttgctgttgttgtttccctgccaggttttggtatcaggatgatgctggactcataaaatgagttagggaggattccctcttttttctattgtttggaatagtttcagaaggaatggtaccagctcctctttgtacctctggtagaattcagctatgaatccatctaatcctgggctttttttttggttggtaggctattaattactgcctcaatttcagaacttgttattggtctattcaggaattcaacttcttcctggtttagtcctggaagggtatatacccttccaggaatttgtccatttcttctagattttctagtttatttgtgtagagacgtttatagtattctctgatggtagtttgtatttctgtgggatcagtggtaatatctcctttatcattttttattgtgtctatttgattcttattagtctggctagcggtctattttgtttatctattcaaaaaaccagctcctggattcattgattttttgaagggcttttcgtgtctctatctccttcagttctgctctgatcttagttacttcttatcttctgctagcttttgaatttgtttgctcttgcttctctagttcttttaatcatgatgttagggtgttgattttagatctttcctgctgtctcctgtgggcattcagtgctataaatttccctctacacactgctttagctgtgtcccagagattctggtatgttgtgtctttgttctcattggtttcaaagaacttaattctgccttaatttcgttatgtacccattatcattcaggagcagtttctatacagttgcgtgattttgagtgagtttcttaatcctgagttctaatttgattgcactgtggtctgcgagactgttatcatttccattcttttgcatttgctggggagtgttttacttcaattatgcggtcaattttagaataagtgtgatgtgttgctgagaagaatgtatattctgttgagttggggaagagagttctgtagatgtctgttaggtccggttggtccagtgctaagttcaagtcctgaatatccttgttaattttctgtctagttgatctaatattgccagtggggtgttaaagtctcccactattattctgtaggagtctaagtctctttgtaggtctctaagaacttgctttatgaatgagggtgccctgtattgggtgcatatatatttaggataattagctcttcttgttgcattgatcccttaaccattatgtaatgcccttctttgtcttgttttgatctttgttggtttaaagtctgttttatcagagactagaactgcaacccctgcttttttttgctttccatttgcttggtaaatactcctccatccctttattttgagcctatgtgtgtctttgcatatgagatgggtctcctgaatacaacacaacaatgggtcttgactctttatccaatttgccagtctgtgtcttttagttggggcatttagcccatttacatttaaggttaatattgttatgtttgaatttgatcctgtcattatgatgccagctggttattttgcccattagttgatgcagtttcttcatagtgttgatggtctttacaatttggtatgtttttgcagtggctggtatgtttttcatttccatgtttagtgcttccttcaggagctcttgtaagccaggtctggtggtgacaaaatatctcagcatttgcttatctgtaaaagattttatttctcctttgtttatgaagcttagtttggctggatatgaaattctgggttgaaaattcttttctttaagaatgttgaatactgacccccactctcttctggcttgtagggtttctgcagagagacccaatgttagtctgataggcttccctttgtgggtaacccaacctttctctctgtctgcccttaacattttctctttcatttcagccttggtgaatctgacgattatgtgtcttggggttgctcttctcgaggagtatctttgtggtgttctctgtatttcctgaattggaatgttggcctgccttgcttggttggggaagtcctcctggataatatcctgaggatatttccaacttggttccattctcgtcactttcagagtataccaatcaaaggtaggtctggtcttttcacatagtcccatatttcttggaggctttgtttgtttcttctcatccttttttctctaatcttgtcttcatgctttatttcattaagttgatcttcaatctcatagcctttcttccacttgattgattcagctattgatacttgtgtatgcttcaccaagttctcacgctgtgtttttcagctccaacaggtcatttatgttcttctctaaactggttattctagttagcaattcctctaacctttttaaaggttcttagcttccttgcattgggttagaacatgctcctatagctcagaggagcttgttattacccaccttctgaagcctacttctgtcaatttgtcaaactcattctctgtccagttttgctcctttgctggcgagcagttgtaatcctttagaggagaagaggcgttctggtttttgaaattttcagcctttttgtgctggtttttcctcatcttcatggatttatctgcctttggtgtttgatgttggtgacctgcagatggggtttctggggtttctgtgtggacgtcatttttgttgatattgatgctattccttttgttagttttccttctaacagtcaggcccctctgctgcaggtctgctggagtttgctggaggtccactccagaccctgtttgcctgagtatcaccagcaaacagcagaagctgcagaacagcaaagattgctgcctgtttcttcctctgaaagcttcgtcccagaggggcacccaccagatgccagccagggctctcctatatgagatgtctgttgactcctgctgggagatgtctcccagtcaggaggcatgggggtcagggacccacttgaggcagcagtctgtcccttagcagagcttgggcactctgctgctctcttcggagccagcaggcaggaacattcaagtctgctgaagctgcacccacagccaccccttcccccaggtgctctgtcccagggagataggagttttatctataagcccctgactggggctgctgcctttctttcagagatgccctgcccagagaggaggaatctagagaggcagtctggctacagcagcttagccaagctgtggtgagctccacccagttcgaacttcccaccagctttgtttacactcatttggaaatgcagaaatcacctgccttctgcattcatctcactgggagctgcagacagaatagaacagttcctatttggccatcttgccagccactaaaaaattatttttaatttattctttatttttttcaatgtgaagtctaaaataaggaagaacttttattctcaattaggaagtcacacagcagagtggttaatatcatgtattttggtatcagcctgcctacattcattatcctagttctgccacatcttagctgtgtgatcttgggcgacctggttacttctctgactatagcttcctcatttataaaacagggatgataataagagtatctgcattggctgggtgcagtggctcatgcccataatcccagcactttgggaggctgaggcgggcggatcacctgaggtcaggagtttgagacccacctggccaacatggtgaaaacccatctctactaaaaatacacaaattagctgggtgtggtggcaggcacctataatcccagctactcgagaggctgaggcaggagaatcacttgaacctgagaggtggaggttgcagtgagccaagattgcaccattgcactccagcctgggggacaagagcgagacttcgtaccaaaaaaaaaaaagggtctgcatcatagagttgcgtgaggagtaaatgaattaatatatgttttaactttagcacttagaatagtgcctggcacatgataagcactatatatattatttactattattactaattcctctcactgagtcaacttatttaattggctatcaagtcctactgctcttttcactaaaaattatctcagttacatttcttccatccctactatcactgttttagttcatgctttcagactgtagcagtcacatgtattcactttatatgtaaacttataaatagctagaataagaatgaaccagaaatatgtttctggggataaaaagatgtaaaacaaatagaatcttacaatttcaaccctaaatgaatctaggaaagtccagaacaaataaatcagaaattacaccacagcatgattactgctacatcagagtaatgcacacagatgctaaggtaacactgagaaagaagctacaaaaaaagtatttctgccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccatctcaaaaaaaaaaaaaaaaaaaaaaaaaaaaaaaaaaaaaaaaaaaaaagtatttctgacttctacttcttcaaaaaagacttaggatctactcttcattccaaaagaactatgaacatatcccttctggagcacttaatgcattatattacttttatgggatgtccacagccatggctactttaacgtgtctaaaacagacttcctttttttttttttttttgagacagtcgtgctctgtcacccaggctggagtgcagtggtatgatctcggctcactggaacctccacctcccaggttcaagcaattccctgcctcagcctcccaagtagctgggattacaggcacctgccaccatgcccagctaactttgtatttttagtagagatggggtttcaccatcttggccaggctggtgttaaactcctgacctcatgatccacccgcctcagcctcccaaactgttgggattacaggcgtgagccactgcacccggccaagactctgcctcttaatgtgatcaccttaggggttagaatttcaacctaaaaattttgtgaggacacagaaattcggactgaagccacacattagaggaacagaaagaaaaagctattgggcgaacaaagaagggagtactagatcttgtaagtgaagacaagggccaaatcatgtaaggccttacaaagtttggattttatttttaattgcagtgggaagccattggtgtatttttgagccaggatcatcttattataattttctttttcatttttttttccctctcccttctcccctcccacaggatctcattattttgaagtgattgatatgatatcagtgtggagaataggttgtagggagcaacagtggaagcggaaagatagcagggaatggttgcagtattttaggtgggagatgatggtgacttggaccagggaggtggtaacaaaaatatagagaagtggatggatttaggatatatatttgaaccaacaacatttgctaataaattagaagggatttattgcagtgagccgagatcgtgtcactgcactccagcctgggcaacagagtgagactccatgtcaaaaaaaaaaaaaaaaaggcacagccatgatgagttgcctgtatataataggccccagagagctcccttgccccttctaacatatgaggacagagtctgaaggtaccatctatgaaccaaaaaacctcagacattgattctgctggcaacttggatcttagaattcccagtctccagaactgtaagaattaaatttctgttgcttatatgttatttcattatagcagcctgaatggactaagatatttgccagtaacatttgacttcaggtcctctgctcttgcttttcctctctcaggaacactttctacccagcctttcacatggctatcttctcaccctcagctctttggctgaaatgtcagagggtcttccctgacttcttacctaaagtagcctctctcctagtcactctctcaaataagtgataagctatttgcacttatcactacttgaaattatatcatttgctgacttgtttactatctccccatactagaatataaaattcaagagctctaggcttttgtcttgtctctgttttatccctaatgccttaaaagtgcccagcacaaaggtgaaacgcaataaaacattttcaaaataagaaaatttaatgattcgaacaaagcagtttcaatggtgggtgaaaacaagtctgaaggggactaatgaatgaatagtaaagaaaaagaaatggaaaatgtaaacttcttttaggaagcatgattgtgagaggaagagaggtacaacaaaggtggaagacaaccaaggttgtggaaacgtcattatgggaagagaaaaacttgttccttaattctctttacataaggatcctctttcagaattaaaagtcctgcatcctctcctcagaaaaatgcaaatacacctttacaaacaatttcaggggatttaagactctataaggtccttggactccaggtgaagaagccctacagtacagaaacaatgaagattcctaaggcatgagttaatgttaattgatggagaaagacagctgaggtaataagaggaaacccagataaagatgtattgccccgacacaagaaagacaaaagcaaggacaggtgaagatttagacacttgtaatcccaataatcccaacactttgggaggccaaggccagaggatcacttgagcccaggaatttgagaccagcctggacaacatagtgagttcctgtatctacaaaaattaaaaaataaattagccaggcatagtggcatccacctgtggtcccagctacttgggaggctgagataggagaatcacttgagcccgggaggtcaaggctgcaatgagtcatgatcgcaccactgcactccagcctgagcgacagtgagatcatgtctcaaaaaaaaaaggtaagtgtcatggaaatctgaggaagtttctgtctggttgaattttaatttttcagtgaaacaggagctaagattatataataaaaagtatcatcggtgttgagcaaaatatgaagcacataatatgtattcaacaaattattgattttttgatagaatggaaaatactggagtacttcaatggaattctgaaatctggttccacaaaagcttactacagttgaggtgggtttttctttttaaaaatattgtctccaaaagtgtagacttatagacattgaagtagaaaggaactgcctcactaacagaaggatgtggaaaaccatacaagatttatgaataattctgagagagtattttatataataaaaataagtggataaatattttgggaaacaatcagcaaactaaatactgcgagcaacaataaagattaatcttaaaaaaaatgttgagtaaagaagcaagatgtaaatgaatacttagtacaattccattcgaagttcaaaaacaagccaaactgtaatgtgcatgttcacatacaatgatgtgaaacattaaggaaaatcaaggaagtggctatcttagaagtcaggagagtggctatctctggggagggaaagaaatatgtaatctgaaaaggtgataaatagtaatacctctaactgcctctgtgtatggaggacttcaaaaccaaatcgtcctaaacaaactagtctaagcaactcaaaaagaagacagaaaagatctcccagagaatctctacacctgattatattctgggctacaggcagtgatttttcttcagaaggtaaacagtacgcgagatattgtggaagctgccattaaataatgccaaagtttaggatttaaaattaatatttaattaatgtaccgtcctagttatttcccactaattaagactgaagagtttggctcattaatcaattaaaatacaaacaagaatctgtcttatcctggaagcagattcgaatgcgacatcctacttctataactaacctgtttttttctacttacaaacctattgttattctacttatgtccttacacgtaaacaaagtatacttgaaatgctgaacaccagtacagaaaattttaaacaaggaaatctcctaggatataaggtcctggaatggaagaaggaaaacgttgggacactataatctatgcaaactttcccgaagctgcgaaaaaaaaaaagtgaaaaaaaaccatatttctgtgagtttttaggtatcaagtccatgatcacctagttatccaatttaagtctcaaatagtttttcaacaaaagccagctttccctgcctttactgtgtataatttttactaaaattatctgagattttcatgcaaatgcctatgtaatctcagcctttcaccaccccaagtctagaaagaggctcagaaatgagcgatcgggagtcaggctgaactcccaaatctgtgacttccaaattcctcggctccaccagagcttccagagcgtttctaaactgaacagtctccccaacaaccaagcggagagctgcgggaggacgcgaagcagtgaccataggaactgggctcaaacctaacctcccaagaaacaggggcaactcgtgctgccgagcttccggccggcagctgtgcccgccgctgcccctcacagccgctcccgctgctagcgcccaactccgcccgccacggccccgcacccgccactcctgcccgcttgcagccgccttctcagagaccttccagtccagtagcagcactctccccaccccgcgcacctccgcagcttctacctggagctccgggtccctccccgggctcctcggcccgccgtcctgcccagagctcatccccgcgactgtcagctctcggcctcagcgggggatacaagaaccgcccactctccatcctccgcccctttctcctcccttcccacccccaaatcgtcctggccccgccccggcggatcggaggaaggacggagcccgcgggaaggaggagggggcggttagcgccagccagtgccgccgtggccccgccctcacgctctgtaccggagtggggctcgtcttccacctccccggcgccccagctttgcttccgtcccgctcgcccccaggcccggtgcgcacgcgtacctggctcgaccttccttctcgcggggtctacaagccgtgcgcgcgctcctacgcacggagcgacgcgtacgtctacctgcctgccttacagggcacctaggagggaccccttcctggcccatccgcgccgcgcaggcgcacgcccac

SEQ ID NO: 1911 - DNA, 157465 bp, Homo sapiens
atactattaatgacaagcctttttttattaaaatggcaagaatacaaatagtttatatcagtaaaatacagtagcattcaggctctaatatgaacattacatcaaagcctatggatagataaggtaagagatttaggaaattgggggaggaaggaaacatcacttatcttattactccagattacagacagctgccacagacaataaaataaaatcgcaattaagttgattgcagtacttgaaagaaaacttattaaaaataaagatttttaataaaatcttacattcttgacagatataccatcacctacctttctaaaagcagtagtagtaaacacaattgtagaatatgtatgttacttagtctttgagtggtacaatactataggttttaaaaccctgacaacactcctactttctgctgcttcaatatcagattatggcatggaattcatgtaaggttggttccaaaatggaatatcagatcccagaccagtatcagtaagttgtacccattttggcacagattttccagccatgaaaacacaaatcacaaagaaaaaaaattaaccaaccaattatttgagataccaagaaaggaaaggaaagcagttttgtaaaaacacttttccctgttttaataagcttctttatttactccagatagtgaacagaatagtgttcaatagtgaagtaagcagattttacactcactatcactgcatggatagaaagagccatatacatttttgtttttataagtcatctcagatcactgcaacatggcacattagaacagagattcagagacacaaagttaataaatacatttaacattgccaagcatttaaaagataaatgcactcatgtagcaaaaaaaaaaaaatcagtttgtaactttgacctttctcagggatgtgaagaatcatttcaggtgtcagaaatctctgtagcaaagattcctataagagaaaaaatcatgctgattaatatttttaattcaactttttcaacatgtgtaacaaatttattctagtaagtgtatcacttcagcaaaacgtaagatttttcttcatttctatgaaggaaaacaaaaaacaatatattttttcactcagttttcacaaactggtacattcataccatggaatactattcaacaataaataggaatgaactattgatacttacagcagcttggatggatctcacgggcattatgctgaatgagaaaagttaatctgaaaaggttatctcaaaacgacagaattatagagatggcgaagaaagtagtgtttcccaggagacagggagatgaagaaggtcagggctacaactataaataggcataatgagggagtgaattctttggtgctgatggaacaacttcacatcttgatcatagttgtgctgtgtgtggattgtaaaaaatatatatatacacatacaaacaaatgagtgcatctaaaaactagtgaaatctgaataaggcctttagactagttaatcacactgtgctaatgtcaatatcccagtttgtaagatactccattatagaagctggggtaaggatatgtgggactgtctgtggtatttttgcaactacttgtgagactataatcattctatttttattttttaattactattttttggagacagagtctcactctgtcacccaggctgaagtgcagtgacatgatctcagcttactgcaacctctgcccccaggttcaagcaaatctcatgcctcagccgcctgagtagctgggattacagacatgcgccaccacgcccagctaatgtttgtatttttagtagagatggggttttgccacgttggccaggctggtctcaaactcctggcctcaaatgatcctcccacctcagcctcctaaagttctgggattatagtcaggagccactgtgtatggccaagactataatcattaaaaaaaagtacctgtggtacatctatactatggaatactactcagcagttaaaaggaatatgtgacaactactaatacatgcaacaacctggataaatctgaaatatattatgctgggtgaaagtcaaccactagaggctgcatactgtatgattccatttacatgacaacctgggaaaggcaaaactagagaggcaggaaacagagcagtggttagaggaaagtaaattcaatgtgatgtctgttgtctagataataggtgtcagtcaaaggacaccatttgaaactgagagtaaaagattaagtgagaaaaaaggtgattaagggcattgttaatcatattaatagaaaggtaacaactaaaataaaataaactttcataaaagccaaaagaaatttgttaaaaagcaaagaagactgatcaaatgaagaaatacaacaaatatcacatagtacagaaagtaattataactattgatgtgacataacagtcatatcaataatgtaaaagattttaactcatctattttatttatactgttctattctatttttgagacagggtctcattctgttgcccaggctagaatgcagtggcatgattatggcttactgaagccatgaccttccaggctcagttgatcctctcacctcagcctaccaagtagctagaaatacaggcacgtgccaccatatctggctaattttttttgtgtgtgtattttttgtagagatggggtttcaccattgcccaggctggtctgtaactcctaggctcaagcgatctgtctgcctcagtctcccaaagtgctaggattacacgtgtgagcaaccacgcccagtgtaattcacctattttttaaaaagattttcaaaatggcagggtgtggtggctcatgcctgtaatcctagcactttgggaggctgaggcgagtggattacctgaggtcaggagtttgagaccagcctggtcaacatggtgaaaccctgtctctactaaaaatacaaaaactaggccaggtgtggtggctcatgcctgtaatcccagcaccttgggaggccaaggcaggtggatcacctgaggtcaggagttcgagaccaccctgcccaacatggcaaaccccgtctctactgaaaaaaaaaaaaaatgagctggatgtagtgatggacacctgtaatctcacctactcagggaggctgaggcaggagaatcacttgaacctgggaggtggaggttgcagggagctgagatcctgccattgcactccagtctgggggacaagagtgaaactctgacttaaaaaaaaaaaaaaaaaaggggatcgttccaagatggtcgaataggaagagctgcagtccacagctcccagcgtaagcgacacagaagatgggtgatttctgcatttccaagtgaggtaccaggttcatctcactgggacttgttggacagtgggtgcagcccacagagtgtgagccaaagcagggcagggcatcgcctcacctgggaagcgcaaggggtcggggaattccctttcctagtgctcgggacactcccactctactactgtgcttttccagtggtctttgcaaacagcacaccaggagattatatcccatgcatggctcggtgggtcccacacccatggaccctgcttactgctagcacagcagtccgagatcgaactgcgaggtggcagcaaggctgggagaggggcatccaccattgctgaggcttgatttggtaaacaaggcagcctggaagctcgaaccgggtggagcccaccacagctcaatgaggtctgcctatctctgtagacttcacctctggggacagggcatagctgaacaaaaggcagcagaaacttctgcagacttaaacgtccctgtctgacagctttgaagagagcagtggttctcccagcatggagtttgagatctgagaacggacagactgcctcctcaagtgagtccctgaccccctagtagcctaactcagggacacctcccagtaggggcaaactgacacctcatacagccaggtgcccctctgagatgaagcttccagaggaaggatcaggcagcaatatttgctgttctgcagcctccgctggtgataccgaggcaaacaggatctggagtggacctccagcaaactccaacagacctgcagctgagggtcctgactgttagaaggaaaactaacaaacagaaaggaatagcatcaacatcaacaaaaaggacacccacaccaaaaccccatctgtaggtcaccaacatcaaagaccgaaggtagattaaaaccacaaagatggggagaaaccagagcagaaaagctgaaaattccaaaaatcagagtgtctcttctcctccaaaggaacacagctccccaccagcaacagaacaaaactggacagagaatgactttaacgagttgacagaagtagacttcagaggatcagtaataacaaacttctccaagctaaaggaggacgtttgaacccatcgcaaagaagctaaaaaccttggaaaaagattagacgaatggctaactagaataaacagcatagagaagaccttaaatgacctgacggagctaaaaaccatggcgcgaaaactacatgacgcatgcacaagcttcagtagccaattcaatcaagtggaagaaaaggtatcagtgattgaagatcaaatgaatgaaatgaagcaagaagagaagtttagagaaaaaagaataaaaagaaacgaacaaagcctccaagaaatatgggactatgtgaaaagaccatatctacatctgattggtgtacctgaaagtgacggggagaatggaaccaagttggaaaacactctgcgggatattatccaggagaacttccccaatctagcaaggcaggccgacattcaaattcaggaaatacagagaacgctacaaagatactcctcgagaagagcaactccaagacacataattgtcagattcaccgaagttgaaatgaagggaaaatattaagggcagccagaaagaaaggtccggttacccacaaggggaagcccatcagactaacagcagatctcttggcagaaactccacaagccagaagacagtgggggccaatattcaacattcttaaagaaaagaattttcaacccagaatttcatatccagccaaactaagcttcgtaagtgaaggagaaataaaatactttacagacaaacagatgctgagagatgttgtcaccaccaggcctgccctaaaagagctcctgaaggaagcactaaacatggaaaggaacaactggtaccagccactgcaaaaacatgccaaattgtaaagaccatcgaggctaagaagaaactacatcaactaacgagcaaaataaccagctaacaacataatgacaggatcaaattcacacataacaatattaaccttaaacgtaaatgggctaaatactccaattaaaagacacagactggcaaattggataaagagtcaagacccatcagtgtgctgtattcaggagacccacctcacatgcagagacacacataggctcaaaataaagggatggaggaaggtctaacaagcaaatggaaaacaacaacaacaaaaagcaggggttacaatcctagtctctgataaaacaaactttttttttttttttgagaaagagtctcactctgtcgcccaggctggagtgcagtggtgcgatcttggctcactgcaacctccacctcccaggttcaagcaattctctgcctcagccttctgagtagctgagattataggcaagtgccaccatgcccggctaatttttgtatttttagtagagacagggtttcaccatcttggccaggctggtcttgaactcctgacctcgtgatccacctgcctcggcctcccaaagtgctgggattataggcgtaagctaccgtgcctggcctaaaacagactttaaaccaacaaagatcaaaagagacaaagaaggccattacataatggtaaagggatcaattcaacaagaagagctaactatcctaaatatctatgcacccaatcaatacaggagcacccagattcataaagcaagtccttagagatgtacaaagagacttagactcccacaaaataataatgggggactttaacaccccactgtcaacattagacagatcaacgagaaagaaacttaacaaggatatccaggacttgaactcagctctgcaccaagtggacctaatagacatctacagaactctccaacccaaataaaaagaatatacattcttctcagcaccacatcacacttattccaaaattgaccacatagttggaagtaaagcactccttagcaaatgtgaaagaacataaattataacaaactgtctctctgaccatagtgcaatcaatcaaattagaactcaggattaagaaactgactcagaactgcacaactacatggaaagtgaacaacctgctcctgaatgactgctgggtaaataacgagatgaaggcagaaagatgttctttgaaactaatgagaacaaagacacaacataccagaatatctgggacacatttaaagcagtgtgtagagggaaatttatagcattaaatgcccacaagagaaagcaggaaagatctaaaatcgacactttaacatcacaattaaaagaactatagaagcaagagcaaacacattcaaaagctagcagaagacaaataactaagatcagagcagaactgaaggaaatagagacataaaaaacccttcaaaaaatcaatgaatccaggagctggttttttgaaaagatcaacaaaattgacacaccactagcaagactaataaagaagaaaagagagaagaatcaaatagatgcaataaaaaatgataaaggggatatcaccactgatcccacggaaatgcaaacaaccatcagagaatactttaaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggactagacagattcacagccgaattctaccagaggtacaaagaggagctggtaccattccttctgaaactattccaatcaatagaaaaagagggaatccagatgcaataaaaaatgataaaggggatgtcaccaccgatctcacagaaatacaaactaccatcagagaatactacaaacacctctacgcaaataaactagaaaatctagaagaaatggataaattcctcaacacatacacgctctcaagactaaaccaggaagaagttgaatctctgaatagaccaataacaggctctgaaactgtggcaataataaatagcttaccaaccaaaaaaagtccagaaccagatggattcacagccgaattctaccagaggtacaagaaggagctggtaccattccatctgaaactattccaatcaatagaaaaagagggaatcctccctaactcattttatgaggccagcatcatcctgataccaaaggctggcagagacacaacaaaaaaagagaattttagaccaatatccttgatgaacactgatgcaaaactcctcaataaaatactcacaaaccaaatccagcagcacatcaaaaagcttatccaccatcatcaagtgggcttcatccctgggatgcaaggctggttcaacatatgcaaatcaataaatgtaatccagcatataaacagaaccaaagacaaaaaccacatgattatctcaatagaggcagaaaaggcctttgacaaaattcaacaacgcttcatgctaaaaactctcaataaattaggtattgatgggacgtatctcaaaataataagagctacttatgacaaacccacagccagtatcatactgaatgggcaaaaactggaagcattcccttgaagactggcacaagacagggatgccctctctcaccactcttattcaacattctgttggaagtgctgaccagggcaattaggcaggagaaagaaacaaagggtattcaaataggaaaagaggaagtcaaattggccctgtttgcagaagacatgattgtatatctagaaaaccccattgtctcagcccaaaatctccttaagctgataggcaacttcagcaaagtctcaggatacaaaatcaatgtgcaaaaatcacaagcattcttatacaccaataacagacagacagagagccaaatcatgagtgaactcccattcacaactgcttcaaagagaataaaatacctaggaatccaacttacaagggatatgaaggacctcttcaaggacaactacaaaccactgctcaatgaaataaaagaggatacaaacaaatggaagaacattccatgctcatgggtaggaagaatcaatatcgtgaaaatggccatactgcccaaggtaatttatagatttaatgccatccccatcaagctaccaatgactttcttcacagaattggaaaaaactactttaaagttcatatggaaccaaaaaagagcccgcattgccaaggcaatcctaagtcaaaagaacaaagctggaggcatcacgttacctgacttcaaactatactacaaggctacagtaaccaaaacagcatggtactggtaccaaaacagagatatagatcaatggaacagaacagagccctcagaaataatgccgcatatctacaaccatctgatctttgacaaacctgacaaaaacaagaaatggggaaaggattccctatttaataaatgatgctgggaaaactggctagctgtatgtagaaagctgaaactggatcccttccttacaccttatacaaaaattaattcaagatggattaaagacttacatgtttgacctaaaaccataaaaaccttagaagaaaacctaggcaataccgttcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaaccaacagaatgggagaatatttttgcaatctactcatctgacaaagggctaatatccagaatctacaatgaactcaaacgaatttacaagaaaaaaaacaaacaaccccatcaaaaagtgggtgaaggatatgaacagatacttctcaaaagaagacatttatgcagccaaaagacacatgaaaaaatgctcatcatcactggccatcagagaaatgcaaatcaaaaccacaatgagataccatctcacaccagttataatggcgatcattaaagagtcaggaaacaacaggtgctggagaggatgtggagaaataggaacacttttacacggttggtgggactgtaaactagttcaaccattgtggaagtcagtgtggcgattcctcagggatctagaactagaaataccatttgacccagccatcccattactgggtatatacccaaaggattataaatcatgctattacaaagacacatgcacacgtatgtttattgtggcactattcacaatagcaaagacttggaaccaacacaaatgtccatcaatgatagactggattaagaaaacgtggcatatatacaccatggaatactatgcagccataaaaaatgagcttatgtcctttgtagggacatggatgaagctggaaaccatcattctgagcaaactatcacaatgacagaaaaccaaacaccgcatgttctcactcataggtgggaattgaacaatgagaacatttggacacaggaaggggagcatcatacactggggcctgttgtggggtgggaggaggggggagggatagcattaggaggaatacctaatgtaaatgacgagttaatgggtgcagcacagcaacatggcacatgtatacatatgtaacaaacctgcacattgtgcacatgcaccctagatcttaaagtataagaataaataataaaaaagagtgtaaatttctcaaaaaaattcacaatgactcataaagcaaaactcaaatccatactgtatataagagatatatttaaaatgcagttactcaaaaaagttaaaaatatttaccatgtaaatagaaacaacaagaaaataggagtggcaacactaataccagacaaagtagagttcagcaaaagaaaaaaatctaaatgcatcagaaaaggacactttataaaagccacattccatgatgaagaatgacagttcagaatatcaatgcaacaaataaaacagcaaaccacctatataaagcaaaatttagaggatatggaaaaagcaattaaaacatactaataataggagactttagaacaccactcttgatataaaacaggtcagatgaacaaatattaaacagtgatataaaagatctgcaaaaaatgaaaaagtggaggtatttacaccacagaaattggcaagtgctacagatcagggcctccccctcctctctttggaaagccagtttaccagcacaccactgagctatccctacagaattaaaaataccacatagcctctataattaaatagtgtgggactgcacatgaataggcagatcaatggaatagaaatagaaagtccaaaaagagatctgaatgactgggacaaagagtcttttaaatcaatgatcttgcaacttgatagtcagttggaaaaagataaaattagatccatttctcaaaccatacataaaataaactccaaatgaatcagatatctaaatgcaaaaagtaaaaatatacaagtactaaaagaaaacattcctctactatctggggagagagaaagatttgctaactgtgaatagaaatccagatgcattaaaggaaaagctttaaaatctgactacacaaaaataaaaactttatagagaaaaaggcaatacagtaagattaaaagacaaatgacaaaaaagtgagaaaatattggtagcatatatcaccaataaagagataatttctgaaatgtactaaaaatttttttaacaaaaagatctaaagtccattagaaaaatagacgaagaaatgaatagctaattcccaaaaagagatataataatagcccttaaacctatgaaaagatattcaacttcactcacaataagagaaatgcaaattaaagctacactgaaataccatttctcatccaccacagtggcacaaattcaaaagcttgacagtgtgttctattagtgacgctgtggggaaacagtactttcacacattgctgaagggactgcaaaatggaggggaatgtggcactgtctaacaaaactacatgtgtatttacccattgacccagcaatcccacttctaggaatttattctgaagatactgcaacatgagaatacatatgtacaagattattcattacagccttgtttgtaattgcaaattattggaaactacctaaatgtccaagtttaggaggtgggttgcataactatggtacatccatacactggagtagtgtgcacctgaaaaaaaggactaaggagaatctctatgaatcaatatggagagatttccaggagatagtgttaagtgagaaaagcaaagtgcaaagaagcatgcaactttttgcataaacaaagaaagatatgtatctgtgtatcattagcacaaaaccacaaagaaagggggtggaggcatggctgatgggatggaaggcataaagagaaagtgacacttctcttagtattattttttgcagagtgttgaccttcaaaagcatgctaatctacatattcaaaaataaaattaagttgaggaaaaaactaggaagtggaaatatgaaaaatgaaagcaaattgaaacaaatgaatccaatgttacttacaatgaataccatgaccaaaataaaagatggaaaaaaattaatccaaataagttacaaactcagtatttaactaaatgctctcaagacttgggcaaggtagcatacaggcctaagaaggaagaactgcaaacagattctgagcttttaaaaagttggcctgttcaggagatcgagaccatcctggctaacacggtgaaaaccccgtctctactaaaaatacaaaaaattagccgggcattgtggcaggtgcctgtagtcccagctactcaggaggctgtggcaggagaatggcgtgaacctgggaggcggagcttgcagtgagccgagatcgcaccactgcactccagcctgggtgacagagcgagaccctgtctcaaaaaaaaaaaaaaaaaaaaaaaaaaagttggcctgtttattgtggtgacatcggtgaagaaattttgaaactattgtagatgcattctgggattgagcaaattagtaactacattgatattgttgagtaaacatgttaatgttgagccaaggttctcactgtagaagaaagaacatatatataagtaatggaagaaagcaaggatgaaacctgtgggcatggtttggagttttgtttatatttttaaatgagcctctgtgagtgtgtgtgcaagtgtgtgtgtctgtgaagaaacatgcaagcatgtgagcacatgagccaccacatgtgtatataagaaaacaaatggggtaaaattttttaaatagtgagtatgggtaaagggcatgtagatgttctttgtattcttatttttgtaactttttgaaaggttgaaattgtttccaaataaaaagtttttatgaaatttgtgatacatagaaatatatctaaaatattttcctctaaaaaacaagctgattactttcctagaacatataaattttgtggtgctataacaaccaatgttttgtaattaaatgaaagaagttaatgtagaaataaaaaggaaatcaaactcttaaaatacaatttatggggcagatggagtatggcagataggagacaggtctaacgtgcagctcccacatggaaggacagaacagtgttagagactcatattgtgatcttttgctccaagattcactgtaggaatataccaggaaaaccaaaagaattcacatatccttcgaaagaagtggcatgctgctgccaattccatgaaacaggtgaaaaactgtgagttcccaaagtgtgagagggaagaaaacctacctccgaacacgtccccactggggaatctaaaaatccacatcacgggagaaaaatttaaccttatctagagatgaaagagatttatggagtcacgtaaagtataaaagtagaagtagcagcaggaagtgccttgcacacactcccagtctccagctcaagcccagggaagccagcaatggcttctcacaggtgtccttgggaaggcagccagcagaattggggaggggtcacagagtgaaggaagctcccaactgaaattggtagtggttttgactgggcacaaattttcttgagcagagtccaggggacgagtggaagctgctgcagataggagccagggcaagaatagccagacagggaagggccaggttcaaatgctgtgcttgctttttcagtggggtagctcacggcctggggcaaaatctgagcaaggcactgcaggagcgaggctggccttgccaactacatgggagctgggcaaggcctcttgctactggctattccccacttctctggcaaactgtatgatacagcagaggtggccaagatcccctctataacataagcccattggcctgagaaccatacccccatcccccaaggtggccgtggcaagccctgcccaagtagagtctgagcccagacccacctaaccctgccccgacctaaagtgatgcatcactttcctgtcacctctactagagcaggtactggtatccatgctgttgccaggctgtagtacggtggtgcaatctctgctcactgcaacctccgacacccgggttcaagcgattctcctgcctcagcctcccaagtagctgggattacaggcatgtgccacccacctggctaatttttgtattttcagtagagacgggatttcgccatgttggccaggctggtcttgaactcctgacttcaagtgatctgcccacctcggcctcccaaagtgctgggattacaggcattagccaccatgcccggccaaagacaggtctttagaattagcccaatcagacaaagacaaaaaagaattttaaaaaatgaacaaatcctccaagaaatttgggattatgttaaatggccaaacctaagaataactagtgttcctgaggaagaaaagaaatctaaaagtttagaaaacttatttgagggaataattgaggaaagcctccctgaccttgctggacctcctccctgacctttaaatgtgcctctgcaagtatgtgtgtgtgcaagtgtgtgtgtgtctgtgaagaaacatgcaagcatgtgagcacatgagccaccacatgtgtatataagaaaacaaatggggtaaaattttttaaataatgagtatgggtaaagggtttggagatctagacctccaaacacaagaagctcaaagaacacctgggaaattcattgcaaaaagatcatcacctaggcacaaagtcatcaggatacccaaagtcaagacaaaggaaagaatcttaagacctgtgagacaaaagcatcaagataaactataaaggaaaacctatcacattaacaccagatttctcagcagaaaccctacaagccagaagggattggggtcccatctttagccttatgaaacagccaagaattttgtatccagcaaaactaagctacataatgaaggaaagataaagtcattttcagacatgctgagagaatttgccactactaaaccagcactacaagaactgtttaaaggagttctaaatcttgaaacaaaacctcaaaatacatcaaaatagaagctccttatgacataaatctcacagggcccataaaacaataacacaatgggggaagaaaacaccaaaacaaggtattaaggcaacaactaatgtgatgaacagaacaatacctaacatcttaatactaatgttgaatgtaaagagcctaaatagtccacttaaaagatacggaatggcagaatggataaaaattcactgactaagtatctgctatcttcaagagactcacctaacacataaggactcacataaacttaaggttaaagggtggaaaaagatattccacgcaaatggaaagtgagcaagagtagctattcttatatcagacaaaacagactttaaagcaacatcagtaaaaaaaagaaaaagagggacattatataatgataaaaggaatagtccaaaaggaaaatattgcaattctaaatgtatatgcacctaacactggagctctcaaatttagaaaacaatgactattagacccaggaaatgagatgcacagcaacacaataatagtgggagacttcaatactccactgacagcactagacaggtcatcaatacagaaagtcaaagaaacaatgaacttaaactataccctagaacaaacggacttaacaggtatttacagaacattctacccaacaactgcagaatataaattcttttcttcagcacatggaacaatctccaagattgaacatatgataggacacaaagcaagtctcaataaatttaagaaaatcagatttatataaagtatcttcttttttaacttatcttttgtaatttttttgtctcattttcattgagttctgctctgatctttgttatttcttttcttctgctgggtttaggtttggtttgttcttgtttctctagttccttcaggtgtgaccttagagtgtctatttgtgctctttcaaactttctgatgtaggcactaaatgctatgaacttttcttagtactacttttggtgtatcccagaggttttgataagttgtgtttcactattacctctcagttcaaagaagtttttaatttccatcttgatttcactgttgacccaaagatcacttaagatcagatgatgatgatgatgatgacaataataataataattattaatttttttgagatgtaatcttctctgttgctcaggctggaatgctgtggcgcaatctcggctcactgcaagctccaccccctgggttcacactattctcctgcctcagcctcccgagtggctgggactacaggtgcctgccaccacgcccggctaattttttgtatttttagtagagacgggttttaccatgttagccaggatggtctcaatctcctgatgtcgtgatccgcctgcctccgccccccaaagtgctgggattacaggcgtgagccaccgcacccagcctgaagtatcttcttaaaccacagtggaatgcaactggaaattacctccaaaaggaaccctcaaaactataaaaatacatggacattaaataatctgctcttgaggctggctgcgggggctcatgcctgtaatcccagcattttgggaggcgaagacaggcggatcacttgaggtcaggagttcaaaatcagcctggccaacatggtgaaaccctgtctctactaaaaatacaaaaattaaggctgggcgcagtgcctcatgcctgtaatcccagcactttgggagactgaggcaggcagatcacctgaggtcaggagttcaagaccagcctggacaacatggtgaaaccctgactctactaaaaacacaaaaaaattagccaggcatggtagcagacgtctgtaatctcagctacttgggagtctgaggcacaagaatcgcttgaacctgggagatggaggttgcagtgaaccgagattgtgccattgcactccagcctgggcaacagagcgagactctgtctcaaaaaaataaataaataaataaaaataaaaataagcccggcattgtgacgcatgcctgtattcccagctacttgggaggttgaggcaggagaactgcttgaacctgaggagcagaggttgcagtgagccgagatcatgccactgcactccagcctgagcaacagagcaagattccatctcaaaaaaattaataataattatcatcatcatcatcatcatctgatcttgagtgatctttgggtcaacaatgaaatcaagatggaaattaaaaacttctttgaactgagaggtaatagtgaaacacaacttatcaaaacatctgggatacaccaaaagtagtactaagagaaaagttcatagcatttagtgcctacatcagaaagtttgaaagagcacaaatagacactctaaggtcacacctgaaggaactagagaaacaagaacaaaccaaacctaaacccagcagaagaaaagaaataacaaagatcagagcagaattaaatgaaaatgagacaaaaaaattacaaaagataaatcaaacaaaaagctggttctttgaaaagataaacaaaattgatagaccactagcgagattaaccaagaaaagaagagagaagatccaaattagctcaatgagaaatgaaacaggagatattacaaccaataccacagaaatacaaaagatcattcgaggctactatgaacacctttacacatacaaactagaaaatctagaggagatggataaattcctggagatatacaactctcccagattaaatcaggaagacatagaaactctgaacagaccagtaagaagtagagagattaaaacagtaataaaaaaattgccaataaaaaaagtccaggaccagatggattcacagctgaattccatcagacagtcaaagaagaattggaaccaatcctatagaacactactgcacaagatagagaaagacggaatcctccctaaatcatcctatgaagccagtatcaccctaattccaaagctaggaaaggacataacaaaaagtgaaaactatagaccaatatccctgatgaacatagatgcagaagtcctaaacatcaaatttgctaactgaatccaacagcatatcaaaaagataatacaccatgaccaagtgagttgcataccaggtatgcagcaatggtttaacatatgcaagtcaaaaaatgtgacagatcacataaacaaacttaaaaacaaaaatcatgtgatcatcttaatagatgcagaaaaagcatttgacaaaatccagcatccctttatggttaaaaccctcagcaaaattggtataggagggacacacacttcacatagataggtaataaaagctatctatgacacacccacagccaacattatactgaatggggacagttgaaagcattccccctgagaactggaacaagacaaggatgcccactttcatcgcttctattcaacatagtatctgaagtcctagacagagcgatcacacaagagaaacaaataaagggcacctaaatcagtagagtcaaactatcactgttcactgacgatatgatcatatacctagaaaaccctacagactcatccaaaaagctcccagatctgataaatgaattcagtaaagtttcaggatacaaaattaatgtgcacaaatcagtagcactgctatacaccaacagcaatcaagctgagaaacaaatcaataactcaactccttttacaatggcagcaaaaaacaaacaaacaaacaaaaacaccaacttaggaatatacctaatcaaggtggtgaaagaattctacaaggaaaactacaaaacactgctgaaagaagtcactgatgacacaaacaaatggaaacacatcccatgctcatggagaatcaatattgtaaaaatgaccatactgccaaaagcaatatgcaaattcagtgcagttccaatcaaagtaccataatcattcttcacagaactaggaaaacaatcctaaaattcatatggaacctcaaaagaccccacatagcaagactaagcaaaaagaacaaatctggaggcatcacattacctgacttcaaactatactacaagactatagttatcaaaacagcatggtactgatataaaaataggcacatagaccaatgaaacagaatagagaacccagaaatgaagccaaatacttacagccaactgatttttgacaaagcaaacaaaaacataaagtggggaaaggacatcttattcaacaaatggtgctgggataattgggaagccacatgtagaggaatgaaactggatcctcatctctcaccttataaaaaatcaactcaagatgatcaaagacctaaatctaacatctgaaaccataaaaattctagaagataacattggtaaaagtcttctgaactttggcttaggcaaagatttcatgaccaagaacccaaaagcaaatgaaacaaaaacaaatataaatagatgggacttaattaaactaaaaagcttctgcacagcaaaagaaataatcagcagagtaaacagacaacccacagagtgggagaaaatcttcccaaacgtgcatccagcaaaggactaatatctggaatctacaaggaagtcaaacaatcagcaagaaaaaacaaaacaaaacataatcccatcaaaaagtgggctaaggacatgaataaacaattctcaaaagaatatatacaaatgcccaacaaacatatgaaaagatgctcatcatcactaattatcagggaaatgcaaattaataccacaatgagatacctaccttactcctgcaagaatggccataattaaaaaatcaaaaagcatagatgttggcatagatgtggtgaaaagggaatgttttcatttacactgctggtggaaatggaaactagtacaaccactaaggaaaacagtacagagattccatttagaactaaaagtataactaccatttgatccatctatccaactactgggtatctattcagaggaaaaaaagtcattatatgaaaaagatacttgcacacgcatgtttgtagcagcataatttgcaattgcaaaaatatggaaccagcctaaatgcccattgaccaacaagtggataaagaaaatgtggtataaatacaccagggaatactactcagccataaaaaggaacgaaataatggcattcatagcaacctggatggagttggagaccattattctaagggaagtaactcaggaatggaaaaccaaatatcatatgttctcactttaagtgagagttaagctatgaggatgaaagttataagaatgatacattgggccgggcgcggtggctcacgcctgtaatcccagcactttgggaggccgaggcaggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctggacgacagagagagactccgtctcaaaaaaaaaaaaaaaaagaatgatacattggactttggggattcagggggaaggatgggagaagagtgaggaataaaggagtacacaatgggtacagtgcacactgtttgggtgttggatgcaccaaaatctcaaaaattactgctaaggaacttatcggtgtaacaaaaaaccacctgttcccccaaaaccatggaaataaaaaaatatataatttatgcaaacagataaaatattagacctttcactttagtataatatatataattctaatttaattatcaaaatcctgtattttatatcaatatatcttggtaatcatgtttaaatatcactattaaagatagactattgagtttccttattaccccaaatgttcactatactagatactgctatttgatctcaagagaatggatccttaaatagactcactcttctaatgatcgatctaggcctcggtcaggagatcgatggtgagcacgttctggtgaatgacattttgtatttggcttcattgtagaactcatatgataagcattacttgaataattttggcggcgaagttcttgtacggccctctccctaaagcaaaatagtgatgctttaaattttatatccagcaaaattattaaaactatcataaaactagctcaattcatacttgaaaatctaaccatcatgaaagaactaaaacctcttgttacctaagaaacaatgctttccatgctgaaaagcattgtttttgagcttgcatagagataaacttacctttcaaagcgctctgttcctagttgtcttttggtaatgtctaaatcagcttccaattgtgtgacaacatttctgaactgggccacatctctactctggatggccctgtttaaaagaagataagagttatagttgactaaacttaaaatatggctatgattctggggtacatgaaaccatattgatagtggtttctcagctggatccaaatcacattgtgatttttatggccagatttattagtacatctaaaatatgcccatgttagacatagtaagtatgcagagtagcctacttgaaaagcctaagcaatcccagtcccatttaattagttaatccttctctgtttcagcttccctgtgggaacatattatacatcatctgtctatactacttactataaattgttttttatgtaagtacttagaggtattctataaagtagtggtatgatcaaataattaacaccggaattcactagctccatgattaatatggtctgttttatatatatctattcaaccaagtgccttataatgaaatttgacatacacaatcttcaatttaatagaatcttccttaaggctaaaaaatgcctcaaaaaacctgtaataaggcacaatatcatagggaagataaacattgatgaatgccactcacacagaacattctatcctcttcacttgctttcaggatagtatcatagactgctgaaatctaaactttagagactaataacaaacacttctcatgctaattctaagtgttagtatttaccagccagtctaaaacagagtatagcccttagggtggaagttttggcgtatttcacaaaaggtagatttccacctaccatcctgagaaagtgatcctgcaaaacctgttgaaggaatcataataggctagctacagtaatggaaaagaaggactcagtcaccgccactataacctgaaaacagtttctgaaggaaactggccctggctctgaagcccttgcctagtcaggggctcctaggagtggctgattgctgagaccatgcttcttatccttccccatgtcctgacctcagatgtgaggacagagtggaggctggatgaaaagtgttacagatgggacaggtaagaacaggggttaagggtcccccatcagtttttatgagagatgatcaagtttaatagaaaaaaaattcactatacagggaggcaattccacccaattctccagccaaatgtcttttaataaggtgctaggagtgctagagatcctaaagaaaagaaaaagaaagaaaagaagccaaaatcaatgtcctgggaagtcttctgtattttgtgaatgcaggtgttcttctaggtatccagtacatgcaataggtacaaaagaaaatatgatgtggcaaatgcaaacactaggttgcaatatattggtctaaatatgaaaattcttctggtttcaaactggttaattttttttctcattttgttatatttcctaaaggcagtattttagatcagacattctatcatactcaaaactctgttggaaagaatcagtagagatcattaaacttaaatttagataagaaaaacataatagaaaaagtaccacctcttaggcaaatcacagtatttctgatccttaggcaaagtatagaaggcaaattctctaaattctagcttaaaatttctactaaagtaccaaaaaattaagatgtatgactttactttatattgctaaacaactcacattttattttctgccaaacaaaggtgttctttaagaagctgaatttcagattctttttcttgaagtgctatctgagactgatattctttgtctcgattggccaccagcaaagcttctagattctgcatggagattctctcatttgccatctgactcctcaggagttcaatttcagaatgagcagaatctaactcattctccctctgttcaataacaagaagatatctacacttattcccattaattcacttaactattatattatcagggactcacaaaattttcataatctgttataaactggcaactacttttaatgtgatttgaaattgtgtccctccttcttaccaaataaacacaccacacatgtatgtatagtatcactttctccatctctctgatcatatcagaaaattcattaatttaagaaaaggcttattaatttcaaactgcaaccagtttctactaccagctttgatatttctttatatactcctgcaagactgacaggatgatatctgtgagcactgctttgtcctgagttaggtgagctacatgcttatagaatgtcattggactccataattaaggaatataaggagtaatctcttatattcttatataaagagtaatctcttatagtctcttaatataattaataattatatttaataatgtaattaaatataattataattaatataaggagtaatctcttatattctcttgcataaacttgtggaaagcttcctttagaaaattatcttgagccttaaaatatgctcagtgagacaaatgttttttaaaaaggaggaagaacagtcactagtatttagaaaacaattattccttatcttgtaatatacataacaaattctatatgcatttaaaagttaaatttgaaaaggtaagctttaaattccagtgaaaagaaataaaaatgaaattacatggaagggagataggtaggtagggaaattttctaagctagatacaatgcaaaaaaaagtttcatcacattaaaaaaataaacattttgatagtcaatataaacttaaccaaaatttgaaaggaaacaactggaagacaaataaacttagtaaatcaaattaatagcttatatctctactaacataaagaacgcatataaactgatgagaaatatgagctaaatgataatgatcagaaaatttacaaaaggagaaatacaagtaaattataaacgtatggggaaaatttacccttactagtaatcaaataaactaaaacaagatgctattactagttcagggcttcttacctcaacattactgatgttttgggttggataattatttggagtgggggcagcactatgcattacaggatgcttagcagtatccctggcctctgcccaatcaacgccaccagcattccccactctagtcatgaccaccaaaaatgtcattactaaatgcacactgggagcaaactctctttcagctgaactggaaaaactctaccaaagacactgttctagtctatctagtctattctagtctatcgcaaatttgttagtttgtgttaatgaacattacattgggcaatggcaatctcatatactttgctggcaggagtagaaaatggaccgtgatttttttgacaatagcttttttgaaatataattcacatgccatcaatgatttttagcatattaacacagttgtacaatcgttaccacaatctaatgtgagaactttttcatcatcccaaaaagaaactcaaggttgggcatggtggctaacacttgtaatcccagcactctgggaggccaaggtaggtggattgcttgagctcaggagtttgagaccagcctgggcaacatggtgaaactccatcgctacaaaaaattcaaaaacttagccaggcatggtgacataggcctgtagtcccagctactcagcaggctgaggtgggaaattgcttgagcccagaagttgaggatacagtgagccaagatggcaccactgcactccagcctcggccactgaaggagaccctgtctcaaaaaaaaaaaaaaaaaaaaaaaaaaaacacccaacacagaacgttctctggccctaggcaacccctaaactattttctactatttgccttattctgggtattccatataaacggaaacaaacaatgtgtatgcggtcttttgtgactggcttcctttattagcacaatgtttttaagagttatcgatgttttagcaggatcaaaacttcatcacttttattgcctaataatattccattgcatagataaaccacagctctattcatgagttaaaaatatttgacttattatactttgggactattataaataatattgccataaaaatttgtatacaagtttttgtatggacatgttttcattcctcttgaatagatagaagtgacatttatgagctgtaaggcaatctaatttttaacattttgaggaactgacaaaatgttttacaaagttgccttactattttacatttccaccagcaatgtatgagggtttcactttttccacatttttgtcaacattttttatcttctctctgattacagccatcctagtggttgtgaaatagtatggttttgatttgcatttttctattaatgatgttcagcatcttttcatgtgtttattggccatttatgtatcttatgtagagaaatgtctattaatatcctttgcctaattttttagttgggttattaagttttttgttttttgagacaaggtctcattctgtcacccaggctggagtgcagtggcatgaagatggctcactgaagtaaacctcccacctcagcccctcaagtctctgggaatacaactgtgcaccaccacacctggttaatttttgtattttttgtagagatgggtttttgccatgttgcccaggctggtcttaaactcctgggctcaaacgatcctcctgtctaggcctcccaaagtgctaggattagaggcatgaaccaccactacatattttgaatatgaatctcttatcagatatatggtttgcaaatgttttctcacatcttgtgcatcgtcttgccactttcttgatgatatcatttgcagcacagaaggtttttttttttattttgatcaagtctacttaatctattttttttgtttgtgtttttgatgtgtatttaagaaagtgctgcctaacccaaggtcacaaagatttacttctgtgttttcttcttaatacagttttggctgttacatatagccctatgattcattttcagttaatctttgcatgtgatccaacttcattcttttccacatagatattaggttgtcccaacgccatttgctaaaaatactattctttcctcattgaattgtcctagcacctgtattttgaaaaatcatttgggcacaaatgtataaaccatttctggactctgaattctgttccatcaacctctatgtctttccttatgctagtaccacattgtcttgattacttcagttttgcagccagttttgaaatcagggaagtgtgattctccaactttctttttctttttcaagattgttttggctattcacttgcacttccatatgaattttagatcagtttgacaatttctacaagacacctgggattctgataagcattgcattaaatttgtggatcagttttgggagtaatgccatcttaacaatgataagtgttctggcccatgaacatgggatgtgtttccatttatttaggtctcctttaatttctgttgacaatgttctgtagttttgtaaagtacaagtatttgtctttttttttttagacagagtcttgctctgtcaccaggcagagtgcagtggcataatcttggctcactgcaacctctgactccctggttcaagcgattctcctgcctcggcctcccaagtagctgggattacaggcacgtgccatcacacccagctaatttttgtatttttagtagagatggggtttcaccatgttagccaggatggtcttgatctcctgacctcatgatctgcccacctcggcctcccaaagtgctgggattacaggcataagccaccgcgtctggccgtatttgtccttttttaatgctaccctttttgatgcaattccgtttgatataatttttttttcagattgttcattgttaatgtatagaaataagaaatatgataactggatattgatcttgtgtcctacaaccctgatgctcattaattctaatacgtttttagtggattcttaggattttctatatttcagatcatgtcacctgcgaacagagatagttttacttcttttccaatctggatgccttttatttctttttcttgcctaactgccctgcctagaacctctgctacagtgttgaatagaaaaggcaaggtgggcattcttgtcttgatactgatcttagggcaaaatcattcaatcaccactaagtacagtgtttgctgtgggtttttcacaggtgccctttatgaggtcaagaaagtttctatttctagtttatagagtgtttttatcaggcaagaatgttggattttgccaaatgctttttctgcatccattgagaaggctgtgtggttttcgttcttgattctgttgatatgatgatgtattaattgatttttcagttgttaaaccaacccagcattcatggaataaaccttactagatggtgtaaatttcgttttatgtgttgttggattcagtgttatagtattttctcgagaatttttcatctgtattcataagagataatggtctgcagttttattttcctgtgaggtgtttgtctggctttggcctcagggcaataatggcttcatagaatgcattaagaagtgttgtcttctacttttggaagagtttgcaaaaatgctggatcaatgcatcttgaatcatttggaagaattcacaactgaagccatctgggcctcagtattactttatggaagtttaaaaatttctattttcacctctttaggttacaggtttattcagattttctacttttccttaagtcagttttaatagtttgtgtttttctggaaatttgttgatttcatctaagcatttaatttttggcattcagttgttcatgatattcccctatgatactttttttataaggttagtagtgatgtcccttctcttattcccgattttagtaatttggctctgtcactttgctaaagatttgtcaattttgttggtattctgaaagaacaagcttgtggcttctttgattcttgattgttttcacttagtttctgttctaatcttgattattattttcattcttcttgctgtgggtttagtttgttccctttttccagtgttctaagtggaaggctaggttagtgacttaagagttttcttcttttttaatatagataggcatttatagctataaatttccctctaagtactgctttagctgcatcctatatgttttgacacagtacatattcattttcactaatctcagagtattttctttttttcctttgtgatttcttctttgactcaccactatttgggaatgtgctgctcaattttcatatacttgtgaatttacaaaatattcttcttttatcaatccctaacaattccattgtgatgggaaaacatattttgcataagttcaatccttttaaatctattgaggcttatattatggcctaatgtatgatctattctggaggatcttccatgttgagaagactatgtattctactgtttttggaagagtgttttataaatttatgttaatgccaatttggtttttgtgttgttgaaatcttatatttccttgttgatgttctgcctagctgctctcttcattattgaaagtggggtattgacatctgcaactattactgttgaactgtttatttacagctcaatacagaaatgttattcctacatagctgtttttcttccttttctcactagtgatattagtcttacacttacatctatatatgtcacaagcccaatgatatattgttacaattattacttttaaatgttatagcttttaaagaagttgatagaagaaaggacaacaaaaatatacagtcagacttagtagctcttttttttttttatttttgagatggagtctcactctgccacccaggctggagtgcagtggcatgatctcggctcactgtaagctctgcctcccaggttcatgccattctcctgcctcagcctcccaagtagctgcgactacaagcacctgccaccacgcctggctaatttttttgtattttttttagtagagacagggtttcaccgtgttagccaggatggtctcgatctcctgacctcgtgatctgcccgcctcagcctcccaaagtgctgggattataggcatgagccaccacgcccggcccaaagcagctcttttaaatatgttcaaagaaataaaggaagtcatacttaaggaggtaaagtaaggccataaatggatgaattgataaagaaaacgtggtatatatacaaaatggaatactatacagcagcggtccccaacctttttgtcaccaggaactggtttcatggaagacaatttttccatggacagcagtcggggtggggatggttttgggatgaaactgttccacctcagatcatcaggcattagttagattctcacaaggagtgtgcaacctagatcccttgcatgcgcagttcacaatagggtgcacgcttttatgagaatctaatgccactgctgatctgacaagaggtggagctcaggcagtaatgctcactcacccaccgctcacctcctgctgtgcggctaggactggtaccagtctgtggtaacaggctatgggcccgtacaggtctgcggcccaagggttgggaactcctactatacggcctttaaaaagaaaaaaattctgtcattcatggcaacctgggtggaattggaggacatcatgctaaatgaaataagccaggcaaagaaagacaaatactgtatgatcttacttataagtggaatctaaacaagctgactttatagaaacagagagtagaatggtgggaggaggaaggatggagaaaggggagatgttgatcagagtccaaagttttagttagactggagaaataagttttggtgatttattacattgcatggtgaccacagttaataataatctactgtataattcaaaattgctaaaagaataaaattttaatgatatcatgcaaaaaataagttgataagttgattgatatgttattagcttaattaaacctgtctgccatacatacatcaaatctgtctacatacatagaccaaaacatcacattatactccataaatatacataattattatttgtcaactaaaaaaagaaagaaaaaagtaaaagaaggcctaataacaatgtctcatcaaatagagactaataataaggaaataataagctgctctaaaagacagtttcttttgtttgctttattttcctatggatgggctgcattttcctggctttttgagggttaaatttttgttgttgaaaaccagaaattttaaataatatattgtagcatctctaaatactgatcctccccatcttggggcttgttatggttggcttatttccttatttatttgtctggattgtttctatgatgtctgtttcccttgcggtatatagcctccgatgttgctcctcagggtatgcacatagttaccccgatcccttcccatgggcatttacacagtcattctagcccctcccgctaggatgcaatggatttagccaggctctctttgactgtctctctctgatctccctgttaagtgtctggctggtctgtccctactggtatcaaatccaactattagcctctattaattgctagctgactgttctatttattttgataatcaactgtgggttaccttgcttcacagtctgatccaattacatttgatccctttgcaggggtactacttcccaacccaagcgttgttgaggtacgattgacaaataaaaattatatatacttaaggaatataacatgatgttttgatacacacatacattatagaatgattgccacaattaagctaactaacatatccatcacctctcaactagttactgttgtatgtgtgtgttaagaacacatgagatctattcacagcaagtttcaagtatacagtatattaactgtagttaccatgctgtacattagatctcccaaacttattcaccttgtaactgaaaatttgcaccccttgtccaacgtctcccttcttcccctactcccctcacccccagcccctcatcaccaccattctactctctgtcaaactcacagaaggggtagttttgaggcaagtttttgaggcttgctctgatcccagaagggctcttgttagctgctgctgtccatggttctctattcaacttctaactggtctattgtttccatttttgttttcgtgatgtttcctcttaattgtgaagcagtggctttttgaaagctcgttggctgtatgtgccaaaatttccacttgtgggaatccatcttaaggatataatgcaaaatgtgataaaagttttacgtaaaaaaattttccatgttgttttatacaataaaaattttacattttttatacagaaatggtaaaaagtagaataatccatttaatatattattttgcaactatgcaaaagaacacaaaaatctggccaggaaaagaaaaggccagaaggaaatgtgacaaaatgtctatagtgggagaaagtaccttattctagttttaggttctgaaatccattgtagcctaaggtgatgactacatttttaaaaatcctttgcttccttcaaaaattatatgagattctccaaagcacttctcatattatgcctaaggaaatcacccataacataagcattcattaaaagatgctaaaggaagaatatttggaattcatgttctcaaaattccttgagaagagttagttaatagatatggtattaatttagagatagaaaatcaagaccagggtatattatatagtgtgaattatatatcaacaaatatatctcagtaaatgtatttaaaaaaaaagaaaagcaaagaaaactaagactgaacaaaaggtccagatagtgctttaaactatttttataggagaatgaaggtggcaatatagatatttttgaccctaacttctcttttcttatttaaaattacctgaatgatctcagggatggaaggctggttcaatattcaaaaacaattaatgtgatctatcatattaataggctaaataagaaaaatcattggatcttataattagatgctgaaaaagcatttgacaaaattcaatatcaatctatgataaaacctcttagaaatatgggaatagaggggaaatccctctacttgataaagaacaactgcaaaatactacagataacactagtggtgaaacactgaatgctttctgcctaatattgggaagaaggtaagatgtccactttcaccattcttaactgacaccgtgcttaagtacgaaacagtgcaagaaggcaagaaaaggcaaacagatcagaaaataataaaactgttcttattttcagatatagtggttgtttacctagaaaaccccatggaatctgcaggaaaactcctagaactagtaagtggatttggcaagttcataggacacaagataaacattcaaaaattaaaattgttggctgggcacggtggctcatgcctgtaatcccagcactttgggaggctgaggcaggcagataacttgaggtcaggagttcgagaccagcctgggaaatatggtgaaaccccgtctctactaaatacacaaaaattagctgggtgtgttggcacatgcctgtaatcccagctactcgggaggttgaggcaggagaatcacttcaacctgggaggtggaggttgcagtgagccaagatagtgccactgtactccagcctgggggacagagcaaggctctgtctcaaaaaaaattaaaattattggctgggcatgctggctaacgcctgtaatcccagcattttgggaggctggggcaggaggattgcttaaggccagaagttcgagaccagcctgggcaacatagcaagaccccatctctacaaaaatcaaaatattagccaggcatggtgacacatgtctgtagtgccacctagctacttgggaggctgaggtgaaagaattacttgagcccaggggttcaagactgcagtaatctgtgtgccactgcactccagcctgggtgacagagtgagacccaatctctaaaaccaaaccaaaagaaaacaaaaaacaaaaatcaattgtacttctacatactagcaaggaacacgttgacaatgacattaacactaaaataccacttacaatagctcaaaaaaagaatacttctttttattttgtaggtggaaatccaaacatgtacagaacttgcatgctgaaaactacacagttaacaaaagaaatcaaggaaaatctaaataagacataccacgttcatgaattggaggccttagcatagtaaagatgttaattctccccaagttaatgcaattttaatgcaattcctatcaaaattcaagcaggatttttgaagatataaaaagattattctaaaatttatgtgaaaaatcaaagagattagaatacctaaaacaattttgaaaaaaaaagaataaagcagatgaacctaaattaaagacttaatatataactacagtaaacaaaattctgtggtattgggggaaagacagatacataggtaaatgtaaaagaatagaaaaccaagaaatagacccacacaaatatacccaattgatttttcacaagggtacaaaatcaattcaatggcagaaagatagctttttaaacaaatggtacagaagaaggtggatactcataggccaaaaaaaaaaaaaaaaaaaaaaaaaagaacctctatgtcaacctcacactttacgcagaattaactcaaaatgggtcacggaattaaatgtgaaaaataaaactataaaacatttagaataagaagtaggaaaatctttgagatttagagctatagcaaataatttttagacttaaagccaaaagcacaatccataaaaggaaaatttataaatgcgacttcatcaaaattgaaaactttttaattgagaaagaccctgttaagagaataaaaaccacaagccacatacttagtgaaagaaaatatttgcaaaccacatgtctgataaagcaggagtccctaacccctgggccacagactgctaccagtctgtggtctgttaggaaccaggccacacagcaggaggtgaatggcaggtgagcccgcaaagcttcatctgtatttacaactgctccccattactcgcattactgtctgaactccacctcctgtcagatctgcagcagcattagattctcataggagtggaaccctattgtgttccacaggcaagggatctcagttgtgcactctttaaaggaatctaatgcctgatgatctgaggtggagctgaggcactgatcttagctctggggagctgctgcaaatatagattaacattagcagagaggtttgactgcacagagaccttaataaatcaattgcttgcagactcatatcaaaaccctattgctgagtggcaagtgaaaattaagttgcatctggtagtaggctttatagtggcaagtgagttgatgtgcttcaattgtacagttgcatctagtggcaggctttaagtcagaatctgacacttattttagtctgcatgtggcctgcccatttttttatttaccacttccatccgtgtctctttcctgcactgagtacttgtctcagtcatagttttggtaaacccacaagctaaccatagccaaaatgagtaaaaaacaaacatcactagagagctcctttgaaaagggcaaaagacccaatgatgagacagcagaagaatctaagactatcaacaaaaggaacgctgcatttaaaagaaaataccaagtcccacttaaattacgggttcattgcaacaggtagattcacattctccaagtctactttgtataatatgtagtgaccggctatccagtgaaaccatgaaaccttcaaaactgctttgccacttggagaccaagcaccctgtattaaaagacaagactttggagtttctcaaaagaaaaaaaatgtgaacacaaagaacagaagcaattattaaaggccaccacttcatcaaatgtgtctccactgagagcatcattcttagtggctaaacacattgctaatgctaagaagccctttgctattggtggagagttgatcctgcctactgataaggataatgtcataaaattttaggagaggctgaagttcaaaaggtggcacatgttcctcttttggctagcaccaataactagatgaattgatgaaataacagaggatattgtgagacaattgttagagaggattaatgagtcaccgtggtatgcaatccaggttgacgagtctacggatgttgacggcaaggcaacaatgcttgtttctgtgtgatatatttttcaggagcatgtgcatgaagacatgttatgtgcgcttttgttgccaaccaacatcacagttgcagactactcaagtctttgaatgactacacatcaggaaaactgaattggtcattttgtgtcagtatatgagcagatggcagtggttgccatggctggatagctttctgatttcattacttgggtcaaagaggtcgcttctgaatgtgagtctacacactgtgtcatctatagagaaatgctggctatccaaaaaatgtcacctgaacttaacaacgttttgcaggatgtgattaaaattatcagccacattaaagtacatgcccttaactcatgtctgttcgcatagctctgtgaagagatggatgcagagcaaacacgtcttctcttatatacagaagtgagatgactttctaaaggtgtatcactggccagagtttttgagttatgagagcaacttcagagatttctttcagaaaatgtcaccactggaagcacattttagtgacagagaatgggtctcaaaacttgcttacttgtatgacctatacagcctgctcaacaaactctatctgtcacttcaggggagaatgacaactgtgttcaagttggcagataaagtggctacattcaaaactaaactgctgtaatcccagcactgggaggctgaggtgggcagatcacttgaggtcaggagttcaagaccagcctggccaacatggtgaaatgctgtcttactaaaaatacaaaaatcagccaggtgtggtggtgggcacctgtaatcccagctacttgggaggctgaggcaggagaattgtttgaacccgggaggcggaggctgcagtgagccaagatcacgccactgcactccagcctgggtgacagagcgaaacgaaacaaaacaaacaaaaaaagccaaactggaattatgggggcaacgagtgaacactgggatttttgacatttttcaaacattaacagagattttgaaggagggtgagccagggccttctttctcccagttggtgtatgatcacctagctcagctttcaaaagagtttgagcattacttcccaatcacaaaagacccctgaacttggaaggaatggatctgcaacccatttgtgaatatgctaggtgaattgactttatccatgctagaagaggatcaactgcttgagagtgcaaatgatggtggctttaaaagtatgtttgagacaacttcaaatctccatacattctggattaaagtcgaggagttcaagaccagcctggccaacatggtgaaatactgtcttactaaaaatacaaaaatcagccaggtgtggtggcgggcacctgtaatcccagctactcgggaggctgaggcaggagaatcgcttgaaccagggagtcggaggttgcagtgagccgagatcatgccactgcactccagcctggcgacagagtgagactccatctcaaaaataaaaaaaataaaggttcaatagggtttggtaataacagaactttaaacatgaccaaaattttccactatttcaaatacactatgcatcttctatacatacccctttaaaattcgggctctatctctccagccacttcctcccatgcatgctacactagccattacaaagtacttattattcactccatacccttgtctgtgttgtttttccttctgaatgggatgcctcattcctttagagctcctgagtatctccttgtgtactcctccctgatattcctgggctgaatagaaatttcctctataaagcttttagtgtctcttattaatatatcattcattacaaattatttgtatgtcaatgggaagtccctgaggacaggaacctatatcttttgaatattatactccctgtggcaagtagaatgtcaggcacaaagtagatacaatcaactgagttacagttaaaagaacccggccaattagtaaataaatttagcttaaaagaatatcattaaagttacaatttagctaaataaacctcaacctcatggttctttgctgatcgctatgtcaatgtgttttatgattctgctggctaaaagtaaatgcaaattacatgctcaaaggaagagtttctgttacagtcttaagttgtctggaatacagctgtcataaactaacctcttggattttaaaaataaaatctaagttcaaagacatggattcatgtaatattacataaaaaagaacttacttttccaaaattatactaactttacagtaatagcaattttaaagatttttaaaatatattacataccatttctatttcttgatctttagcaaccagctgtcgattaagaagttctttgcttgagtcaagtttaatacagagttccctagtagaagacaaatctgcaagagcggacactttttcaaactgaaccttctgaagctcctcttccatttttacaacagatttatgtaaggtagaaatctgggacttgtaagacctttctgcatttaagtgctgtaagaataaaattatatatatgtatgtatacatatatattaaactggaaggaaactataacatggaaaaatgaagtggggcaaatctaagagtagtgcacttagattgtatgaagtttaaataatacaggtggtaacaatatgtacaaaacagtctaagataaattcaggttttgactttttttttttttacataaaattcatgagcaggatggtcaactggtcattctttttaatgtacttaggaaaaaaaaacctttcccacttaaaagtctccagccccaaaactagttgagatatatcatttgaccaacagttttacctatattagccagtttcaattattttataatacaaatgctattgttgttgttaaaaacaaaaatgctagccactgttttattcacaacatctgtttttgaattcttgactggcatgtcaatttcaatcataatgtcataaaatgaaaactgataactctttaacacttactaatacctctgagggaaagagactaagggcaagtataaattaagtatatatccacattataggaaataagagtgtgtttttaaaactatgagattcaagttacataaatgctttcgaatgttcaagataattccacccccacccttttctttcagaaaaatgtcttatgtaagtgcactgccacctacagagaagtatttgtttgctataatgtgaagacaagtagaactgagaggcaaataaatttatgtgtttttacaagtgattttacaagtgtaaagcactagaatttgctcccattataagttatttggccataattcactcctactttctctctatctcttcccttccttcctcactcactctttcttattctccaagccaactttttatccatccttccatccacccacccattcatcacatatatattgaatatactctatgttccagtcactgtggctaggtacatattcgatggtatgtggtatctgctctaatgaaacatccagactactagagaagtcatatattaatcaaataatgatacaaataactatataaatacatacaaagaaaatataattaataccctaagagaaaaaacaaaatggaattatataacatgctcgattaaaaccagaaaaggcagaagagcagctgaagactaaacaaacaaatgaacggggcaataaattaaagatacttataaatatgggaaatattaatccaactataattactttaactgtgactaatctatataccccaattaagacaaatggtcagagtggataagaaaacaagatctacttatttagctacgataaattaatattaatattcaaatgttaatgctaataaaaggaaagttggggtagctacattaatttcagacaaagcaaatttcagagaaaggaaaattatcagtaataaagagagggcatgacataatgattgtaaaaagttaattttcaaagaagacataacaatccttaatgtgcacattcctaacaacagagcatgccaacatacgtaagccaaaaaaattgataggatggcaaggagagatacccatatctactattctagattactattatagattattattggagaatgcaacacccatgtatcagtaactgacagatcaagcaggcagaaagtcagcaaggatacaattcaactgaacagcgttatcaatcaattggatctagatatttacagagtactttatccaaaaacagcagaatacacattcttttcaagctcacatgcaacattcactaagacagactacgtatgccctataaaacacatctaaacaaacttaaaagagcaaaaatcatacaaagtatactctcagatcacaatggagttgaactagaaatacattaacagaaggatagttggaaaatcccaaaatatttagaaatttaacaacatacttctaaataacacataggtcaaagaagaaatcacaaaaaaaatttagaatattttgaatgaaacaaaaattaaaatataacttaccaaaatttgtggcatgtagttaaagcagtacttacaagaaatttatagcactgagtgcatatattagaaaagaaggaatatctaaaatcaataacctggccgggtgtggtggctcacgtctgtaatcctagcactttgggaggccgaggcaggtggatcgcctgaggccaggagttcgagaccagcctggccaacataatgaaaccctgtctctactaaaaatacaaaaaattagctgggtgtggtggtgggtgcctgtaatcccagctactctggagcctgaggcagaagaatcatgtgaattcaggaggcagaggttgcagtgagctgggatcgcgccattgcactgcccctggtcaacaagagcgaaactccatctcaaaaataaataaataaataaataaacacaaaagaaagaatcttaagatctgtgaggcaaaagcatccagtaacctataaagaaaaacctatcagattaatagcagatttcttagcagaaaccatacaagctagaagggattggggtcctatcttttacctccttaaacaaaacaattatcagccaagattttgtctccagtgaaactaagcttcaaaaatgaaaaaaaaaaaagttttttttcagacaaatgctgagagaagttgccactaccatgtcagcactatgagaactgctgacaggagttctaaatcttgagacaaaaccttgaaatacaccaaaatagaatctctttaaagtataactctcacaaggcctataaaacaataacacaattaaagaaaaacaaagtattcaggcaacaagtagcataatgaataatagtacctcacatctcaatactaacattgaatgtaaatggtctaaatgctctacctaaaagacacagaatggcagaattgataagaatacactaaataagtatctgatgtcttcaagagactcacctaacacataaggactcatacaaacttaagtaaaggggtggaaaaacatattccatacaaaatgaaaaccaaaagcgagcaggagtagctattcttatatcagacaaagcaaactttaaagcaacaacagttaaaaaagacaaagagggacattatataatgataaaaggaagagtctaacaggaaaatctcacagttctaaatatttatgcatctaacattggagctcccaaatttataagcaattactactagacctaaaaaatgagatagatggcaacacaataatagtgggggacttcaatagacaggtcattaagacagaaagtttaaaaagaaacaatggacttaaactataccctagaacaaatgcacttcacagatatttacagaacattctaccgaacaattgcaggacatacattctattcatcagcacaaggaacattctccaaaacagaccatatgataggccataaaacaagtctcaataaatttttaaaaatcaaatttatatcaagtatcttctcaaaccacaatggaataaaactggaaattacctccaataggaaccctcaaaactataaaaatatatggacattaaataatctgctcttgaatgatctctggttcaacaatgaaatcgagatggaaattaaaaaattatttgagctgaacaataatagtgccacaacttatcaaaacctctgggatacagcaaaagtggtactaagaggaaagttcatactattaaatgcctaaatcaaaaagtctgaaagagcacaatctaaggtcacacctcaaggaactagagaaacaagaacaaaccaaactcaaaccccgcagaagaaaagaaataacaaagatcagagcagaattaaaatggaaacaaccaaaaaaaaaaaaaccactacaaaagataaaagaaacaaaaagctggttgagaagataaacaaagctgatagactattagtgagattaaccaagaaaagagcagagaagatccaaataagtccagttagaaacgaaatgggagctattacaaccaataccacggaaatacaaaagatcattcaaggctactatgaacattgttacatgcataaactagaaaacctagaggaaatggataaattcctggaaatatacaacccttctagattacaagcagcaagattcaaatggtaaaaaacaaaaaaaacaagaaacaaaaacaaaaaactgcctgccaatgaagaaaagtccaggaccagatgaattcacagctgaattctgtcattcaaagaactggtaccaatcctactgaaattattccacaaggcagagaaagagagaatgctccctaaatcattctatgaagccaatatcacactaataccaaaactaggaaaggacataacaaaaaaagaaaactacagaccaatatccctgatgaacatagctgcaaaaatcctcaataaaatactagctagccgaatccaacagcataacaaaaagataatacatcatgatcaaatgggtttcatatcagggatgcagggatggtttaacgtaagtaagtcaataaatatgatagaccacataaacagaattaaaaacaaaaatcacatgatcatctccatagatgcagacaaaacatatgacaaactccagtattcctttatcattaaaaccctcagcaaaatcagcatagaagggacataccctaaggtaataaaagccatctatgacaaacccacagacaatattaccgaatggggaaaagttgaaagcattccccctaagaactagaacaagacaagaatgcccactttcactacttctattcaacatagtactggaagtcttagccagagcaatcagacaacagaaagaaataaaaggcacccaaattggtaaagaggaagtcaattgtcactgttcgccaattataggatcatatacctagaaaactctaaagattcatccaaaagctcccagatctgataaatgaattcagtatacaaaatcaatgtacataaatcatcactgctatacaccaacagtgaccaagttgagaatcaaatcaagaactcaactccttttacaatagcaaaaacaaaaaacaaaaaacaaaaaaacacaacttaggaatatacctaaccaaggaggtgaaagagctctacaaggaaaactacaaaacactgctgaaagaaatcatttatgacacaaacaaatggaaatacatcccatgctcatggatgggtagaatcaatattgtaaaaatgagcatactgccaaaaacaatatacaaattcaaggcaattcctatcaaaataccatcatcattcttcatagaaccagaaaaaaaaaaacctaaacatcctaaaattcgtatatgactaaaaaagagccagcatactgtagaaagtagaaaagttaatcttcaaagttcgtcttgatttaaaaataaaataatagacactaggaataacagttccttactctaaagcctcctatcaactattagttcttacactttagcccagttagttgctttggcttactcaggcatgtctggacaggcccaggcaagtcttagctcatagcttatgccccttccttatttggaaatgttattgtttccttaaacctttcataagcaacttcctcttctttgttctctcttgcacttacctatttaggaaagttttaggttattagcaaattgggtatcagtttaagattgtgaggtccagctccagccaatggatgcaggacactgcagtaaggatgacccaaatgcataagagataaacatgtctgcttttcctttgctcaagtgtgctctcaccattgttccatctgcaatgggcaccctttctgcagaaagtaaaaatggccttgctgagggaattaaatttatgttcaagtgctatttctttgcgacaccagggaacaagcatttctaacaatacccaaagcaagactaagcaaaaagaacaaatctggaggcatcacttacccaacttcaaactatactacaaggctatgttaccaaaatagcatggtactggtataaaaataggcacatagaccaatggaacagaatagagaacacagaaataaagccaaaacgtacagccaagtgatcttcgagagagcaaacaaaaacataaagtggggaaagaacaccttattcaacaaaatggtgctgagataattggcaagctatatgtagaagaatgaaactggatcctcacctctcaccttatacaaaaatcaactcaaaatgatcaaagacttaaatctaagacctaaaaccataaaaattctagaacatcggaaaaacccttctagacattggcttaggcaaacccttcattaccaagaacacaaaagcaaatgcaacacaaagataaatagatgcgacttaattaaactaaaaaacttctgcacagcaaaagaaataatcatcagagtaaacagacagcccccagagtgggagaaaatctttgcaaatgacgcatccaataaaataataatatccagaatgtacaaggaactcaaacaaatcagcaagaaagaaacaaacaatctgatcaaaaagtgggctatgcacatgaatagacaattgcccccccacattttttttttttttttttttgagacagggtcttactctgttgcccaggctggagtgcagtggtactgtctcggctcactgcaacctctctggttgaaaatgacatttttatagataaacacaaacattttgaaggtttgagtcactcgctttgtgaggcttggccagtgttatattgttctcttcacagcctttgtgagccaagacaggtctttgagttgagatgtgctggggcgcaggtcttatgtggtaccacattctagaacagaaatgactgggtgcattttgttggccctggggcatcctaaaagggcccctcagtagggaagaaagcgctgtagacgggacatggccagcccatccagcagagagggcccagcaggtagcacggagaaggctggtcagctgtctggggctctgaccagacgagatttccctcacctcagtcaggctgctctttggccactgtgtaacatggcttgaagctgggtactgcagtaactgtctctaccgtcaagcctaggagtggaacaggagcagatctcttacaacatttggggcatagctttctgaacttctgtctgtgctatactgactacacatacatacgtatatgtgcaaaagtgcatatttacctgaaagaggtactgtctgcattgttttgtgagctttttttttttttgagacggagtcttgcgttgtggcccaggctggagtgtagtggcgtgatctcagctcactgcaacctctgcttcccaggttcaagtgattctcctgcctcagcctctcaagtagctgggattacaggcatgcaccatcatgcccggctaattttttttagtagatacagggtttcaccatgttggccaggctggtctcaaactcctggcctcaggtgatcctcccgcctcagcctcccaaagtgctgggattacagggatgaggccaccatgcctggccccattctttattttgtaagattgaggagaacacattttcaagcaaccagatgtcataattaacaagcaaaacttcaaagtaggcattaaaaatatgttcaaggacctaatgatgcatggttaatgaagtaaaggaagatatgatgacaatgtctcatcaaataaagattataaaaaaatatataaatcatttttttaaaagaacaaaatggaatgtctgaaacttgaaattacaataattgaaatgaaaaggtttcccagagggtctcagcagtggattctgaactggcagaggaaacaattaatgaatttaaaaaagattgatgaagattatgcaatttgatgaagaaaaaaagcagaatgaagaaaaatgaacaaacctccgaaaaatataggacactattaagcacaccaacctacatataatgatagtagtagaaggagaggatatagaaaggaccagaagaaataattgaaaaaataatggctggaaacttcataaatttcaaggaaaattttcatcttcatatttagcatgctaaataagcaagtaggataaaagctaagagatctacaatcagacacatcattataaaaatgctgaaagcaaggaaaatatcttgaaagcagcaagggaaaaatggcttgtcaattgcacaggaactccaataatattaacaactggcttctaagcagaaacaatggaatccagaaagcagtgatctaacatattcaaagagctcaaaaaacaaaacaacccaaaataccaagaattcttgtcaaccaagaagcctacacccaggagaactacctttcagaatgaagggaaaatctctacagaaatgctacaagccagaagagagtgggagccaatattcaacattcttaaagaaaagaattctcaacccagaatttcatatccagccaaactaagcttcataagagaaggagaaataaaatccttcacagacaagcaaatgctgggacattttgttaccaccaggcctgccttacaagagctctgaaaaagcactaaaattggataggaaaaactggtaccagccactgcaaaaacataccaaattgtaaagaccatcaacactatgaagaaacttcaccaactaatgggcaaaataaccaggtagcatcataatgacaggatcgaattcacacataacaatattaaccttaaatgtaactgggctaaatgccccaattaaaagacacagactggcaaattggatagtcaagacccactggtgtgctgtattcaggagatccatctcacgtacgaaaacacacataggctcaaaataaagggatggaggaatatttaccaagcaaatggaaagcaaaaaaaaaaaaaaaaatcaggagttgcaattttaatctctgataaaacagactttaaaccaacaaagatcaaaagagacaaagaagggcataaaataatggtaaaaacatcaatgcaacaagaaaagctaactatcctaaatatatatgcacccaatacaggaacacccagattcataaaacaagttcttaaagacctatgagagacttagactcccacacaataatagtgggagattttaacaccccaatgtcaatattagacaaatcaatgagacagaaaattaacaaaggtattcaggacttgaactcagctctggaccaagcggaccaggcagacaacagaactctccactccaaatcaacagaatatacattcttctcagcacctcatcacacttattctaaaattgaccatataattggaagtaaaacactcctcagcaaatgcaaaataacagaaatcataataaacagtttctcagaccacagtgcaatcaaattagaactcaggattaagaaatccactcaaaaccgcacaactacatggaaactgaacaacctgctcctgaatgactactgggtacataacaaaatgaaggcagaaataaagatgttcttggaaaccaacaagaacaaagacagaacgtaacagaatctctgggacacatttaaagcagtgggtagagagaaatttatagcactaaatgcccacaaaagaaagcaagaaaaatctaaaatcgacaccctaacatcacaattaaaagaactagagaagcaagagcaaacaaattcaaaagctagcagaagacaagaaataactaagatcagagcagaactgaaggagacagagacacaaaaaacccttcaaaaaatcactgatgccacaaagatactcctcgagaagggcaactccaagacacataattgtcagattcaccaaaattgaaatgaaggaaaaaatgttaagggcagccagaaagaaaggtcgggttacccacaaagggaagcccatcagactaacagaggatctctcggcagaaactctacaaaccagaagacagcagggccaatattcaacattcttaaagaaaagaattttcaacgcagaatttcatatccagccaaaccaagcttcaaaagtgaaggagaaataaaatgctttaaagacaagcaaatgctgagagattttgtcaccaccaggcctgccctaaaagagctcctgaaggaagcactaaacatggaaaggaacaactggtaccagccactgcaaaaacatgacaaattgtaaagaccattgatgctaggaagaaactgcatcaactaacgagcaaaataaccagctaacatcataatgacaggatcaaattcacacatgacaatattaaccttaaatgtaaatgggctaaatgctccaattaaaagacacagactggcaaatttgatagagtcaagacccatcagtgtgctgtatgcaggagacccatctcatgtgcagagacatacataggctcaaaataaacggacggaggaggagcaaatggaaaacaaaaaatggcaggagttgcaatcctggtctctgataaaacagactttaaaccacaaagatcaaaagagacaaagaaggccattacataatggtaaagggatcaattcaacaagaagagccaactatcctaaatatatatgtacccaatacaggagcacccagatgaataaagcaagtccttagagatctacaaagagacttagactcccacataataataatgggagactttaacaccccactgtcaacattagacagatcagcgagacagaaagttaacaaggatacccaggaattgaactcagctctgcaccaagcagacctaatagacatctacagaacactccaccccaaatcaacagaatatacattcttctcagcaccacaccacacttattccaaaattgaccacatagttggaagtaaagcactccttagcaaatgtaaaagaacagaaattataacaaactgtctctcagaccacagtgcaatcaactaaaactcaggatgaagaagctcactcaaaaccactcaactacatggaaactgaacaacctgctcctgaatgactactgggtacataacgaaatgaaggcagaaataaagatgttctttgaaaccaatgagaacaaagacacaacatactagaatctctgggacacagctaaagcagtgtgtagagggaaatttatagcattaaatgcccacaagagaaagcaagaaagatctaaaattgacaaactaacatcacaattaaaagaactagagaagcaagagcaaacacattcaaaagctagcagaaggcaagaaataactaagaacagagaagaactgaaggatatagagacacaaaaaacccttcaaaaaatcaatgaatccaggacctggttttttgaaaagatcaacaaaactgatagaccactagcaagactaataaagaagaaaagagagaagaatcaaatagacgcaatacaaaatgaaaaaggggatatcaccactgatcccatagagatagaaactaccatcagagaatactataaacacctctacacaaataaacttgaaaatctagaagaaacggataaattcctggacacatacaccctcccaagactaaatcaggaagaagttgaatccctgaatagacaaataacaggctctgaaattgaggcaataattaatagcttaccaatcaaaaaaagtccaggaccagacggattcatagctgaattctacaagaggcacaaggaggagctggtacctttccttctgaaagtattccaatcaacagaaaaagagggaatcctccttaactcattttatgaggccagcatcatcctgataccaaagactggcagagatacaacaaaaaaaggataattttagaccaatatccctgatgaacctcaatgcaaaaatcctcaataaaatactggcaaaccgaatccagcagtacgtcagaaagcttatccaccatgatcaagcgggcttcatccctgggatgcaaggctggttcaacatatgcaaatcaataaatgtaatccatcacataaacagaaccaaagacaaaaaccacatgattatctcaatagatgcagaaaaggcctttgacaaaattcaacagctcttcatgctaaaaactctcaataaactaggtattgatgggatgtatctcaaaataataagagctatttatgacaaacccacagccaatatcataatgaatgtgcaaaaactggaagcattccctttgaagactggcacaagagggggatgccctctctcaccactcctattcaactgttggaagttctggccagggcaatcaggcaggagaaagaaataaagggcattcaattaggaaaagaggaagtcaaattgtccctgtttgaagatggcatgattgtatatttagaaaaccccattgtctcagcccaaaatctccttaagctgataagcaacttcagcaaagtctcaggatagaaaatcaatgtgcaaaaatcacaagaattcttatacaccaataatagacaaactgagggctaaatcatgagtgaactcccattcacaattgcttcaaagagaataaaatacctaggaatccagcttacaggggacatgaaggacctcttcaaggagaactacaaaccactgctcaagacaataacagaggacacaaacaaatggaagaacattccatgctcatggataggaagaatcaatatcgtgaaaatggccatactgcccaaagggatttatagattcaatgctatccccatcaagctaccattgactttcttcacagaatcagaaaaaagctactttaaacttcatatagaaccaaaaaagagcccatacagccaagacaatcctaaggaaaaagaacaaagctggagggatcatgctactggacttcaaactataccacaaggctacagtaaccaaaacagcatggtactggtaccaaaacatatatatatacacacacaccaatggaacagaacagaggcctcagaaataacaccacacatctacaactatctgctctttgacaaacctgacaaaaacaagaaatggggaaaggattccctatttcataaatggtgttggaaaaactggctagccatatgcagaaaactgaaactggaccccttccttacaccttatacaaaaattaactcaagatggattaaagacttaaacgtaagatctaaagccataaaaatcctagaagaaaacctaggcaataccattcaggacacaggcatgggcaaggacttcatgactaaaacaccaaaagcaatggcaacaaaagccaaaattgacaaatgggatctaattaaactaaagagctctgcacagcaaaagaaactgtcatcagtatgaacaggcaacctaaagaatgggggaaaatttttgcaatctattcatctgacaaagggctaatatccagagtctacaaagaacttaaacaaatttagaagaaaaaaaacagacgaccccaccaaaaagtgggcaaaggatatgaacaggcacttctcaaaagaagacacttatgcagccaacaaacatgaaaaaaagctcatcatcactggtcattagagaaatgcaaatcaaattcacgatgagataccctctcacactagctagaatggtgatcattaaaatgtcaggaaacaacagatgctggagaggatgtggagaaataagaatgcttttacactgttggtgggagtgtaaattagtttaaccattgtggaagacagtgtggtgattcctcaaggatttagaactacaaataccatttgacccagcaatcccattaatgggtatataccaaaaggattacaaatcatgctactataaaggcacatgtgcacgtatgtttactgcagcactattcacaatagcaaagacttggaaccaactcaaatgtccatcaatgacagaccggataaagaaaatgtggcacatatacgctatggaatactatgcagccataaaaaaggatgagttcatgttctttacagggacatggatgaagctgaaaactatcattctcagcaaactaacacaagaacagaaaaccaaacaccgcatgttctcactcataagtgggagttcaacaatgagaacaccgggacacagggaggggaacatcacacaccggggcctgtcagggggtgggaggctacgggagggatggcattaggagaaatacctaatgtaggtgacaggttgataagtgcagcaaaccaccatgacatgtgtacacctatgtaacaaagctgcacattctgcacatataccccagaacttaaagtataatttaaaaaaaagaaaaaaaaaaagaaaaatacattcctagagaaacaaaaagtgagagcatgccttgttggcagatccaccatataagaaacactaaaggaagttcttcaaactgaaaataactgatcacagatggtaattcaaaaccacacacaaaaagcaaagaacaacaataaaaataattatgtaattataaaagacagtatagctgcatctcttttccatctgaactgattttaaaatcaattatataatattacataagatgatacaaatataattgtactattggtcctataacagatgaaatacaatatatttaccaataaatgcacaaagaacgtgggtgggagcaaagctttattggactaaggaaatgaaaagagacaaactcaaagccaaagtaacaatgaagacacccagaaatgggagggcgagggaaggctaacataacaaaaatctataaatatatagttgccctcatttttcctctcaggtttttaaaaagacacacaattgtataaagttataatagcaacaatgcattgttttgtagtatacagaaaatccaaaatactccaaaatccgaaacttcttgagcactgacatgacattcaaaggaaatgctcgttaaaacatttcagatttcagattttcatatgtattttgaaaagcgcaactagtaagtaaaattcaaatattccataatcagaaaaaaatccaaaatctgaaatatttctggtcccaagcattctggataagggattctcaacctgcaatatgtataacagtaatagaaaaaaatggaggaaaagggaatagaactatgtaacagtaacagttccatatatcatcagaattaagttagtataaacctgaagtagattctggtaagttagatgcatgtagcaaacaccaataattcacaaaatgcagggatgaaaatcacaaaaaaattttttaatgttttattagataatatacacttaatgcaaaaggaaacagtaaaggaggaatagaggaacaaaaaggcataagtcatataggaaaaagtaaaatggcagatataaatccaactacagtcatgtgacacataataatgttttggtcaatgatggaccagcacacatgatggtgggcccataagattataatatcatatttttactgtgccttttctatatttagatatgtttatatacacaaatactattgtattactattgcctatgtattcagtacagtaacatgctgtacaggtttatagcctaggcacaacaggctattccatatagcctaggtgttaggagattaaaccatctaggtttccagaagtacactctatgatgttcacacaaagaaactgccgaatggcacatttctcagaatatattttcatcattaagagacacatgactgtatatcaataatattaaatgtaaactgataaagcaatttaatcacaaaaactgaaaaactaagtaaataagcaaggttcaactatatgctgtctgtaagggacacactttagtttcaaagtcaaatagaatgaaactaaaaagataaaaaatatatcatgcaaagagcaacataagaaagctgaagtggttatgataatatcagagaaaacagactttttaaaaatgttactagagataaaggaggacattttacagtggtaaagggtcaaggccatcagaaatgcgtaagaatatacgtatatatgaactcagtaacaaagcactaagtaaatgaaccaaaaagtgacagaaatgaagggaaaatgataaaattcaatgctcatattcagacttcaatacagcacttacaataatgttaccacaataaggcagaagataacaggtaaatagaagacttaaacaacattataaaccaatcaggcctagaagacatctatagatcatttcatcaaacaaagtagaatacatatttttttcaagtgcacatgaaacattctctagaatagacactacactgggcaatacaacaaaatcaagaaatttttttaagctgtaaaaatataaagtatgttttccaaccataataataaaattaaattagaaatgaataacagaaaaaaaggggaaactaacaaatatgtggaaataaaaaatatagtccaaaataaccaatgggacaaagaagaaatcaaaaggaaaattggaaaatactttgagattacttaaaatgaacatacaacatacctgaacttatgagctgccgctaaagcagtgcttagaagaaaattgatgcaggtaagtacctatctttaaaaagaaaaaaaatctcaaatcaacaacctaacttcttaagacactaaaaaagaaaggcaaacaaaatctaaagcaagcagaaggaagaagaaataaaaatataaaggattggagcaaaaattataataataaagactagaaaaaatagtagaaaatatcaatgaaactaagagttgatttctgaaaagataaacaaaactgagaaaactttagccaaactaagaaaaaaagaagtctcaaatatacaattataaatgaaagaagagacacaacaagaaatacaaagaatcataagtgactactgtgaacaattatatgccaacaaattggataacctagaggaaaagaataattcctagaaatatacaacctacaaagattgaatcatgaaaaaaaatttttttaaagcctgaagagaccaaagcaagtaaggagattaaatcagcaataaaaataaatctgtcccagaactttgggaggcctaggagggcggatcacgaggtcaggagattgagaccatcctggctaacacggtgaaaccccgtctctactaaaaatacaaaaaattagccgggcgtggtggcaggcgcctgtagtcccagctacttgggaggctgaggcagaagaatggcgtgaacccaggaggcggagcttgcagtgagccaagatcgcgccactgcactccagcctgggtgacagagcgagactccatctcaatttaaaaaaaaaaattaaaataaataaataaataaataaataaatcttgccaggtgcagtggctcatgcctataaccccagcactttggaaggctgaggcaggtggatcacctgagctcaggagttcaggactagcctgggcaacatgcccatctctaccaaaaacacaaaaattagctgagcatagtagcgtgcacttgtagtctcagctacttgggaggctgaggtaggggaatagtttgagcccgagagacagatattgcagtgagccttgatggcaccactgcactccagcctgagggacagaagcagaccctgtctcaaagattaaataaataaatagtgtattcctgatagttaagatttaaaaaaaaaatcttacatcaaaaaaaagctcaagaccagatggcttcatgggtgaattctactaagcatttaaagaactaccaccaatcctcaaattcttccaaaaaattgaaaagaagggaagacttccaaattcattttagtggtcagcattatcatgataccagagcaagacaatgttttctacaaattttctacaagggaactacatgccaatattcttcctaaatacaaattcaaaaatttccaaaaaaaaaaaaaatactagcaaacaaaattggataacatgttaaaaggatcatacaccataatcaagtagcatttatccctgagatgcaaggatggttcaacatatacaaatcaatccatgtgaaaggccacgttaacagaatgaaggataaaagtcgtatgataatctcaacacatgtagaaaatgcatttgaccaacttcaacgtcctttcataataaacataaaaaagctctaaagaaactaggtatagaaggtatgtacctcaacacaataaaggctatatatgacaagcccacagttaacatcatactcagtggtgaaaagctccaacaaaaaatggttagaagtaataaattcagtaaattttaggatacaaaatcaacatacaaagatcagtagcatttctatacactgacagaatggaaatcaataaaatcaataaaacaatcccatttataatagcataagaaaaaagatgctatatgttcaccgaaaactataaaacactgatgaaagaaattgaagaagacacaaataaatggaaagatattccatgtttacagatcagaagaattaataatgttaatgttcatactacccaaagcaatctacagattcagtgtaatccctatcaaaattccaagagcatttttacagaaatagaaaaaaaatcctaaaattcatatggaaccacaatacaccctttagacaaagtaatcttgagcaaaaagaacaaagttggaggcatcacactacctgatttcaaaatactacaaaacaacagtaatcaaaacagaatggtagtgccataaaaagcagacatagagaccaatggaacagaatagacagcccagaaataaatccattcatttacagtcaattgacctttgacaaaggtgtcaagaagatgcagtggagaaaggacgatctctgcaaatgataatgggaacactgcctatggagaagaatgagattggacccttatttcaacatatacaaaaatcaactcttaatggattaaagacttaaatataagacctgaaacggtaaaactgctagaagaaaatggagaggaaatgcttcttgacattgaccagggtagtgattgttttggatataattccaaaagcataggcttcaaaagagaaaatagagaaatggggttggatcaaagtaaaaaacttctgcataacaaagaaaagtgtgaagagaaaatctacaaaatgggaaaaaatttgtaaaccatacagctgataagggcttaatattcaaaatatacaaggaattcaataggaagaaaacaaataacccaatttaaaaatgggcaaagagcctgaatagacatttctcaaaagaagtcatacaactggccaacaggtatgttaaaaaacactcgacattggtaatcattagggcaacattgctaattattaaagaaatgcaaagtaaaaaccacctcacacctgttggaatggctattacaagaaagacgaaagataaatgttggtgaggatatggagaaaaggaaccccttcccttgtacaccattggtgggaatgtaaattagtatagccattatgggaaacagtataaaagtgtctttaaaaatttaaaacagaactactatataatccagcaatcccacttctggatatacatccaaaggaaatgaaatcagtatgtcaaaaagacatctgcattcccatgtgctctgaattatttacaatagccaagatatggaatcaacctaagtgtccatcagtggctgaatggatagcaaacttgtggtatatagatatacaatgaaatactattcagccttaaaaacaaagaaatcctgccatttgtgaccacatggatgaccctagaggttcattatgctaagtgagataagccaggcacagtaagacaaacactgatctcgtttatatgtggaatctaaaaaagttgagctcatagaagcagagagtagaatggtggttacctggagctgatagggcagggtgaggtgagagaaagcttcagttagacagaaagaataagttttggggacaatagttaataataatgtactgtatgtttgaaaattactaagagggtagatcttaaatgttctcaccacaaaaaaaaaaatggcaagcatatgaggtgctggatatgttaattagcttgatttaatcatttcacaatttatacatatattaaaatatcacattgtacactgtaaacaatacaattttttatttggtagattataccttaataaaactggtgggggaataaagccaggcagagttcctactgccagaaagagagagggagagagagagaaagaaagaaattaacaaaacagccaggcagagtagctcacacctgtaattccaacactttggaaggctgaggtgggaagatcttgagcccaggaggtcaaggctgcagtgagccgtgattgcaccactgcattccagcctgggcaacaaagcaagaccctgtatccaattaacaaaaaaaaaaaaaaaaaaaggaagaaaagaaattactgaaataaagaaaataacaatagtcggccaggcgcggtggctcacgcctgtaatcccagcactttgggaggctgaggagggtgaatcacgaggtcaggagatcgagatcatcctggctaatacggtgaaaccccgtctgtactaaaaatacaaaaaaaattagccaggcgtggtggtgggcacctgtagtcccaggtactcgcgaggctgaggcaggaatatagcgtgaacccgggaggcagcgcttgcagtgagccgagatcacgccactgcactccagcctgggtgacagagcaagacttcgtctcaaaaaaaaaaagaaaataacaatagtcaacacaaccaagtaaccaagttagtttctgaaaagatcaactaaattgacaagtctgtagctagattgatctagaaaaaaagactcaattaatagaatcagaaatgaaataatgtagtaacgcaatccttacatactgcattagtagtaatgtgaccttactgaaatgaaatagattataaaaatacactataaacaactgtatgccaataaattaaatatcttggatgaaatgaacaaattcctagaaaacacaaactagcaaaactgtctcatgaaaaatagactatctgtatagatctataacaacaaagaaattgattagcaattttaatactgcccataaagaggtaattttaaaacttcccataaaacttctctaccagatggctttactggtaaatttttaccaaacctttaaagaagaatcaatgcaaattccatacaaactgttttgaaatacagaagaggaggaaacattttctaactcattctatgaggccagtctcactctgatattaaaaacagacaacacattacaagaaaagaaaattacagacgctcctagaaatacacaaaatccttcaaaaaaaaaaaaaaaaaaactagaaagccaaatccagcaacataaaaaataattacataccatgaccaagtgggatttatctaaaaatgcaaagttggcttagcatatgaaagtcaattaatgtaatatactatatctataaaataaagaaaaactacatgataatctcaatagacacagaaaaagcatttgacaaaatccaacaccctttttgataaatacactcttcaaagtaacaataaaagggaatttcttcagtgtcataaaggttttctataaaaaaccaacagctaacatcatacttgatggtaaaagatgaaatgctttccccctaaaatcaggaacaagataaggatgccccttctggacccttctattcaacactgtactagaagttctagccagggtagttaggcaagaaaataaaataaaaggcatccagattggaaaggaaaaagtaaaaactatctctattcacagatgacatgatctttgatatagaaaatccaccagcccaggtgacagatatagaaaatcctaaggcattcactaaaaacttttagacttaataaataagttcagcaaggttgcaggatacaagatcgatatacaaaaatcattgtatttttatacacttgcgatggagaatctgaaaataaaaataagaaaacaattctatttacagttgcattcaaaataataaaatacttaagaataaaattaacacaagaagacctaacttatactctgaaaacaacaaaatattgttgaaagaaattaaagatctaataaacgaaactacaccttgtgttcatggatcagaaaacttaatattgttaagacagccatattccccaaattgatctaccagctcagcatagtctctatcagaatcccaggtggtttctttgtagaaattgacaagctgatcctaaaatttatatgaaaattcaaaagtctcagaatagccaaacaatcttgaaaaaatgaaaacaaagcaggaggactttcacttttccatttcaaaagctactacaaagcaatagtaattatgccagtgtggtactgatataaggatagacatacagatcaatgaaatagaattaagagtctagaagaagcccatgtgtctatgatctattgatttttgatagaggtgccaagaccattcaaatggtggggggaggggagaaatagtcttttcaacaaatgttactaagataactagatggacacatgcaaaagaatgaatttggacccttacttcataccatgtgaaaaaaaatgaactaaaaatgcatcaaagacctaatggagggtttggtggtgataaagggtacagtgattcttttcaaagtgatgaaaatgttctaaaattgattgtggtgatcattacacaactctacgaacatctaagcactattaaattgtatactttaagtggataaactatatggcatgttaattattctcaataaagctgttacaaaaaatagcaacacaaaaatatgtagaatacagctaaagcactgtgtaggggaaaatacataccttaaatgcttagaaaagaagaatgggctaaaaccaatgacctaagcacctacattaaaatacgaagagaaaaattaaacatatattatttagaaggaaagaaataataaagagaagaaatcaatgaaatagaaaactagttcattaatagagaaaaatcaattaaattaatactccttctttggaaagataaacataaatgataaacttctggctagactgatgaagagaatagagaaatgctacaaattaccaataacaagaatgcaaaaaggaatataactacaaagtaagaacaaatttgcctacaaatttgacaacttagatgaaataggcaaatcctagcgaaacagaaattaccaaaatgacctaagaaatcagaaatcctggctgggcatggtggctcacgcctgtaatcccagcactttgggaggttgaggtgggtgaattatgaggtcaggagttcgagaccagcctgaccaacatggtgaaaccctgtctctactaaaaatacaaaaaatttgctgggcatagtggtgggcacctgtaatcccagctactcaggaggctgaggcaggagaattgcttgacccaggagatggaggttgcagcaagctgagatcacaccagtgtgctccagtctgggcaacagagtgagactctgtctcaaaaaaaaaaaataatatatatatatatatatatttatatatttttatatatatatatatatgcaatctaataatgtatgtttaaaaatacatcatgaccttgcaccacgagtgcagcctgggtgacagagctagaccatgtctcaacaaaaaacaaaaccaccatgacctactatccaggaattattttttaaagcaatgtattagccagtttaacaaactaaaaaattaaagtgatatgaccatctcaatagctgcagaaaaagcatttgataaaattttatacccattcatgatacaaactctaagtaaacttaggccaggcatggtggctcatgcctgtaatcccagcactttcggaagccgacgtgggcagatcacctgaggtcaggagttcgagaccagtctggccaacatgtcaaaaccccatctctattaaaaatacaaaaaaaaattagccaggcatagtggcaggcacctgtaatcccagctactcgggaggctgaggcaggagaattgcttgaacctgggaggcggaagttgcagtgagccgagatcacgccactgcacaccagcctgggcgacagagcaagactcagtcttgggggaaacacacacacacaactttaagtaaacttgtaagacaagggaatgttttcaacttgacaaaatgcttctacaagcccggccaacatggtgaaaccccgtttctacaaaaaaatgcaaaaattagccaggcatggtggcacgctcctgtattcccagctactcaggaggctgaagtgggagaatcctttgaacccaggaggcgaaggctgcagtgagccaagactgcgccactgcactccagcctgggcgacagagcgagaccccatctcaaaaaaaaaaaaaaaaaaagcttctacaaaaaacctgcagctaatatcatattcaaagatgaaacactgagtcctatttccttatggctatatatgaggcaaaaaatatccactctcaccacttttattcaatactgatatttgaagtactaggcagaagaaaaaggcgttctgagaagagtaaaagagaagaagtaaaactatctttatacatttaagtcataattgcatacgtagaaaatccttttaaaatctacaaaaacctactaggactaaaacattgaatttaaacaatgttacagaataaaaggtcacaaaattctattctacttttgtgtataggctatcaaaacctggaacataaaattcaagaataaaatatcatttttacaatggcattgtaaagactgagatattctataagagccataaaaaaccccatgagataatatgggatacatttaacaaaatatatttaatacctatacactgaaaagtacaaaacattgttgagagaaataaaagacctgcctaaataaataaatgagtggatacaccatgtttatggattggaagactcaatattgttaaaatctcaactcttcccatactgaactgtatattcaaaataatgctaatcaaaccccaagtaggttttttttctgtagaaaatgatatgctcattctaaatttatgtggaaatgcagaggacccatagtagccaaacatttgaggaaagaacacatttggaggatttaactaactcatttcaagatctaccataaagatatattaatcaagtcactgggttactggctaaggatagatgtatacccagaagagagtatagaaacagatccacacatatatgatcatttgatttttgtgaaaaatttgtagataattcaatgatgaaataagtcttttcaataagtggtgctggataccttcatatctgtatgagaaaaaatgaaccttgacccttatcttacatcatacacaagtattaattcaattgtagcatagatctaaatataaaatctaaaaatataaaattcctaaaagaaagtctatgcaccttggtgcatgcaaagatttatcaggacatagaagtacaaagtataaaaagaaaattggtaaactggacttcatcaaaaatgtaaaacttctgctcttagaatgattttattaagaaaacagaaaggcaagccaatgactgggagaaaatatccaaaatctaaagtgttcaaaaaatatctacaatttaataacaagaagataaacatgccaataaaaagatgggcaatagatttgaacagctacttcacaaaagaagatagactcatgaccagtaagcatgtgaaaatctgttcaacatcattagtcgtgaggaaaaggtaaactaaaatatgaatgtgataaccttactcatctattaacaataccaagtgtgggagaagatttagagcaactatcacacagtgcaagcgggagtgtaaactgatataaccactttgttttttgtttccatctcctccagcatttatcctttgtgttacaaataatacaattagactcttttagttatttttaaatgtacaataaattactgttgactatagtcaccctgttgtactatcaaatactagatattatttattcaatttgtcaggtttttacaaagttaagcatacttaccatataatccagcaattccactcctagttatttatccaagaaaaatgaaaacttacatgaacgcaaagacttgaacacaatgttcacagaaattatattcctcacggccaaaaactagaaacaacctgttatggacaaaactgtgtcccctccaaattcatacgttgaaccctaaccccctagtgtgactatatttggagataggacctttaaagaggtaattaaggttaaatggggttataaggataggatcctaatccaacatgactggtgtccttataagaatagggagagacaccaaggatgtgcatgcacagaagaaaggccatgtgagaatgtagcaagaaggcagacatttgcagaccaaggagagaagccccagaagaaaccaaaccttccggcactgtgatcttagatttccagtctccagaactgtgagaaaatcattcagagggaaataaacaaatccacagttacagaggaagattttaacatgtctttcagtatttgagagatcaagaatacaaatatagtaaggatttataagacttgactgacactattaacaagcctaatctgtaaatatatataacatacatatatgtgtccaccaagaagtgagcacagatgcttttcaaggtcatgtagaatattatcaaatattgattacataatctgccactaagcaattcttagcagataacaaagaattaattatcataagccattttatctgatcacaatattagaaacattagacaataagatattagacacaacaaagtaaaaatagactaataacctcaagtcccctgcacattggaaagttttttaaaacttcaggtcaagtgtggtggctcatgcctctaatcctagcactttgggaggttgaggtgggaggatcacttgaggccaggagatcaagaccagcttgggcaatatagtaagactccattgctacaaaaatattaaaaattagctgggtgtggtgactcacacttgtagtgttagccacttggaggctgagacagatggatcacctgtgcccaggaattggaggctgcggtgagctatgattgtaccactgcactccagcctaggaacagagtgagactctgtctcaaacaaacagacaaacaaactttagtaattaaaaataaatcataatgaaacgagatgatattaaaaactgaatggcaatgaaaggattatctcaaaacttgtgggctgcaggtggctgcacccaaaaaaatagaaatttccagtcttcaatgcatagaaaagaaataaaatcatgaaatctgatacatttattctaaaattcatctgagacaggttaataaggaccaagtacagtccagataatttgagggaacattaattcttccagatatcaagactcaacataaaattataatagctacaagagtgtgttattgacaaggggataaattgaccaatggagcagaatgtatgggaacttatttttatgacaaagtagacttgacttatatttcagagaagaaaggacaacggatatctattcacaaaaataaaaattatatgtctacttcgaactgcacaaaatcaatctcaagcaggttaaagtcctaaatgtaaatggcaaaatttcacatactttcaaacatttagaagaacttttaaatgaaaatataggaaaatatctctctggccttgggattgtataggatttcttaaagaagacataaaagtataaactatataggaaaatattgataataattctgagtatatcagaactgaacatgtctgtttatactgcaaggaaggtgaaaagacaagccacagacaaggacaatataattgtaatatctttaagaggattattatcaagaatacatagagaattccgttaaaaatcaatatgaaggcagggtgtggtggctcaggcctgtgatcccagcactttgggagggcaaggtgggtggatcatgaggtcaagagatcgagaacagcctggccaacatggtgaaaccccatctctactaaatacaaaaaaaaaactagttggccagggtggtgcgcacctgtagtcccagctacttgggaggttgaggcaggagaatcacttgaatctggaaagcggaggttgcagtgagccaagatcacgccactgcactccagcctggcgacagagcgagactccatctcaaaaaaatatatatatatgaaaaagataagctatgcaatagaaaaatggccaaagtttacaaaaatttcattcaagagaaattcaagaaaatgttcatagaggaagaatcctaaatggcaaagaaacatgaaaaggtcctcaatttcacttgcaatcaaggaagcacaagacaaaaagtatggaaaaaattgtctgacaatatcaagtattgattcacatttgagaaaataactcaggatttcttatggcagaatgacactttagagagcaatttgacaaaaacttagaagagctgaaattgcacatatcttggatctactccaggcatatagctttttaaaattcacttccaggcataaatatagggaaacatgtagtcaaggagaaatgtaaaaggtttgttgcagtgttttatcacagaaaaaagtgaaaaaaaattaactttccttcaatatgggaatgaattttaaaaagggaatatttatacaatgaatatatgcaactgtttgagtaaagcagtacactatatatatatcaaaatagatgtgtcaaaattataatattgagcaaagagggcaagttgcaaatgaatatctccaactatgtttgttttcacttaaataaaaaccaaaacataccaaataacattatacattatttgtgggtgtaagattgtagaaaaagtataaacatatgcaaaggagttagacacactgacaggaaagttatgcacaccagcaactagggaggtaggagggaaaaggatgagagaagttttatctgtaatgttttatttctttaaacaaggagacatttgaagcaaacatggcaaaatgttagtatccttacatgtgggagctggggatatgtttatctgttttgttacttttgcacttttatggtatgtttgaaatagtttctaattttaacaaatgctaatgattgttctggatgtagggtagataagagattgtagaagaatcaaagtataaggagaatggttagcatgctacaattcacagtacatttaaataatttacgtgtttgttcatacatttaatttatggaaggccaaacaaaactcttttaaatatgatgcaggatgtattataagcatatttttccaaacttacttgctcaacctctctgttgagggaatctactttttcttttaatctgttaccctctgcctcagcagtgataagttccagtttgagggtattgttatctgcctctgattgacgggctttattttcccagttttcagcatcttcattggcttttcgaagttgttccatcatttgccggttctcagattcctgaaaagcaaactttagctattactttaaaatgctgaacatatgataaaaattaaacattattatccaagtcattgggaattcacttgccatgagaagcgtttataatagaaccctgaggaaatatatctatactcttagtttagaaaacaggtcatcctgtaattaacaaagactgcaatcagcatctgccctggctcctgagtaacactcagtgaacactagtaaatagtaaatttaggtaaattactcttttcttcaagacctgaatgaatttgttcttatatttccttttgtttgaagtcctccacagcctgcttttcccatatgtctgcttactgactacttgctggtctggattctgagcctctgacctttcgtactggtgtattcccttgttcttgaccaatttaccgggctgtgctggctacagagcttctgagtacttgcatattttaaatgtcagcttctgataatttcctgtctggtgtctgccttttattcatagccccagccttaattatcttgatcatgaactgttctatgattatcttttacctgctagtctagtaactttccctgccagtctagtaactttcctgaaattgctcagaagtaaactatcaaacctatgccaataaacactagttgtaaatatgcattcatgtataaattgagcatacaataagaaccagattttttgaactttcaaaattctatcatgagcagagtaactgaagtagggtctgatttctagtagggaaataaggagggaaaaaaattcagctccacaaacaatataatagaccgagtaatcattattaggctatttaaaaaaatattttattatggtttggtgaattcattctaaaaaattagttgtaattttggtaattttttaaaaggcactagatctctttctctcctgttaataaatagtgcacgtccctatcagaaatcctgggctaaataaaatgaccaaattgcaataaataatgtctaatactcctttcaaatcagataagccatttcctgattatgtttactggtggaaattcagctaatattgccaccttgtggcctctaatgtgaaagatctttgccaagtctgtgttagtcaacaatatactaaactaccttattggctttcaagattcagatactccaactgtgtcagcaggaacctgatatgtgttttccatgattgtactaacaatcatagttgtgtacagagtatgtacttggagggtgcttgtacaatatacttaaacgaattgtattcacattgatctttaccctctttaactttgtgcagtacttactgtctatgtcattcacttaaaactgccttacagctttgtgttgctaggtgtggatgtaaagcctccctgataacaccttgtatttctctaaagcaggaaccatttttatattaaatttagttctgtgaccaggtagtacattattcaaagtgaaaagggattccgtagaatgtctctcctgtcctccaaccacccagtgctccctccttcttggcaagcagaaagcatattttaccctttttcatatcctcccatagaggccagagcagtgttgagcatgagaggcaacactataaagaaaatgaaactgttctttggtattctctatttcctgctttcaggatctctttacttctatatggtgcctcccctgtatccacagctccctctggccacccacaagtctcactgcaacactccgtaggcctcagctggaatcctttgcatttcttgcctaaattatggttacaacctcttctaactgctctctccacttctgattttgttacccttctggtttattcttgacgtttccaaaataaacttcctaaaaggcaatccttaaataacttatatgttttagttctaacaaaagcttctgaaaatagggttcaaagaaggtctttcttacctctcctttatcatccacttgtacacactactctacctacaggacctactttttcccctacacctttgctcatgttgttcccactgcctggcagtcattctgtttcctctccatttttcatctctggcactccagcacctagcacgctgcatgaatgagtgaatgaatgaagtactccacacttcttgatggtctatccctatcaaaatggatccgtggttcattctctccgggcctgcatccatccagtgttatgcaatctcataaacaaattcatactaggatgctaaaatccccagcacttcggaaggccgaggtgggaggatcacttgagcctaagaagcttgatgtgtgatgtctgaaaatataattctagaatctaaaagttataatccctaatggtggaatttcaggtaatgttactaacagacaagggagataaagggaagtgtttaacactggctgaaagcttactatgttaaatgttgctctggggtgagtgcagtggctcatgcctgtaatcccagcactttgggaggccgagacaggtggatcacttcaggtcagaagttcgagaccagactggctaacatggcgaaaccccgtctctactaaaaatacaaaaattagccgggcatggttgcatgcacctgtaaccccacctactcaggaggcaggagaatcgcttgaacatgggaggcaaaggttgcagtgagccacgattgcaccactgcactccagcctggcaatacagtgagcctgtctcaaaaaaaaaaaaaagtgttgctctggatattcatttatttatttctgacctattctagaatagattcagatggctcactgtgctaggtgttttaaattatctcacttacttgggtgttcttcccgattacagatgggaagaatcagagaggctgagtagcctgcataaataaaaagccttttgttcatttatggtattacattgctggaaccttaaaatcaggaagtgtaggaaaccacgtgcttttcctacacaggctgcttgctgcctgaaagcaaggattgcaatttagaaatccttagaatctcttctgtctcaaagcccttaacagtactatgcataccataaataaatgttcaagatatgtttgtggactgacatgaaatgataaaatagtataggtggattgattattataataggtatagtgttacctacataccactcaaaccattaatgggaacatcctccctcaattttagataatattttacctaatagacatatctaaaatcctcagtaaagctgcctgtttattcctgagttgccacacatgcaccacacttattggagtcatctgatgtcatgtacatgtgcctggtcaaatgattgctaacagagaagtgtgaggagaaccatctgccttgtggtcctaaaaaaaatagatggtcccataacagggtaaccaattctgatctgctacataatcaggtggaacctcttttgtcagaggtttataactggaaaccccaccactttcaattaattataagcgaggtcaaattgattttagccctttgtccatcatccagttaggaagattctgcttgtctagagtggcagagttgcaaaacaaaaggggcatattctccaggcatctttctgaacattctaaatatgtagttaacccaccattgtcaaaactaaaatatactatgtattaaagaaagctttgattcacctgtcgttctgagtataccaacttctaaattaactctagtgaaaactaagtatcatgagcaaaaagaaaaaaaaaatacatacttcagactttaatatattcttcagcttgttaacctccaaattagtatcttgaaccttctgttttatgtcattaagttcattatgagtgtcattcaattttttggacagtgcctacgaaaaaaagataggtatatttgactatgaaaaataaaaaatttctatatctcaaaaataccataaacaaatttttaaacacttggaacaaataaaattaacatacctaatatataaactcatataaaaaaagaaaacacataagcccaatagcaagtgggcaaatgacccaaataagcaattcaaaaaaggaagcataagtaggtaagacctgaaaaaaactctactagcaactgaagatatgctaattaaaacaacacattactattctgcttatcaaattaataaagatttaaagctattcagctatggtaaagaatgggcatttccatgtactactggagtaaatgtagatttgcagaaagcaaatctgtgatcaggaatctggtgatgtatcaagagacaatttttaaatgctcataaaaacaagaaagacaaaaatgttgattatttttgaaggtgggaaatggcacatggggattcattatatttgaaaatgtctatttacatttttttaatttaaaaaagaaacctcagctgggtgtttttcctgtaatcctggcactttgggaggatcacttgagcctaagagtttgagaccagcctgaacaacatagtgggaacccaactctacaataaataaataaataaataaataaataataattaaaaagaaacctgataatctgtgattcactctgaaatgaaatctaataaaatttaatgagatgctgtcattaaggcatttgttacagtgacaatatttattcacattaagtgaatcatgcagtaaataatagtatatctacatagtggcataaccacataatggaatattacatacctgtgagaaatgtttggaatgatttttaataatacagggaaatatttgcctatgttaagtgaaaaaaaaatcgtgctaaaacacaaaaatacctcattatcccaatttgttaaaaattgtggtatcaaggataaattttttttaagtttccactttctcgtcttctgcaatactggttcttaacctgtggtccacagagagagacctctcttctaccttgggcctatgaccataacgaagaaaaaactacttttgagcatatgtaaattgttatgacaacagttttcttctgattataaaaaatgtttacaaagtttgaacaaggcaggaaaatgcttacaatattatagtaagctaataatagctataaaatatttattgagtgatatactggacagtacagtaagtgctttccaggtatagtctcacttattaaccatttttacagatgctacagagactcagagaagttggtttatatgatcacacacgcagagagcaagattcaacccatgtgaatcttactcgactctactgcctcttcatgtagaaaaaagcatgatctaaagtgataggtgattttatcccactacattagaaaatgtgtataaaaatagtgttaaaatttttaagtgcactgtatagcaattaaaaaaatatgtcaaatataacagtaactgagtatcaaaaacatgggggcttttctaaactcttaactttttgtttagaaaaaagactttctataataagcttctatttctaaaccaatcaaaaaaatagaaactaaatttctaggttttcataaataagatatatccacctttagcccatatgctctagctgtaaagagtacacaaaggcaaaccttacaaattcccatgttttggtttttattgctattcattaattttttaaataaacttttagaatagttttagatttacagaaaagttgtgaagacattataaagggcacctctattgttaacattttacattagtatggtgcatatgtcacaattaataagccaatattgacacattattatctgaagtccatactttattcagatttctttccttttttacataatgtcctttttctattccaggatcccattattcatttacttttaaacaaaatactttaacatctcagataattttttatgattaacaaagtattacagctttatagctgtttaagtaaattaataatcttcaacagttaaagaacacagactttcaggatgcaaactaaacacactgaaagtgatacaaagtggggaaaaccatttggtcttaaaaattttgagaagggaagaaattttccaaataggatttttaaatgttcacgttaaaataaatgttattggaaatgagaactgcagattagacttaaatatattgccttagggagaaagagtaattataagaggaactttcctaaaaagaatcacagtgctaatgagaaccaaaaaacaaggcacagtccatacattcatacttaaaacagaataatatgtagtccatttttttaaaaaaaaaacacctattcttttctttaaggtttctcaaggtttttattctcattttttgattattcaaatatttatccttcagcaaggaagtactaagctttaatacaaatatagccctgttctctcttttctttaatatttaaccctttgtgtctgagaattccatttaaaaattatgtggcctattttgttattttttaaaaaaaagaaaaggctagttccagtgtctgagctcttctataaaataaaatgagggctgttcctcacaagaaattcatatttttttttcttggagaaaatgattctaggaacaagtgtacctggttttcttgtttagctttagcaaactgttcctggagattgtcattgtcatgagccaagatatctctttccctggcgatctgggccagctcatcatttgtctcatccaattgccgacgcattctggaaacgtcttgttcacacacaattagggcctcagtacactgtctattccacaaatcaaagagtacataagaagagacattttactgaaacagagcaacaaattctcacaagacagaagatggacagttagtatgaaaacatttgaagagattttaaacacgtttgaatttataggaataaatactgcaaagacagtgcattagagtttctcaatgttgccatcatttcgctatgaaaaggatacaaagtatacataatagtcaatgatttgccaaatatttcaaaacttcttacatcaagtattaggaaggctttcatcctacttctgttatggcttagtctcctttacagattcctcttcctctgcccacttaaaaattaatgcttttcagggctcaagccctagcctcccaattattctcactctaacccttctctcagacaaactctattcatatccatggttcccaaccccatctagatccaatgactccaaaataattatctccagttttagaccctctgttatactccagacttatatttaactgcttactagacatgtctacaataaggtcccaaaggttcttcaaattcagaggtaaaatcattttttctcctcatactttcttcatgttcagtatttgtccctggccagaaacttggcattttcctggtgtctctccctcatacaaaagcatttcactccttctgtcccacaactcctaaaccccaatttatcaccacctcttctgcttaggtatctttctaacacaaaattctcctcagaattctttaatgatttcttattgcccaaaggatataaccaatactcatttgtctgttacacaagcctctgcctgcctatttagtctcctcccttcacttctccccttacactctaggtttcaacaacactcacccacttgtaggtcaagaggcttgtcaacatgatctgtggttctttgctattctttctactttaaatgcccttcccttccccttattttacttggcaaacaccatcccctcttttagttccttagacagacttaggcctcctttgatgagagagttagcaccttacacgtatcattaagccccttgtttcttactatctttgtacctaacatggtacttggccccccagtaagagctcatatatttgttgcacgactgatttaccttgatgcctgttccatctcagcaatgatattcttcatgcctgaaatggtcttttccttgaaaaataatataagtattaaataaaaaaatcttaagctgttatttctgttaaaattgaatgaacaaaaagaaaatttccctttccctttaggtttccatttggttttaaaaacatgtatgtcctattcttttccacactttaaagcctagtatatcaatgtgaatatttgcactgggtaaaaatagattatgttcattaaagtaaaggctatacttaggtgtaattatgagatcagtatatcaaattctttgtcaaaagatattttatgcagtcacccagcaatacaagaaccctataaccacctgtttttggaggcaaaccaatggtttggcattggagtattggcattttatactgggatttagaactggttctcttgctcacattctttatgttataaaacccagagaagccaatcatgtatacctaaatttagtttttaagaataattttgattaagtgtattatttatattagccagcaacaaaatcttcaaaaagctgttccaatccaattacttatagaagtatactactgatatttaggtgagagctaataagaaggtaagcattaggcctcgagcaaaggtaagagaaataaactatattttcctttttcaaaggcgtgatgagggagtagaagtagtggagtcagtcaaggcagaaatgggtttgaatatcttaatgcctttaataccattcccacacctctttttaaaacttccattgaccctgaactagtccaactataaacagatacttagagctaacattagccctaaaaaagtaagaaagttatttcactaagtaataactagatttcaccttgccatttgaattttcaaattttaagtaactaagtaaaaagatttttaaaaacccaaacctatattttccaaccaattctgttcctgtttcttttctttttttttttttttttttttttttttttgagatggagttttgctcttgatgccccggctggagtgcgagggcgcgatctcggctcactgcaacctccgcctcccaggttcaagcgattctcctgcctcagcctcccaagtagctgggactacaggcatgcgccaccatgcccagctaattttttgtatacttagtagagacggggtttcactatgttggccaggctggtctcaaactcctgacttcaagtgatccacccacctcggcctcccaaagtgctgggattacaggcgtaagccactgcgcccggccgttcctatttctttagcgttagttttacacatatttgcgtgtgtgtgtgtgtgtgtgtgtgtgctatcttcctttattcatgtgctcttctccagggtatttttagctacagtttcccattctgctttctcatggaatggtacagattccacatctggcagtaatagatactggtgtgttgttaaaatatgcattaaaaaaaaagttaaaccccttcaagaaggacaagccaacgaaggaaaaactaaaagacaaaatactccataaaatggaatgtttacacatttttgaaatataatttaatacatttctaaacaaattctgaaaagctagttgaactagtgcttttgaaagtctttacttgaggccgaatgcggtggcttatgcctgtaatcccagcactttgagagggtgaggcaggcggaacacgaggtcaggagtttgagaccagcctgaccaacatggtgaaaccccatctctactgaaaatacaaaaattagccgggtgcagtggtgggcgcctataatcccagctactcaggagactgaggcagggaatcacttgaactcgggtggcgagggttgcagtgggctgagattgtgtcactgcactccaacctgggtgacagagactccgtctcaaaaaaaaaaaaaagtcctttcttgattaaccttaaaatatgtttgataagcctaaaaagggcttcactttatcaatataagtgcatcttaaaaaaaaatactctagaaacattgtaaagtatccagggcaacaaaatttctgggttgaatccaataacatatactcttagcctatttttctcttaatatgaccctaataccaccatttctcaaatgtgccatcattccttgtacaacctcagtatgttctaagatgtattccttgtacaacttcaaggtttaacaattttttaaaataatatttaatatttcttattcaacctcatatgttgtccaactagggatgtagattcatgttaactgtcaaaattcagtctggacaggatggtgctaagtatatttagaaaaaataaactataactttattcaaataattctggtttttcttacccaaaaatctatgaagttgccattgagttttctaattttaattggtagcaagtagtaaaacatctttttaaaccatggatactagaaaaaaatcactttattcactataatgtagacttttccatgctaatttatttctgtaatctctatatgaacagtattagttttcactgagtagcctttgttagttcagctctgaggtatcattatagagaacatttcctcttttgattgcctaatggtaccttgcaagttattttccctacagaggatggatgtgtttactttcataaaatcttatacaaagttcttgattttgaagtagacttgtaactcaatattgcttgtgaaggaaatataacattgttacggttcgcagaatggaagaaatgtgaaatattagatatagcacaagaaaatgagattttgaaagatgtgaagaattttgcttctaaatgttagtgttgtgaaaggaaatcatgcttaaatattcaaaaatgttttgaatataatgagaagcaaaattctacctaaaaaacctaaaatttcaaaacaatgagtcagccttttccacaagtatttaccatctcatgccctttgatgacctcaattatgttcatgattcccaaatctattaactttaattaaattttcctccaaacctaaaagtccaagagcctttaaatatttcaatatttcacctacataacccaaagacaattcaaactcaacatgtcaataactttcctttctaagcctgttctagttcctgtttcttccttcatacataggaactatccatgtgattcttaagccagaaaccataccttgtcaattttacttccttaagagacctatttctctcactgatactcctactattctaatatagctctcaacactgttttcttaactagtgtccctgtcactactctcatttccctataatccatcttttatacgaatttacaaatgccagaatatttgttataaaataaagacctaattgtaacatttcattatcattatttcagtgaccctctatatccatgatgatagatctcacactcaacatcacatgtacttttatgatttttttgcttaactatcccatctcttcatgtatctatatctctatgggatatagatatagatacatgaagagatgggttatatacatatatacacacacacatacacacactgtaaggttgcaatgagcatcacagcagagaagggactgtatgcctatcccatcttttctttgccctcccatatctatctctctacaacctgttctctggccatgctaaactatcaggaagtctcatgaaattctcatgaaagccactggactctcacttaagctgttcaacctgtctggatcaccctttctcattgtcttctttccctgactactatctagtcattctcctgactactatctagtcattcagtgactactatctagtcattcaaatattctcctgactactatctagtcatttttcagggtagtccaggcaccatcacttaatggaagatttttccagaccttcctcctcccttaacccaattcccaggctgaatcaggtgtgtttttgcccaattccaacaacacattgtgcatatgtcattatggcacttaatgtattctgtcataacagtatctttatctctctccttattacactagaggctttgagaaggcggaccattcacctttttttttttttttttttttttttttttttgagacagagtcttgctctgtcatgcaggctggagtaggatggcacaaactaggctcactgcaacctccacctcccaggctcaggtgatactcctgcctcagcctcccaagtagctgggactacaggcatgtgccaccatgcccctgcctcaccctcagtttctaacataacatctggtacatgtcaacaaatgtttgttgaaataatgaatggatggatggaaacataaattaatgaatgagttaccttagtaataaagtaaactaataaagcccttattccaatgatgctgcttttgcttaagatatttgtgaaaacagcttaggaactgctttcagaaatcagtttataagctagaaaataatatcagtatctctgccttgttggcaacaccttttatttattttatttatttatttttgagacagagtctcgcactgtcgcccaggctggagtgcaatggcccaatctcggctcactgcaagctccgcctccggggttcaagcgagtctcctgactcagcctcctgaggagctgtgattacaggtgcccgccaccacgcccagctaattttttgtatttttaatagagacgggggtttcactatgttggccaggttggtctcgaactcctgacctcatgatccgccctcctcggcctcccaaagtgctgggattacaggcgtgagccaccgcacccggcctgcacgcggccggcaacatcttttttcaacaacaaaaatgtgggatggaggttatcatccagctttattcaccagccctatatgatctattctcaaagcctgaggatgatgtaaaaatgtgctcctagggcagggtgcagcggcttatgcctgtaatcccagcactttgggaggctgaggtgggcggatcacgaggtcaggagattgagaccatcctgactaacatggtgaaaccctgcctctactaaaaatacaaaaaattagccaggcgtggtggcaggcacctgtagtcccagctactcgggaggctgaggcaggagaattgcttgaacccgggaggcggagcttgcagtaagccgagatcgcgctactgcactccagcctgggcaagggaggaagactcccgtttgaaaaaaaaaaaaaaaaaaaaagtgttcctagttctaaacacaattacaaagggtaactacctgaaaatatgcttttaagaagaaatcagtctcactactttattgtcatgctttatattttgatatctgaattagttcttgccaattgatattaattactaattcatgatagaaaaatcaacttaaaatattagctactagatttgtacacatgcttcctaagactatcttaaaatatttcaaagtcagattttgaagttccagcttctagaaaaacatttgagaaaattcaaatattttattcagattctagttcttttaaaccatagtttaacatttaacatttcatttaaacgtttcttataaaccacagttctcagaacatactttcattgccaaactctctccaagggatgcaatattctcagattttttatccaaacatgcttgcaggcattccttttctttagccagatcattgagggttccaccaagaatgctgatttcttctcgctgtgcaatattttgccttgtaaagttatctatgtatgcaatcataaaagtgttgttttaatcaaaataaaatcttttttctatttcaagcagattatcgtactttttgaacttctccttacttctaatatatattatattcaattactaacaatgagtactatatcccaaattaaaaaaatttttttggttaaaaactacagtgaatcacaaaactctaaatgatgcataaacacaaaagcacaataacaatgaattagaatagtgaaggaaagctctacatcgcaagctgtcaaagtagacttaatgtatgatgggaaaagagagagtgggtggatgaagtaagtggaatatcaaaacaatctgcggcatttctctcctgtagtttcccctcccctccctctagcctagaatcactgttgtatataaagttggtaagtaacaaatcttaataaaatattcaattaagtcatctttaaagtaaaatgtcttctaatattctggtatttctaaagtagtgttataaaaattcctaggaaaaaaaatcatcccaggaagtatgattcaatctgtgagaactcttgcaagccagtgtcaacgttgaaggcctgaatgattggtacagaagaatagttttcaaattgtggtttctcaaccagcaccatcagcatcacctgggaaatgtacattcttatgcctccactccagacctactgaatcagaaattctgggggagggcacagcaatttatgctttaaaaactccttctttccccagtgattctaatgtataatgaggattgagaaccactcgtctagaggagtttacctactctaggtattagatttacctacagaaactgttagagacacaaaagctctggttctagcctacttcaaggaggctggctccagtgatctttattagctctcaaggtgattctgacacagatgaaagtttgagaaccactggtctagagctctacaagggaagctctgttagacagacttctaggttaatccctactaggttaatacctgtgagggccatccaggagcagtgctatgggagataataccatattgtcatatgccaaaagcttgatctatatagtactggagaatacaccatgtctctttttgcaggcagtattgcctttaagacaacccgcatgttttgtgtgtcctgatatctgagttcattcccactggcaatcaaacaatcaatacatctctaaaatagctctagtatctcctagcttaaaaaaattatcaacctaacagcccactcaaactattaccttattttcttgctaccctttaatagccaaacttcttgagagacttctattcttttctgtcctgacttcacttcccatttattcctcaacccactctatcttctacatccaacactccattcaaacttttttttggtgttaccaaatcttccaatgtgccaaatccaatcaatatttttctttagcctcacttatttcacttctcaaaagtgtctgacaattgatcatatcctccccttttaaaaacacttcgctttctggtcttccaaaataacactcacttctgggtcttcttcctacttctttggcttcttgttactcagtcctggatcctcttctcattctctatatttccctaggtaatttcacggttttaaaatatcatttatatgctgatgtgtcccaaatatgtatctttctcttctgagacacaaacttaaatattcagctgcttaccttagatctttattgggacttaaaatacccaaatgtgagttctccttcaatattatcttttatatttctgttttaatatttcccggtttgataaatagtatctccatctacctagttggttataccagacattcttgaactatataatagcaagtgttaacaatatttcctctgctttaaaataggctcttctatagccctgaccaaaattttaccctgtaagattaagttaggaccatattttcatactgatcactaacaagaaacataaataagaaactttaaaaaagtaactttctctataaaccccagtaatatcatagacataactaacactatccccttggtgataagtgagttctcgctagacataactaaacatatgtacactttccaccaaaagtaatatataggtactgtttcattacagcagctatggacaagctacaatattacacaaaaaattcaaatttaagttatcatcgtaagtttacaaactgttgctgctgagtttagctattacttcattgataaattttaacttatcactaagtacttatggtgctaaatctaaaaaattttgctgtcaaagaaaaatgaatttctctactattttttattcataaacttagttaagggcttgtttccaagtttttctatgttatactgaagagaagaaaatacatctttgctaccaaacttaagaaaaactaaaagtaatattaagagaaaaaaactcaccaattttttcatccaagcacataattttctcctgagtaagctgtagctcatattttttcttagcaaggtgtcgctgagtatcagaaagatctttttctgtgttttcatacaaaagtctgcaaatattttaataataaaactaattctgaaatttttgttttgtcatcttgtagtgtgtttaaatctaaaaacttttaaggacactaatatatttatttcctcttaatatttttatacagttttaatattttcattataaaaccaggaagtttaaaaaataaagggtaagaagggatcttcaatccaccactccaacataagctactattagcattttggtcataataccttccttaggtcccctaatgccaaatcagagcaatcagattaggaactactatgttagctctggttggggtttgtctgtctcaatagcctagggttttatgttttaattcagaaacaagatgaggccatagagatgtctgcaacacaggaaatagaactaaggtgtcccatgtaaatatggagagatataccattagtgagaaggtcagactagagaaaaacaccttgtcaattgctgctaggctcaggaaaataataacaactgtaatgcctaaccttgttttttactaactctatttttaaattttccctttttgtctccttaactacctagccttgtttcccatataaataagactctcccttagctgggaaagccggacaaactccatttggccccttgatttacaagacattaagggctccttacccgacccccttcctcaaggagttaacctgtgtaagcagaccctcagcatttcaaaggagccaaattaactgataaggtactggaacaaacaatgtgtgaagttcccaggattttgctcaaaaagataacaacataaagccttgagtctgtgtccagcatagcatccatatctaacaaaggatttagagccccgcacctggttccgttgcttttttttgtaaccatttgccttttaaattgttaatctctctgtaaccatttgtttttttgattcttgcatgtttttacttctgtagaattattgcatttgagctcccctccccttcctaaactaaggtataaagttaatcaagccccttcctcgaggctgagagaattttgagcgttagccgtctctttggccgccggcttaataaaggactcttaattcgtctcaaagtgtggcgttttctctaactcgcttgggtataacacaacaaagagtcttaatctcaatctaagcatcaaaataaaatttggttcccgattggtcatataatcaggaaccccttgcaaaactctggaggcatgctctcaacccaagcacagaactaaccccagacaaaggcctatggaaaaggatctcataattcaaaatttaaaaatacatcaagaaacaatccaaccttagtgggagtcaaaagacacacaaactaaattagatccctaagaacttcagactacagcactatcaaatagaaacttagaaatacatgtgtttaaatacaaacacataaaataataggatatataaagaaaaaaataatcaacaaatttggaaaagaaccaaatagaacttcacaaaattaaactaacatcaaaattttaaagattacaaaactcagtggacaagttaaaaatacagaatagacactgtgaaagagataactggtaaactggggaaaaaaacagatcagaggtcctatattagagcacaaataaaacaatgaaaaaatacaaaatagaggttaacagacataaaagacagaataagaaggtccaatatttaccaaatcaaaatcccagtagggaagaataaagacaatattcaacaaaataatacctaataaaagatgaaatccaagactaaagaggtattaacctgtatctattaagacaattataaatgggggaggataaaaggacttaaaaggagacaagatttctatactttatgcaaactgataaaatgtgacaccagtggatcgtgataagtaagtacaattcacagagcaaccactgaaaaatctatagacactcaaaaatactacagatatcaaaaatgggattctaaaaaatgtcaagtaatccatgaaaaggcaggaaaacaaaaacagagacatgagaaacagaggaaagaaacaaacgaaaaacacccccaaaaaataacatggagaattgagccctaccaataattatattaaatgcatatggtctaccttatttttaacagccaaaacctggaaaaaatcaaaatgtccctcaccaggtgaatagctgaacaaattatggtacattcatactatggaatgttactcagcaatattaaaaagtagcaaaatttaatacttggctggatctcaatggcattattctgagttttcaagcgaatcttgaaaatcatggctgtatgactcttcctataacattcttgaaatgacaaaattacagagttggacaacagattagtgtcagatattagggatcatggtgggggaagaggagatgtgactgtaaaggagtagcatgagggatatttttgcggtaatagactttccgtgtcttgaatgtggtagtagttacatgaaactacatatgtgataaaatgacagaactatgcacacacattgtaccaatgtcaattttctggctttgatattgtactatagtgatataaaatgtaatcattgtgggaaagtgggtgacgggaatacatcgacttatctgtatatttttgtaacttcctacaaattatgaaattattttaaagcagcaaaacaaaaaaaagtcctagagttaggctgcacaattatgccaattaaattaaaatctctgggaatgagaattaacatcactattgttttttaaagctcctcatttgattctaatatgcagccaaggctgttaaggaatgcatctgatatggtttggatgtttgtccgctacaaatctcatgttgaaatgtgatttccaatgttggaagtggggcctggggaagagatgactggatcacgggggcaggtccctcatgaatggtttaacactatccccttggtgataagtgagatctcgctagttagttcacatgagatctggctgttcaaagaaatctgggacctccccttttctcttgctcctgcccttgtcatgtgatgcactggctccccctttgctttccaccaagatggcaagctgtctcgtgccctcaccagaagcaaatgccagcaccatgcttcctgtacagcctgcagaaccataagctaaaataaatttcctttcttttaaaatgacccacactcaggtatttctttatggcaacacaagaatagactaatagagcctcctgatgtctcttcatctagggtagcaaaaggtgaaaaactgacaaagcaggtgtatatgaggcagaaagtgatagtggttttatggcatcagcgtctctcccatccccccataccatgaactcaaagaggctgatattgttagtcacccaagagcattgttttacacaataacttatatctccatggcaaaatgtgtcccagggccaaaattataagacatttgagatggccagtcatttaaaaacgaaacaaaacccactgattacaaaatcaagcagaagctggtatattagaataagtgcatccaggccgggagcggtggctcatgtctgtaatcccagcactttgggaggccaaggtgggtagatcatgaagtcaggagtttgagaacagcctgaacatggtgaaaccctgtctctactaaaaatacaaaaattagccgggcacagtggcatgcacctgcaatcctagctactcaggaggctgaggcaggagaattgcttgaacccaggaggcggaggttgcagtgaggtgagatcgcaccactgcactccagcctgggtgacagagtaagactccgtctcaaaattaattaattaattaatttaaaaaatgcatccaaaaaagtaattagcccaaaaaaatttaaaagaaaggagaagccaggcatgatggctcatgtctataatcctagcactttgggaggccaatgtgggaggatcacttgaggctgggagatcaagaccagcctgggcaacataggaagacccccatctctataaaaatttttttaaaaattagtcaggcacagcggcacatgtctgtggtcccagctacttgggaggctgaggcaagagaatcacttgtgcctgagaggtcaaggctgcagtgagctgtgactgtgccgctatactccagcctgggcaacagagggcaatcctgtctttaaaaaaaaaaaaaaaaaaaaaaaaagttgtttttttggaggttctagaaaaatttaaaaaactaaaagacactgctagatattatcaatatgaaaaaagacaaggaaaaaagttacaaataacagttataagaaatgtagtagatgaagttaaaaaaaatacatgttgtaaatagtagaatggatacacttgataaatgaattagcacactgacaacaaattgaagaaatttcagtagaaggataaacaaatagaaaacaagaaataaatgtagaagacttaccaaagctgactttgagacttactacagtattcaagatggtatggcattagtctacggatcaacagactaataaagcagaatacagagcacagaaatagaccacagatatatggtcaatcgattttcaataaatacaccaaagcaatccaatggggaaaggaaacaattggtgctaaaacaactgcattgccctgagtgatgaaatattctgtacaacaaacacccatgacaggggtttacctacataacaaacctatacatgtacccctcaacttaaaagttgaaaagtaaaataaaatgaacaaaaacaaaccaaaaaacacaattgtattcttttgtggaaaaaaaagaactctgaccactacatgacaccatacacgaaaaacctaaccataaaatgtaaaattacaatgcttttggagaaagcataaacatgtatgttaaaagttttaaccaatcctggtaatcaaatccaaccaaatcagaatctactatgaccaagtggggtttacccaggcatgccaggttggtttacaatttgaaaactaaaaattaatcaataataactcatcatattaacagactgataaagaaataattatgatcatatcaacagatgcagaataagcatttgacaaaatccaatatccattcttaataagaacactcagcaaattacaaatagaagacactttttccaatctcataataggcatctatgaaaagcttattgctgacgttacaaagatgaaaggctgaattgctttccttccaaaaccaggaacaaaacaaggatgactgttctcattcttctgttgaacactgtaccagaggttctaccaagtaaataaggaaagaaaaagaaacacaaggcattaagattagaaaagaagcaaaactcttaattcacaggtgacatgataatctacataggaaatcctataaaatctaccaaaaaactgaggctagatgttcaagaccaccctggacaacagcaagaccctgtgtctaaaaaaaaaaaaaatttgggggccgggcgcagtgtctcatgcctgtaatcccagcactttgggaggccaaggagggcgaatcacgaggtcaggagattgagaccatcctggctaacacagtgaaaccccgtctctactaaaaatacaaaaaattagccacgtgtggtggtgggcacctgtagtcccagctactggggaggctgaggcaagagaatggcgtgaacccgggaggcagagcttgcagtgagccaagatcatgccactgcactccagcctgggcgacagtgcaacactccgtctcaaaaaaaaaaaattttttttaggccaggcacggtagctaatgcctgtaatcccgtcactttgggaggtcgaggcaggcagatcacctgcagtcaggagttcgaaaccagcctgaccaacgtggagaaaccctatcactactaaaaatacaaaattagcctggtgtagtggcgcatgcctgtaatcccagctacttggggggctgaggcaggagaatcgtttgaacccgggaggcggaggttgcagtgagccgagatggcaccactgcactccagcctcggcaacaaaagtaaaacgccgtctgaacaaaaaataaaaaataaaattttttttaaattggccaggcatggtagcgcatacctttactcccagctacctaggaggctgaggcagtagaatcactggagcctaggagtttgaggctacagtgagctgtcatcgcaccactactgtccagcctgagtgacggaataagacagtgtctctagaaaaagaaatactaaaattttttgttcatcaaaaacaaagcaattacaagcaaaaaacaagccacagactagtttaaaaaaatcatacatttcagataaacggcttctacaataatgcctacaaataaacaataaaaaccaccaagcaaaaaaatgagcaatagaactgaacagacacttaacaaaagaagatatataaatggcacacaaacaggcactcaacatcattaggaatcaagaaaatacagattaaaaccacacaattatacctctttacatccagtaaaatggctaaaattagagactgaaaacactaaatgttgctaaggatatggatggaacaaagtaaactcttatacaacctttctcacatggggttctgtgggagaaagaactagataaaattaattcagtgactattttctcaattctctcaaggatagcccaaagctagtacaattctagactcctatgaatctaagagagatgataattcggtgtagtagtcccctcttatctgtggtttctctttctgtggtttcagttacccacagtcaactgaaaacagagagaccacattcacatgacttttacaatatgtggttataattagttattgttgttatattttattattagttattgttgttaatctcttactgcacctaatttataaattaaatattatcataggtatgtatatttaggaaaaaacacatagtacatatagggttcagtattaatatctgtggtttcaggcatccactgagggtcttgggacatatcccccctcgataagaggggactactatacatacaataggtatcttagcaaattagaactcagttctcattctctctgaaaggcctgatttaaaagggctgcattataaattgttactgggactgtaaaatcacacaatcacgtggaaaactgatcattccttatgaaattaaatgcatgcttaccatgtaacccaataattccactcttatttattcaagagaataaaaacatatgcccataaaaggcatatgcaaaaattttacagcagtcttattcatgaattacagctaaaagtgggtgactaatccaaatatctatcaacaaagtattaataaaagcatgtggtttatctatactatggactactacttcacaattttaaaaaaggattgtggtggggaaaatggcagataggaggcaggactaatttgaagctctcactcagacgaacaaagcagtgtgtggagactcacgttgtgaacttttgcttcaagaactacagaaggaacatactaggaaagccgagagaatccacagaccctttgaaggaagaggattgctcctgcaggacctgagagacagcccacataatttgagtgcccaaagtgggaaagtgggaaatggggatcatccacccctgaacacacaccttcactggggaaagtgaaggtccagatcacgggagaaggatttgaccttacctggagctgagatactttagagagccaagcgaaatacaggagtagagtaagcagcgggaagagccctgtgggctctctcagtccccagggaagccatctctgacattgtctcacaggggtccttggggagggctgccagaggaactgggaaaagaccacagggagaaggaaacttccaactgaattttgtaacaattccaaccaaatgtgaactttcttggacagaactcagggaaagaggtgaagctcaagtgcagatgcaggcaggaggggtggcacaaaacctgaaagccctgcttgctttctcagctgggaggctggtagcctggggcaagttctcagccctgcttgcccactgcctggaaacaaacttggtgttgttggtggggagggcacagtgggagtgagattggccttttgggttgcatgggagctgggtgaggcctgtaattgctggctttcccccacttccctagtgacctgcatgacacaggagaggcagccataatcctcctgggagcataactcccttgacctgggaaccacactcccatcccccagagcagtggtagcaagccccacccaaggagaatctaagctctgacatgactaaccctgccccacctgagggtcttcctctatccacctggtagctgaagacaaaggtcatattctcttgggagttctggggccccactcaccacctgatcctccctatactaccatagctgatgctctcttgaaagtgccacctcctggcaggaggccaaccagcacaaaaccagtgcaataaacaacaataatacaaccaaggaccctcacagagtccatttcactcccctgccacctccaccagagcaggtgctgctatctatggctgagagaccagaagatggttcatatcacaggactctgtacaaacaccccccagtaccagcccagaacctggtagacccactaggtggctagatacagaagagaaataacaatcacacagtttggctatcaggaagccacatccctctaggaagagagagagaatactacatcaagggagtaccccatgggacaaaagaatctgaacagcagcccctgagccccagatcttccctctgacatagcctacccaaatgagaaggaacaagaaaaacaattctggtaatatgacaaaacaaagttctttaacaccctcaaaaaatcacactagctcaccagcaatggatccaaaccaagaagaaatcccttttagatttcttcttgccagaaaaagaattcagaaggtcagttattaagctaatcaaggaggcaccagaaaagggcaaagtgtaatttaatgaaataaaaaaatgatacaagatatgagggaagaaatcttcagtgaaataggtagtataaataaaaaacaatcacaacttctggaaatcaagggcacacagaaatgcaaaatgcactggaaagtctcagcaatagaactgaacaaacagaataaaaaactttagagcttgaagacaagattttcaaaataacccaatccaacaaagacaaagaaaaaagaattttaaaaaaatgaacaaagcttccaagaagttttggattatgttaaacaaccaaacctaaaaataactggcatcctgcggaagaagagaaatctaaaagcatgggaaacgtatttgggggaataattgaagaaaacttccctagccttgctagagacctagacatccaaatacaagaagctcaaagaacacctgggaaattcatcacaaaaagatcatcacctaggcacatagtcatcaggatatctaaaggcaagacaaagaaaagaatattaagagctgtgaggcaaaagcatgagctaacctataaaggaaaacctttcagattaacagcaaatttctcagcagaaaccctactagctagaaggaattgttgtcctatcttcagcctccttaaacaaaacaattgtcagccattaattttgtatccagtgaaactaagcttcatacatgaaggaaagagtctttttcagacaaacaaatgcagagagaatataccactaccaagccagcactacaaagaactgcaaaacgagctctaaatcttgaaacaaatcctcaatatacatcaaacagaacctccttaaagcataaatctcacaggacctataaaacaacacagtaagtaaatacatacatgcatgcatgcatacatacatacataaataccaaggtattcaggcagtaaatagcacaatgaatagaatagtgtgtcacatctcaatagaaacattgaatgtaaatggcctaaatgctccacttaaaagatacagaatggcagaattgataattcactgaacaagtatctgctgctttcaagagactcacctaacacataagaatccacataaacttaaggtaaaggggtggaaaaagacattccatgctaatggacaccaaaagcaagcaagagtagctattcttatatcagacaaacaaatttgaaaacaacagcagttgaaaaagacaaagagggacattatataatgataaaaggccttgtccaacaggaaggtatcacaatcttaaatatagaacagttactactaaacctaataattgacatagacagaagcacaataatagtgggggacttcaatactccactgacagcacttgacaggtcatcaagaaagaaagtcaacaaagaaacaatggatttaaactataccctagtacaggactatacccaaatggacttaacaggtatttacagaatattccacccaacaaccacagaatatacattctattcattagcacatggaatgttcttcaagatagaccatatcataggccaccaaacaagtctcaataaatttaagaaaatttaaattatatcaagtactgtctctgaccacagttgaataaaattggaaatcaactccaaaaggaaccttcaaaaccatgcaaatacatggaaattaaataatctgctcctgaatgattactgggtcaaccatgaaatcaagatggaaatttaaaaattctttgaagtgaacaataatagtgacacaacctatcaaaacctttgggatacagcaaaggcagtgctaaaagaaaagttcatagctttaaatgcctacatcaaaaagtctgaaagagcacaaacagacaatctaaggtcacacctcaagaaactagagaaacaagaacaaaccaaacccaaactcagcagaagaaaagaaataataaatatcagagcaaaatgaaatgaaattgcaacaaaaaacacaaaaaaattcatcaaaaagccagttctttgaaaagataagtaaaattgatagaccattagcgagatttaactaagaagacagaagatacaaataagctcaattagaaatgaaatgggagatattacaactgacatcacagaaatacaaaagatcatttaaggctactacaaacaccttcacacgcataaactagaaaacctagaggagacggataaattcctggaaatatacaaccctcctagcttaaaccaggaagaattagaaaccctgaactgaccaataacagggggattcaaatagtaatttaaaaattgcccacaaaaaaagtcaaggaccagctgaattctatcagacattcaaagaagaattggtaccaattctactaaaactattctacaagataaagagggaattttccctaaatcattctatgaagccagcatcaccctaaataccaaaaccaggaaaggacataacaaaacatgaaactatagaccaatatatctgatgaatatagatgcaaaaatccttaacaaaatactagctaaccaaatccaacagcatatcaaaaagataattcaccatgatcaagtgggtttcaaaccagggaggcagggaaggtttaacatacgcaagtcaataaatgtgacagaccacataaacagaataaaaaacaaaaatcacatgatcatctcaatagatggagaaaaggcatctgacaaaatccagcatccctttatgattaaatccctcagcaaaatcagcataaaagggacataccttaatgtaataaaagccgtctacggacatacccacagccaatataatacgaaacagggaaacactgaaagcactcctgctaagaactggaaaaagaaaaggatgcccaccctctccacttctattcaacatagtactggaagtcttagccagagcaatcagacaagagaagtaaagggcatccaaatcagcaaagaggaattcaaactgtcactgtttgctgatgatatgatcgtagacctagaaaatcctaaagactcctccaaaaagctcctagaactgataaatgaattcagaaaagtttcaggatacaaaatcaatgtacacaaatcagtagcactgctatacaccaacagcaatcatgcagaaaatcaaatcaagaactcaacaccttttttaatagctgcaaagaaaaaaaaaacaacttgggagtatacctaaccaaggaggtgaaagatctctacaaggaaaactataaaacactgctgaaagacatcacagacgacacaaacaaatggaaacatgtcccgtgctcatggatgagtacaatcaaaaatgtgaaaatgaacctactgccaaaagcaatatacaaattcaatgcaattcccatcaaaataacaccatctttcttcacagaactagaaaagacaatcccaaaattcatatggaaccaaaaaagagcccacatagccaaggcaagactaagcaaaaagaacaaacctggaggcactgcattatccaacttcaaactatactacaaagctacagttatcaaaaaagcatggtactgatataaaaataggcacttagacgaatgcaacagaataagaacgcagaaataaggccaaatgcttaaagccaactgatcttcgacaaagcaaacaaaaatatgaagtaggggaaaggacaccttattcaacaaatggtgctgggataattggcaagccacatgtagaagaatgaaactggatcctcatctctcaccttatacaaaaatcaactcaagatggatcaagcacttaaatctaagacctgaaaccataaaaattatagaagataacattgaaaaaacccttctagacattggcttaggcagtgactttacgaccaagaacccaaaagcaaatggaacaaaaacaataagtaggtaggacttaattaaactaaaaagtttctgcacagcaaaagaaacactcagcagagtaaacagaaaacacaaacagtgggagaaaatcttcacaatccatatatctgacaaaggactaatatccagaatctacacggaactcaaacaaattagcaataaaaaaacaaacaatcccatcaaaaagtgggctaaggacatgaatagataattttcaaaagaagatatacaaatggccaacaaacaaattaaaaaatgctcaacatcactaatgatcagggaaatgcaaatcaaagacaaaatgtgataccaccttactcctgcaagaattggccataatcaaaaaaattaaaaaccaacagatgttggtggggatgcagtgaaagggaccacttttacactgctggtgggaatgtaaactagtacaaccactatggaaaacagtgtggagattccttaaagaactaaatgtaaaaccatttgatccagcaatccaactactgagtgtctacccagaggaaaagaagtcattatacaaaaaagatacttgtacacacgtttatagcagcacaattagcaatttcaaaaatatggaaccagcccaaatgtccatcaatcaataaatggataaagaaattgtggtatatatataccatggaatacaatccagtcataaaaaggaatgaaataatcacattcgcagcaacctggatggaactggagaccattattctaagggaagtaactcaggaatggaaaaccaaacatcttatgttctcactcataagtgggagctaagctatgaggatgcaaaggcataaggatgatacaatggactttggggatttaggggaaaggatgggaggtggggtgagggataaaagactataaattgggtacagtgtatactgctcgggctatgggtgcaccaagatctcacaaatcactgaagaatgtactcatgtaaccaaacaccatctgttccccaaaaacctatggaaattaaacaaataaaataaaataaaaaataaaaggttcatattagaaatattaaagattgtactattaatacttttttaagtgataatgattctttaaaaaattctattgaaacaagccagatacaaaaaagtatatactttatacttaaaaaagtatatactttagtgagatttaactaagaaaagaagacagaagatacaaataagctcaattagaaatgaaatgggagatattacaactgacatcacagaaatacaaaagatcagacagagtttcgctctgtcaccaggctgtagtacagtggtgcaatctcggctcactgcaacttctgactctctagttcaagcgattctcctgcctcagcctccccagtagctgggattacaggcacacgccaccacgcccagctaatttttgtatttttagtagagacggagtttcaccattttggccaggctggtctcaatctcctgacctcgtgattcaccagcctcggcctcccaaagtgctgggattacaggcgtgagccactgtgcctagccaaaaaaaagtatattgtatcagtacgtatgtaggcagccccaactttgacagccatgcaggaccacaaaaatgactgtacaagctgtccaggcaaagtaatctttaataatcaatgagaaaaataatttttccataatttttaaattttaagtcaaaatataactttattactgtcatttataagtgtatagcaaaattttaaaaactagtatttattgagtacattgtaaattaaaacattaggtacattgagaattaacatgttttattctttataaaaagtttatcaagagtagtttgaacagtgcttgccgccccttatcaaaacaaaatacagagcaagcatgttttttatgtcttggcaagttgttatacacctttctaagtttggatcagcttccgtgttttaccctttatgctttcaatggcatgaaacatctcggagagttcttttaatgtgatggcttttgccaatgtcacgtctactgggctgccttcatcctttttgtcacaatcactttcttcaattatgttgataaggttgcctttattagtttccctggctgcatatctagaatctctttaatggcagcagtgtcaacatttccatgacagctatttcttccttaattccctttacatttgactcaaattttgcttccagtgttgtaactcttggtttctttgtagcattttcatctttgatggccaattcccccctttcaactatccattttataaaatgtcacatgttcatcactgggaaacgaggaggcaacagaaaacagactttgctatctaagcataaactgattaacatgtcactgatcaatcacccacacactttaaaagaagtgatgtgattggtcactggtcatgatttatatctgttattttcttagggatttgtagattaaagagctagcagtaagtttgtacttcatgcaattactcacagtaattactctggtaactgaaactgtgttggtagagaactgatattactaaactaaaccctactaaccaaattaatgcatatagaaaccatgcaaagtggggactccctctaagaaacccagatacaggcaaaatttacctatggtaataagtgtcaggcaatggggaggaggagaactgactggaaaggagaataaggaaactatctggagggaaggaaacgctctgtatcttttttaaagtatggttacacagttatatacaattgtgtacattcatcaaactgaccatatgttattgcatattaatgacctgaatctgaaaatatatatatataggaccccaaaaacttaaattcagacaaaattctaaaataaattctaaaggatattttttctaacagaaaataaaggaccccagatcactcaaaggcaacaaaaggaatgaagggcaatgaaaagaataaatgtacaggtaaatctaaacaaatattgactgagcaaacaacagtaagtgttttattcagtttatatatatagttatacacacatgtatgtatatgtgttattaaaatatttggctaaaaatggtacagaagttaagatgggtaaatggagttactgttctaaggttcttgcaattctcaggtaatcactaaaagaataataaatgagtttatgacttctagaatgatttctaagctgacagaaaacaataaaatgattttttaaataccccatcaatccaaaagaaggcaagaaaagaatcatacaattgataataacagaaagcatacaagacattagatttaaacccaaagatataagtaaataaaatacaaatggaccaaatgatccagttaaaatacaaaagatgtcagattaaattttaaaaacttaacatatgctatttgtgaaagatgtctaaaacataaggacactgaaaggttgacagcaaaagaaaatatttttcatgaaaatgaatactgaaagaaaattggtatagctatgttaatatcacacaaagaggtaagaaatatgagtagagataaagaaagtcacttagtaatagaaaaattgtaaacgtatatgcacctaataacataccatcaaaatatataatgaaaaaattgacaggtctccaaggacaaaaaatttttatacagaaaatagtaaatatcaaaacctttagaatatacctaaagaagtattttgaggataatttaaagctttacatgtttctattagaaaaaaaggcctagccgggcacggtggctcacacctgtaatcccaggactttgggaggctgaggtgggtggatcacgaggtcaggagtttgagaccaacctggctaacacgatgaaaccctgtctctactaaaaatacaaaaaaaattagccaggcgtggtggcgggcacctgtagtcccagttacttgggaggctgaggcaggagaatggcatgaacttgggaggtggagcatgcagtgagccgagatcgcaccactgcactccaacctgggtgacagagagagactctgcctcaaaaaaaaaaaaaaaaagaaaagaaaagaaaagaaaaaagaaaaaaaggcctaaaaagtaaaaatgtaaacattcatctgaagaaaattcaagaaaaaaagaaatctaaaaaaaatagaggaaaggaaataataagaacaaaagtaatgaaataataaaaacaaaaaacaaacaataggatcaaaaccaaagcaaaatgttggtctttggaaaaaactaataataaccaccaactgcagaatagaaaaacaggaaataactacagactctatgtacattcaaatgtccacaggatattataaataacattatactaaacatccttttaaatttagacaaaatgaaaactgcttacatatatatactaacttgcgtaagaaggaaattctaattatttctttaataaataaatgaaataaaaccttcccttaaagaagagatccaaatgactttattggtaagttctacaactccaatcttatacaaactgttccacaaaatgacagaagaaaaaatgaattgaaaagagtattatagtatgagtttacattaccttgctatcaaaatctgattttaaaaagccataagagacagctgggcgtgatggctcacacctgtaatcccagcactttgggaggccaaggcaggtggatcacctgaggtcgggagttcaagaccagcctgaccaacatggagaaaccacatctctactaaaaatacaaaattagctgggggtagtggcgcgtgcctgtaatcccagctgctcgggaggctgaggcaggagaatcacttgatcctgggaggcggaggttgcggtgagccaagatcgcgccattgcactccagcctgggcaacaagagtgaaactccgtctcaaaaataataaaaaataaaataaagccataagaaaggtaaattatcagccaatctaaattacaaaaatagatgtaaatatacaaaacaaagtattagttaacatagaccaacaataagtaacaagcataatatagtgtgaccaatctatatttattctaccctgtaaagttggtttagtattacaaaattaatcagtgcaagttcacattttaacagaataagggagaaaaataatgtgaccatctaaatacatgaataaaaattatcagatcaatttcaacattcatgtatgattttttagtatctgggcaaaataaaaataggagaaaattttcttaaatctaatattacatagttatcaaagaacctacaagaaatatattgaatagttaattagaagtaattcacatataacaaggcaagaaaaataaaatgtataagaattagagaggcaggaaaagaatacttgcagataacatgattttatgtacacaaataaaaaaacttctgtaggtgggttattaaaattaatgaaaagttagcaggactgttggataccacaccaaaatacaaaaatcaattttatttttacataacagccacaatttttaaaaacagttaaaatcatctcaaaatactgagtacctacgaatttaacaaaataaatgtaagacctctctacacacaaaaaataggaaacattatagagcaaaactgaaaaatatagagagatatacaatgcttatggtggcccagaagactcaaataacataaaaataaatgatttaaaaattaatctatgattcaactcaatgccattaaaatcttaatagtgtttttcttttttggggtggactttgaccagctcactctaaaatttatatgaaaattgaaaatgcaaagggccggcaatagtcaagactttcttgatgaataacaaggtagatttgttcttataggtttaacacttttacagttatagtaattaggaaagttttgtaatggtacaagaaccatgtaaaagacaaatggaacagattattgaccctagaaataaacacatacatagatatttatttttaagaaaaacatctctgcagagcagtgaaggacaatcttttcaacaaatattactgggaaaattgagtaatcatgtattaaaaagcaaaataaaacaaaacttgaccactgcctcacaacatacacaaaaatacactcctggtagggccgggtgcggtggctcacgcctgtaatcccagcactttgggaggccgaggcgggcagatcacgaggtcaggagatcgagaccatcctggctaacatggtgaaaccccgtctctactaaaaatacaaaaaattagccaggcgcggtggcgggcgcctgtagtcccagctgctcaggaggctgaggcaggagaatggtgtgaaccccggaggcagagcttgcagtgagccgagattgtgccactgcactccagcctgggcaacagagcgagactccgtctcaaaaaaaaaaaaaaaaaaatacactcctggtaaattacacatataaatatgaagataatataggaacataccttcatgatcttaaggtacaaaaatattttctcagttaaaaaaaaaagcataaattaggctgggtgaaaaaaaaaaaaaaagcataaattaggctgggcgcggtggctcacgcctgtaatcccagcactttggaaggccaaggtgggcgaatcacgaggtcaggagattgagaccatcctggctaacaccgtgaaaccccatctctactaaaaatacaaaaaaaatcagccgggcgtggtggcgggcacctgctaaggcaggagaatggcgtgaacccgggaaggcggagcttgcagtgagccgagattgcatgactgcactccagcctgggcgacagagtgagactctgtctcaaaaaaaaaaaaaaaaaaaaaaaaaaagcataaatcaaatgggaaagatgaataaatctgactacataaataacgtctgttaataaaaagatacttttatttttgtagagacaaggtcttgctatgttgcctaggcttatttcaaagtcctggcctcaagtaatcctcctcccttggcccctcaaagtgctgggattacaggcatgagccactgtccccagcccaagacaagctttcttggagaacatcaacagtaggctagatgaagtagaaaaaaataatttgtaaacttgaaggcaggtcattagaaaatacccagaggataaaaaagaaaaaagagtaaaaagaaatgaagaaagcctatgggatatatgggacactatcaagagagctaacattaacaaagaattataaaaacaaaaggagagagagagaaaagaacaaaaagataaagaactaaagattcagcctcaagaaaggaggaaattctgtcatatgctacaacgtggacaaacactgaaattatgctaagtgaaataagacaaccagagaaatactactcaatactccacttacaagatgtctctaaacagttaaactcagaaacagaaagtaaaatggtagttgccaaggattgactggagggggaaatagggagtgctgttcaaaggatacagaggttcagttgtgcaacacgaaaaactctagagatctgctttaccacactgttcttacatttaacaataccggattatacacttaaaattttgttaacagaattaaagaagtacagccatgttaacaaaaaggctttggatcagtttgtaaatttctctgagcagaaagaaaagttaataaagcgacaagaagagttagataggggttacaaatcgatcatggagctgatgaatatacttgaacttcggaaatatgaagctattcagttaactttcaaacaggtatccaagaacttcagtgaagtattccagaagttagtacctggtggcaaagctactttggtgatgaagaaaggagatgtggagggcagtcagtctcaagatgaaggagaagggagtggtgagagtgagaggggttctagctcacaaagcagtgtcccatcagttgagcagtttactggagttggaattagggtgtcatttacaggaaaacaaggtgaaatgagagaaatgcaacagctttcaggtggacagaaatccttggtagcccttgctctgatttttgccattcagaaatgtgacccggctccattttacttgtttgatgagattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcatattgatgtgatcacagcggagatggccaaagactttgtagaagatgataccacacatggttaattggaaaatactacttactggtttgggagttgtgtatagtaatatgattctcatacccagaactgtaaatataaacctaaatatttggccaatagttttcagacttaaagcatcatagtccttttatatttgtctttgtattttataagatactctgtaatgtcatgtttgtacttacagttttagaatttaatttcctgtacaactttttgtaaaatgttctgctcctattttaaatgttttgaaacatgctaaatattctttcctaattattttatcgcttatactgccttttttatagcttcaattaaataattggttttatgactaaaaaaaaaaaaaaaaaaaattgttaagaaagaccaggcccggtggctcatgcctgtaatctcagcattaataggagtgtgaactactatttttctttcttaagttccggggtacatgtgcagaacatgcaggtgtgttacacaggtaaacatgtgccacggtggtttgccgcacagatcaacccgtcacctagatattaagctattactatttttcaatgttcatagatgcaatgaaattcaaccttactgaatctgtagaacctctgtttctcacagcaacagatactaaaagtaaaaccactcatgtagaggtcttcaaaaactcattctcccaagcttattgctgtaggctgcttcaattgatacatcttcggcaaccatgccagtacacaggaaaggctaagtatagtacttgcattcaattaatagatgctccatcacgtgctcctatttctctgttacggcttttcattatattctaaatcaccctttttctaagcaactgccaaacctgtgctttgtgttttcttatactgttcatatccccaaacagaatttaaagttataaaggtaaacaatcaaagtcaaatatattctgtacccagaagagctttgtaaaagctatttcagttaaaagttgaagttttttacaaatgtaaagtaagattactagaagtgtgattcctagttaagtgtggcattaccagcctgtgattgagctcaggaaaattgttcactgtgtgccaagggttcctacaactgcttttcaataatcctctcagaaactgaactcaacaaataattttcattataaaatacactataaaaagcagagctatagttatagtaaactgttggttgtttaaaggtgatttagtttacctcaaagaattattctctgctttttgtctgccaagttcactttcggtatccattgcctttcttgctagtgatttcatttctttttccacagtgcttatggtttccttcatcaaagtcatatttgacatttgctccatacgttcatcatcaagctatacaagtagaatgacaaggttactgccatcactaaaaacaccttagtaatcttcctgaagggcatactccctctgtacaaactggtttatggcaagactgacaggatgagattatcaggttagacctgactgctgtagaaggttttacagataaggtgttgtgaagtaggaccaaggaaaagccactgcaaagtaaagcttatcacagtatatcagtctatatttttcaatctggttcaatttgactatagtataaatatgctgtttgcaaaagaatttatttgttgcccaacattaataaattacacatataatgtagaattatgaaaacaaaaattattttctcctgtctagtaattttttttttttttgagacagagtatcgctccatcgcccaggttgaagtgcagtggcgcgatctcggctcactgcaatctccacctcccgggtgcaagcaattctcctgtctcagcctcccaagtagctgggactacaggcgcatgccaccacacctggcaaattttcatatttttagtagagacagggtttcaccatattggtcaggctggtctcaaactcctgaccttaggtgatccacccgccttggcctcccaaagtgctgggattacaggcatgagccaccgtgcccagcccctatctcatatttttaactcattacaataaaacagtacagatgaacttataaatatattcaattatatttggtaatagaaagttaaattctcttatgtttatatagtgacaatatcatcaatatatattcgtagcaatatcaaatctgattaggaaaaaggtgatgtttcacatttaaatttagtttaaataaactttgcttataatttttatttcatcataattttctctccttatccactctttaggtagaataaaccattttctttacatctggcaatattatctttaacaaaatatggagatgagaaagtagataagatccctgaaaatgaatgcctaatgatttttttaaagtacatactttgcaacctaacaccaaaaaacatttactcacatttttagaaggaaataaacaaatgaaaaagtgacaatttacactataaaataccttaagtattttaggactataaacactatcttagaaaaataaaataacttctctgaatacagaaaaaggagaaaggggaaagccattgagtgtttatagccaaaagagacttttctttttttttttttttacattatgaactgtacactccagctcctctatcctttgttccaggtgagccttctcattaaatgctgtctcttgagcaatctgattaaaaagcaaaaacaaaataaagtgatttcaatatccctgaatttgtgtttcacatatattcacgtaaataaaatcctttccaacctttagcctctcccttagactatctcgttctgtggtcattcttcgtaaatcagtaaaggctacatctctttcagtctccactcgccggagaatagcatgtgccgttgttgatttaggactcttacagcttttcatcatttctcgtcgaagtcgggtaatttcttcctgtgcctattatttaaatcatagactttggttgaacaagctttagaacacataaacataaaaaattttatgtatctagccagttaaaatgcaaacctacatcaacatgcatgcagcagggtaatggtatcgcttttattttaaaataagcttatacaaataaatgaaaatgaatatatttaaatagaagttcatgttacaacatctttgccaaaagtctaaaataaaattaatttggaggaagtcattgcaacagagaatgttttgctaagaaatatatttggtatactccatttattcattttgtagtgtaaatttaaattcagcacaatttagacagactaccggtttaatgaatattatcatagtgtttcagtcttcctaaatataaatgcatatgccattcctatgtcttggctacttctgccctgacagaaaggcccaccaatccttactgataacccaacagagtctctgcacgtctgttcaaccatccttgggtcccaaatctattccaaacctgcagattatttaatatcacagttcgctgcacaggtctcttttcctcttgattttgatcactgtctattcagatagtctccaagccccaaaggaaaatatataacttcccaatttccacagctaagccttcaccagaaccccaaacctcatctcctaaagtgtcttctaagatctccctgactcaattataattatttcttctcatcttgaatagtaccctctccactggcactttctcccctgccttcagtcatgtacagtgctcccttatcttgaaaacctgtcacttgatcctgctgaccaatttaccatcctatgtctcttcttcctgcgacacattaaaaaaaaaaagtcccatggtctataactattgccaatggttccttaccatccattctatcaccccagaacaacctggctcccaccctcccaccttctgtggaatttcaactaaagacctaaccaaatataatggtcttttctcagttcctgttctccttgatatttcagtggtctgttgctgctcacaacatccttcttcttgagattccttcctcccttttaacattgttcctccctagctgtctgtcatctttgtctctttcaaaggttcccttctgcatcttgaatattataacttaacgtttctgctcctctatgtacagttttctcattcagagacttcatccactctgaaggctcgaagctcacctctaagcagatgacttccaaagctaactatttaactcttgcctctctctactccagtcccacatttcttacagtctgatggcaattacgacctgagtgtgctatcattatcttactctgtctaaaaacaaactcacatctttttcctcaaaccaccaatgactctcctattttttattttattaccacattgctgagtcattcaagacagaattttagtcactgtcatgcaaccctccttcttcctaaaagcaaatcatgtcaaatcttccttcacagggtcttttgcatctgtccctatatttatctccattgaaacacccttgcttagtcccttaatgccttatatgtgcactagtgtaacagccttctaaagaggagtccatggtctctccctccatcaattctctcaaaggagaaattgttaaataagaagacagtatagaaagattatgtgagaaataaaaatttgccataaggttaaaattgtaaaattgtaaaaatgatactttgttcatattttgcctgcctttaaaaaaaaaagattgtttgttgcttatgaagcaaaatataaaccccatataaggcccattgaacagcctgtaccatttagtccagaagtcagcaagctatatataactcacaggccacatctagcctgcctcctgtaggtctgtaagtggagaaatatttttgcatttttaaatggttggggaaaatatcaaaagagtattttaaaacaagtaaaaatgatgtgaaattcaaatttcagtatccataaagttttactgtaatacagccaaagttattcatttatgtattgtccaaagctgctttcaccctacaacaatagggctgattagttacaacagagaccacatggcttgcaaagcagaagatattttttgtctgggccttacagaaaaagtatattgattcctgctctagtgcaatcttacctttcaagtcttagctctctcccttctccactgacacataccctctattctagtcttaaaccaatttatttatctgctgattttcctacctttatcctttgcctcataccattcctttagtttggattgttccttctagcccctttcagggtaatagaaactccattcatttttcagggctcacactttgtatcttttaataaagatttccttgatcaccatatctaaaaatgcccacttcttttgtttcttataatatcttctagaccacttaataaaaatcaataaatacaatatactttatctccctaactagactgtaaatttataggaaaacatggtcagcatcttatcatttttctatcccttagagtagtgagcctagaaccctgtgtatagtagctataatttgttaaaaaattgtgatacttttaaaagaagttatatgggtgatttataggatttaatacttgttgggttaaagaaggtatttgattaataaaagctatgcaattctaagctagaaagcagagataaactacatacttcttttattctctaaaattaagcaaattatataaaagttcctaaagtgatgtgataaggtgtggcaagttcaaggtaaaaaggtcaggatttgatctttttaccttgaactcataacaacttatcatttaacggtttcttcatatcttattccaaaaataagactatttttatacatgtgtatgatttttggctatggggataacatacgtgtgtactcacatacctactgtattggaaatgtactacatttcattaagaatatcttaaaaacatatgtaatccccaaatgttagattaacttgatttgcaggtttaagcagtctcataaaactcaaagaagaattacataactctagaactcaatgttattacttatataatttgttttttgtaagtttacctgttcataaagaaggaagatcttgtctctctcagatttaagaaccttgacattaccctgaatttctgccaaatggcgctcatatttttccagcatgcatttaagttcttcacgatctcttgttgttgtcttcaaaagttctacatcacagtttgcaccctataattatataaggaatttgaaatcttctttgatatatagtactgatagaaaggtgctactgatggtagtgcccaatttctatttaagaaaataagactatataatgaaaggaaattataaaaaataagtttaaaaaccacatctttttaaaacagcttcattccaaattattccacatttgcctgattacctcccaagtgctaattatgctgaggataaagaaccaatatcagtagtctactgtgccatcaaagagacctctgtctctcaacccctttgaaacagcaattcacagcaaatcaaaacaaattattttcaaattaggtaaaacaaagaataaaagccagtgtctgggcaacaaactccaaaatatttgtaagtttataaaacctacccgggcagttggtgatgggcgtcttggacttttagacctacttcgcatcatctttctcaaatgttgagcttcactcttatagtgatctttgtctgcttccaaagtcttgacaaaggaatcaagtctagaaggagatttattttgtgctttttcagtatctaaaattatcttgccaaagaggaaaaaattagaccattatttcaagctaaactatagcatcattttctaagtgaaattgaaaacaaacaggatccttaaaaacatttaatttggtattttttaaatacaacatttaaaaaattatatatcagtaatttttaaaaagcagttagatatctttcttttccaggatttctgggtatgctatattttaactgaaagataattttggagaaaaaatggtaaagaaattttagagaggccagaaatgtccacagacctagcacacatcctagaaatggcatggatttgctttagaaaaacatatgctactaggctgggcatggtggctcatgcctgtaatcccagcacattgggaggccgaggcgggcagatcatgaggtcaggagttcaagaccagcctggtcaacatggtgaaaccctgtctctactaaaaatacaaaaaaattagctgggcatggtggcgtgcacctgtagtcccagctatttgggaggttgaggcaggagaatcatttgaacccgggaggcggaggttgtggtgagccgagaatgcgccattgcactccagcctgggcaacaaagcaagactccatctcaaaagaagaaaaacacatgctactactaaagcaactgttatagcatctaagttttgtccaatattgttcaatgcgtgaataaattaactgaatgctggatattccatacttgtaagcattcccacaaatttgcattcactttcatatatttagaaacacttctttgacaacatttatttaacaatactttattgggagaaaattatagatatactttcagatagagggttttaaatattttaaataacactaaaatgtttaaacagaacagttttcatttcacattgttagataaataaaacattgtttggaattatgtaacaaaatttatggcttaaaagtatttactattaagggggataaaagttaatgtgtaaacaaacttcatattttgagaattattcagtcatcattttaaatcaattaacagataaggacattaataaaaccaaccaaaagttgttctttgcctctaggaaacaaaggaatagtgatgaaagcagcaaaaaaaagtcactcttacagatgggggttcccctgtgtccctagcagttggtgcagattttagaaaacaaacatattttattcctcacaaaacgtgtgagagccaaagatataattttttatagcttactgaccaaataaaaatgattccgtaacacatatttatgaaaaatgtacttacagatttaagcctttttattgtatcttccaatactataatattattttgctggcaaatgagatcaatctgaagaaaaagtaaaaaaaaaaaaaattatttctattaaagatgtttaaactaattggaaaaagaacatcaaaaaaaaggaagccacttaaaataaaaacatgaaggcagtgaatattttaaagaagaaataacctgtttagcaacctttgatgataaaagataaaagatgatttacccagaatgaaataacaattctcttaaattcaatcttttgtataaaatgttaattgattgtattttaccaaattattccccataaactggaacaaaatgttagtactaattacaattctgaagataataggaaagcaataaaagaatgactagaataaaataagttgacccaaattaccccattcagaaaagattgctttctcttctgaactcaactgcttagttcaattcaatccacaaaatactttttgtatcaatttatgacagtgaacatacccagtcttataagataggtacctatagtcatatatttagcatatgactacattatatgttcctacaggacagtgactaagtttttatgcaaagcagtaaagttctttgctaatagcatattcacttaatgtattttgcaattcatcaacctttccctcattattctaaactgcatcctgatcttgcctactacatttttaatttgaattctctggaattattgtacttcatttgtcctttagaccaacgttctcttctacgatttttctggcagtcatattttaagtttatgaaatattaaggggtgctattatttgcaacgtttttctcacaagtgaagtacttagaaatagaacataattacatagagtttggataaccttatgtatagccttgaatagacaattttcaatgttttaatgtatactactaagtagacactaaaaagatacaggtctactctgaatgtgttaagatttccacattaagtataaaaattcactctgcaaaacagagtatctggtatgacacattctcataaaaaataaatttatacgcagacatcctacatataaacataaccaaataaactgaagattatgtctaggtataacaaggtatgattatggtagatgttattttcttcatttacttttctatatggactaaaattttgtataataaatatgcattaattttacagtgatttaaaaaaatgttgattccactctgaaaaacaaaataactggcccaaatgaaaaactgctaactcagtgttttcacttacttaacaattaatgaatgcctactacctgcctgccattgtgttatgtgctgggtaaagtaatgaataaaaaaggtaaaaatctctgccctcatgtagtatatattctagccaaaaaaagaaaaacaaaagataatagtcaaaatatgttagtgattgcatccctcaaaaaaataatacaaggagcgctcacgttctaagcacttgagttaagtaaacaagagagacaaagatttctgcctttgtggattctacattccagctagaatagacaataataaacctaacaaataattatatagtatactagaaaaagaagagcagagttaaggatactgggaatatttatggaggaacaggttggaattttaaatagggtggtcaggaagtcctcattgaaaggtgacctttgaccaaaaacttcagaggaaaggaagtcaatcatgtgaaaatctgggcaaaaaacattgcaggcaaaagttacagctctaacaaaggtcctaaggcaaaagaaggtctggttggttctaagtatggagaccggcatggctggagcacagtgagggaaggggaaaggaacagcaaagtgctacagggaaaaataaagcgaaggagaaagacagggagtgtgtgcagggaatgtggggatgggtatttcagagcccgctgtgtggaagacattgtgtaaagtctttgttgtcccccaccccaccctttgtttgtgggggacaaacaaagactttacacaatgtcttccacacagcgggctctgaaatactttttattgaatcacacacaaaagtaacaataatgataaggactatcagagatccagtccagtaacatagcccctaggtcaattaaaaatataaattataggaagaaataatggtaaaattttaattctgcttcacatttcatagtgtcatgttcaattatctgggaaatgccatgttaacacatgaatgataaacaactcaagatgagagaataaacgaaggcatatagttgaggtggttttaatgtatgtccacaaattctaatactccttccttcaatagctggagcttaatttccctcccctagagtgtgggttatacttagtgactcacttttaaagattagaatatggaggaagtgatgagatataacttttgagactgggtcatgctaagccctgcagatcctccttattatctcttggattgttggctgggggagaggggaaggtggagggagaataaacttccacaaagaatacatgaagcaaccctagagagaggtccacctagcaaggaacaggcctcctgccaatagccaaaagccatctgagtgagccatcttagaagtagatcctccagtagcagtcaagccatgactgtggcaatcagcttttttgttgttgttttttgagatcgagtctctctttgtcatccaggctggagcgcagtggcgtgatctcggctcactgcaacctctgcctcccgggatcaagcaattctctggcctcagcctcccgggtagctgggattacaggtgcccaccaccatgcccagctagttttttgtatttttagtagagaccgggtttcatcatattggtcaggctggtcttgaactcctgacctgaagtgatctgcctgccttggcctcccaaagtgttggaattacaggtgtaaaccaccagccctggccatcatcttgataacaatttcctgagaaacagtgaaccagaacaacccagctaagccactcttgaattcccaacccaagaacctgtgaggtatcaatatttgttgtttgaaggcattaaggtttcaaagtaattacatagcaatagccaatagttaatattgaaaatattttaatgaagtaaatcatggaagaagttactgttgacctttaaaaataagactaaaagtaaatacttcccagtgaatacatttaatactatctcaattccagacaaactaacagtagctttagcctcagactctacctccgcatacccagagtataatcttaaacactagaaacccaaatattttttctcagcaatcgaattagaaatcttgtttcaagtgccaccccacaaattaggcaaggaatctctcccacataaatataaacctaaaatgcatatctaatgtcttaggatgatgacaacacacactggagttcatatccccagtgttggttttgcatctttctaatccccattctacttggggacattcacttaactgaggttggtgatttcctcatttcagggcattctaccaacccaaaggcctatttccattttgttctctctttattaagtttctgatgtttttcctgtgtcagcaatggtatctctactccaagacttactgcttacctctttttcacccaatagctttccaaccctcaaatacacccaacattccacattatttatgaagatctattttctagaaatactctttgccaaaccaggcaaaattccacctgtaaatttaatacttacagttttaggtaaatcctagctcttatattttagatgttttccattccaaaaattcttccttttgaaagcagagaatttaccctgacatagtacttactctctctagaacataaaccctaacaaccctttaaaagtgatgtgatgacttctaaacagggcattctcattgttggaattcagtcaacttggtttcccgcagtctgggaaggagtgcagttaatttttaatttgaaaacaaaaacaaggaagacatactaaaactcttcaatattgatatatatatatttttttgagataaagagtctcactcttttgctcaggctagagcgtgacgtgattttggctcactgcaacctctgtctctcaggctcaagctattcttgtgcctcagcctcccaagtagctgggattacaggcgtatggcaacacgcccagctatttttttgcattttagtagaaatggggtttcatcatgttcaccaggctggtctcaaactcctggcctcaagcgatccacctgcctcggcctcccaaagtgctgggattacaggcataagccaccatgcttggcccaattttgataatttttataattaagacagatggaaatcaatttaccattaaactgtgaatgttactttaaaaaaagtaacaatacattccacctgaagtggcattaaaaaattaagttaaaaaaaattttaaagtaacaatacaaacaaaagtattgaaaaatgtttaaaatattcaagctacttttaaatatccttcaaatactttaacagcatccatttgaagataaataattcaaaagttaaaaacaaatcattcttatctagtatttcaagcagttctaaggacctgttccagacaacatggttaaagaagactgtatccttaaagtaataactcgtgtatttaaatattgcactattatggccaggtgtggtggctcatgcctgtaatcccagcactttgggaggccaaggtgggcggatcacttcaggtcaggagttcaataccagcctggccaacatgatgaaaccctatttctactaaaaatatgaaaattagatgggtgtggtcgtgggtgcctgtaatcccagctactcgggagactgaggcaggaaatcacttgaacccgggaggtggaggttgcagtgagccgagatcgcgccactgcactccagcctgggtgacagacggaaactctgtctcaacaacaacaaaaaagttctattatttgactttccactaatttaaactcatccattaagcagtctcaatgaggttactgcataaaaatacatacaatcctagaggtcatcaattggactcatatttcaaattactttaacagtgacttcaataacgtttcacctgataatttaattgctttattatttgctataagagtcctgttacattaaaagaatgtttaagaaataacacgtaataacaattagctttgggaaattactctgttacagacacaatttactaatttggtgattaataaaatcaagacaaataagcatgttcacaagctatcatttaaaaattcaacaggttgttttttggccttcaaatatgctctatcttgcttatcagccattaggcagcaatggagaagtgagactgtcattttataattacatttaatctctagtttctaaatttcatggcaaagtactcaatcaagaaaaaaaatgttgatcaaaatatcataaagctacagtaactaaaacaatgtgatggtggcacagaaaaaggcaaatgaatcaatgaaaacaaatagtccagaaagtcacagatatctgagaatttagtatctgttaaaatgatatgtcaagtcagtggagaaaggactaggcaaccctacctcatattagaacaaaaagaaactagcagtatcaacagaaggaaaactattaaaaagtattaaaagaaaactttagaaagtatatctgtagttcttgaggtgaaaaaaaaaccttcctgaacaagaaccaaatctcagacatcagtaagaaaaaaaaaagattggcaaattttcaaatgttagttaaaaaaaagttttaaattgactttttattgatacataataatggtacatgtttatggggtacatgtgatattttaatacatgcatcaacgtatactgatcaaatcagggtaatggggatatccatcaccttaaaaattatttctttgttctgggaatactccaaatcttctctttcagctatttttaaatatgcaataaattgttaatgatagtcaccctactgtgccatcaaacactagaatttatatcttctctataactgtatttttgtaccaattaaccagccttgattccatatcttggctattgtgaatagtgctgccataaacacggaagtgcagatacctctgtgacatactgatttcctttcttttggatgtatacccggctgcggtgttgctggatcacatggcagttctatttttagtttggtaaaaatcttttttaatgggtattgaaatcaattacatatgtgaaaatagacgaaaataaatgtatctattagtttgtagatatctctgcagaggagagaggaattgggaagtgggagcaacatttagttcacggaacattcctgttgctttcaaattttttacaatgactgcatattacttaggaaatgttttgagtagaatttgttaaaagaagtaaaatgtgagaaacaatttaatccttagaacagacatttaaatatactgtcaaatctaaaaagcttccaaattatacaaatgagaatgctactttttccattgcatttaaaaattacatgatgtttaaagtaaaattaaaatccttatccgtggtaaatctggtaccttggcttcttcaagttccttgttggcggaatccaccacaaaatttttctctttttcgagttgctctgctagttggtcaattttaatcaattctttacaaagatgctcattgtggctggttaaatcatctacttgactgcttaccacctccttactatccaagagtttcctaacatattcttccaagccatgatttgtctgtttgagatcttcaatctgttattatcagaaaaaaaatcacattaaaataattccttagcttttttctggggagcagctgtgtgactggaatcaggaagggagatttgcttccctggcaaagaaacttaactctatacctttttgtgccttctgaattttgtaccatgtgaatgtattacctatttgaaaaaatatattaaataaacattttaaattttatagcaatatctttcaagacaatttatagtttattttaaaaagaacttaattactattgatttttagccaatctattagaaaaatggccaaatatttatatctgcaataaagaaacttcaatagctttgaaattaattttaataccattaagagttcttttaattaaatttctaattattgttattaaaatatattaactcttttaggccaggcatggtgactcacacttgtaatcccagcactttgggaggctgaggcgggcagatcatctgaggtcaggagtttgagaccagcctcgccaacatggtgaaaccccatctctactaaaaatacaaaaatcagccgggcatggtggcgagtgcccgtagtcccagctacttgggaggctgaggtacaagaattgcttgaacctgggaggcagagattgcactgagcccagatcctgccactgcactccagccttggtgacacagcaagactctatctcaaaaaaaaaaaaaaaaaagtatatatacatatatatatacgtatatatatgtgtattattaactttttaaaaagtccttttgaaagtatcagtaacttacttgactaagctaaatatcaaatcaatcaagtatttgctgcctaatgtggaggaacacagctttccttcccagcccactatcaaaccatcaatggatgaagaaaagggccttttctatcacaaaggtatccaaatgcctttaaaggaaaaaaaaaattagacccattgaacaatgattatgtcaggaactatattaaattccaaaaatacaaagataggttagatacctgccctcagggaactctttgtttacttgaggaaatacaaagacaacatgttaagtgcaataacaaaaataactacgaggtaaagtcatggtacaaattcttttccatagtacttgtctctcattgtgtatttaacaaatatttattgagcacctattgtgtctaagatactgtgttagtaccctgtaaaagatgcattaaaaacaacagcaacaaaaaaaaacactcgcacacagaagtttcagtctgtaaggagcatctgaaattgctaaatacctgacctcttagttctagcattattcttgccctgaggttgcccttttcaaacagctatagagttatcgtcttccaaaccattaaaaacaaagttgtcttcaaaaaaactttataagttgtcactacataaaaatatcctaagtcatgaattatttttaaatatgctacaatgccatttattgtacccagtaaatagcccaccaagaggcataattaaagtcattattttaatccagtgtctcctactctcttctcttttggccttctcccatctgctctcaaaaattcttcgaaaatgcaaatttgaggtcattcctataaccttatgttgcctcatgacactgagaatgaaattttaaaatgccatttatgatccaactcgacttagctgtccaacctaacttcccaccaccagacacactataaaaaacaatctcattaaattcatttaaaaacttcttttaggggagttattgaaatgtacacacttgaaattgaagtgttatcaaagaaccctccttatgagaatcctcaaggaaaaccctacttaggcttcaatttcaggaaaatacgtgccttttttggaaacctggtttgttcttaccctaacaatcattaattatttaactaatatttctatttgcctttgcctctagaaattttaaagcttaatccaaagcccacctctagcaacatgcacagaaactaggtacaatgatctgttcgttattgtcatcccaggctttcactgtttacttattttaccctacccttattatttcagctactttcttttaaaacaaacagacaaactacaggacgtgaaacagataaacttcaagttgtgtttttcatctttgttcgtggcttttcctatgccatgtttctcagcaacaagagcacactaaaaatgtctgttaacttcccactgcaccaggagatgttcttggtgcttctcctttccagtatgtgtgcccataaagcctcttatataagtttatctcaatattttataagatgcattaaaatcatttatttccctgtcccttctactagattctaaacaacttaaaagactgtattgtctcatttctgtatcaacacatcacttgtttctgcatcatttattacgtatctcacatataatcctcaaattattaagtaagcaaataaaacaaattattagtaatataaatgaacactcccctcccttctctcatgaactttacttttactcaattccaagacaaaagtactttagaagaggcagtctggagtaacacaaaggatatgggctctggacttcggcagagttaggtttaaatcctgttgtagttctttaccagttatgtaattggggaatttaccatattttcttgatcctagaagatgcacctgacttaagaaaaaaaataaatgagagtctcttgagtttcttctgttaaagggacagaatgcctagaatttgcagaattgtcattagacattatataagagctcaagtaaaatttccagtattataggtactcaattagttttgttaaaaatttttatttttaaataagattcacaggaagcaaatgtagtacagagaagtctcatacgccctttactcagtttccgctgatagttgtgtcataaacaacatagtatatcatacccagatacaccatgtgcatggtgttctatatgatttttctcacatgtgcagatctctgtaactaccacctcaagatatagaactgttccattacaacgagaccattcttctgctgcccctttatattctccttccccgccctcaattcttcccaccaatgtgtacaattttgtcattttgagaatgttacataaacaaaatcatagagcatgtgatcttttgagattgctttctttcactcagcacagcgtcctttagatccacgcaagttgttatttgaaccaaataggatcattcctatttattgctgaataatattccatggtatggaataccacagtttaaccattcaccaattaaggaaaactggttgtttccagtttgggaatataacaaagccgctatgaacaactgagtaggatataagttttgagtagatataagttttcctttctctggaataaatgcccaggagcacaactgctgggttgtatggtaaatgtatgtttagtcttaccaaaaactgccaaatcattttccagagtggctgtaccatttcatattcttaccaggaatggatgagtgatccagtttctcctcatccttgccagcatttggtattgtcactattttttattttagttactgtattgttatttcatcatggccttaatttgcattcccctgatgtttacagaggctgaacatctttttctagtataccagacatccttctgtgaagtatatatattcatatatatatatgtgtgtatatatatttgagacagaatctcattctcacccaggctggagtgcagtggtacaatctcagttcactgcaacctgcctcctgggttcaagtgatcctcccacctcagcctctcaagtagctgggactacaggcatgcaccacctgcctagataatttgtgtaatttttagtagagatggggttttgccatgttggccaggccggtcttgaactcctggcctcaagtgatccatccacctgccaaagtgcagggattatagccacgagccaccacacccggccaaaaacttcaattttgattaagtccatattaccaatttttccttttatgagtcatgcttttggtatcatatctaagaactttccatccaagcctaacttcctgcaaattttctcctatgttacctcctaaaagtctcatagttttatgttttacatttacatctatggtccatttaattttttatgaagtgtgagatttaagtggagggtaactgttttccctgtatctaaatgctccaacaccacttgttgaaaagactatcttccactgaactgcatctgcatctctgtcaaaaaatcgtttggctgtacttgtataggactatctctagattctctgttctgtaccattcatgtatgtatctatccctcaccaatatcacagtcttgattactgtagttataagtgttgaaatcatgaagagttttgtttttggtgccttcctgtggattatctcaacattttttagaattctacgttgatttatttatagtgtttctgagtgtaactcttgtttgatctttttctaccagttgttctaggcattacattatatatacagaacttatcatagcctacattttaacagttcaagtgaaagtacagaaaccttacctgttagctccctttactctcccctattaataaaataatttaaatatttcctgtacatgcatttaaaaccacattcgacagttaaatacaattttgtaaaattaaaaaaaaatttgaatcggagtagtggctcacatctgtaatcccaggactttgggaggctgaggcagtggatcacttaagaatgggagttcaagacaagcctgggaaacatggcaaaactccatctctaccaaaaaaaaaaaaaaaaaaaaaaaaaatcagccaaccatggtggtgcatgcctgcagtcccaattacttgaacggctgaggtaggaggattgcttgagcccaggaggccaaggctgcagtaagcagagatgatgccactgcactacagcctggatgacagagcaagaccctgtctccaaaaaaaaaaaagaaagaaagaaattctgtttcatttacccatattttttgctctatatattgttcttccttcctactgctccaagattacttcttttatcacttcctttctggttagagaaatacttttagctattcttttagggtagctctgctggcacaaattatcttaatttttctttatctgagaatgtctttactttccctcaaccttcaaggatactttctctggatataaaattctgagttgacaggtttgcttttttctagcacttgaaaaatgtcgtgccacttccttcttacctccagtttttcagatgaaaaataactgctgtcacttgaattggtgttcttctatagataatgcatggtttctctctggttactttcaggatttttttagtgtcttggcatgcatttctttgggtgactcctgttaggtattccatcaccttctttcatctgttttatgtctttgtgtcaaatttgtgggaaattcagccattatctcatcaaatttttttagcaccactttctctcacttttttgtcgaacatagttttacctgtctctgaggctctattcaaatttttttccatctattttctctctgatgttcacattaggtaattatttttctagtctcgtgttcactgattcattcctctcctccattctattgagaacattgagcttttattttcagttactttatttttaaagcttgttttattgtcacaaaatatatatacataattttcattttaacatttttaaagtatataattcagtggcattaagtatattcacaatgttgtacaaccatcaccactacctatttccagaatttttttattcccctcccccaaaaaactctgtacccattaaacaacaattctatctccataatttgcctattctaggcagaggtggaatcaagcattatttgtcttcctatgtctggcttattgtacttagtatgtttttgaggttcattcattttgcagcatgtatcagaatgtcattcctttttgaatctgagttatattccattgtaagcacatgccatattttgtttatccattcatttgttgacatttgggttttttctacctcttggctactgtgaataatgctgctatgagcatttgtatatacgtatctactggagtccgtgttttcaactctttaggatatatacctaggagtggaatagctggatcatattattagtctgtctttaaaattttgagaaaccatcaaatgattttcaccaaggtggctccattttacattcccatcggcaatgcaagtgttccaatttcttcacatcctcaccaacacttgttattttccattataacaaccaccctaatgggtatgaagtggtatctcatggttttgatttgcatttctttaatggttgatgatgttgagcatctttttcatgtatttattgacatttgtatatcttctttggagaaatgtctgttcaagtcctttgcccatttttgaattagatttttctggggggaaaggggctaattgtaggagtcctttgtatattctagatattaagcccttttcagatatgtaatttggaaatattttctctcatgtagttaacagactaagtttttggagtagttttaggtttacaaaaaattgattaggaagtacaaagagttcccacacactcctctctctcttcctcaacacagtttcctctattatttacattttgtattaatgtggtatatttgttacaattgatgaaataatactgttacattatatatatatatttttttgagacagaatctcggtctgtcgcccaggctggagtgcagcggcatgatcttggctcactgcaacctctgcctcccgggttcacacaattctcctgcctcggcctcctaagtagctgggactacaggcacccaccaccatgcccggctaatttttttctatttttagtagagacggggtttcaccgtgttagccaggatggtctcgatctcctgacctcatgatccgcccgcctcggcctcccaaagtgctgggattacaggtgtgagccactgcgcccggcctactgttacattattaataactagtatctataacttaccttagggttcactcttggcgttattcattctgtgagttttgacacacataggatgacatgtatccactattagtatatcatacagaatagtttcactcccctaaaaatcctgtgctccacctattcatcccctctccctccaattcctggtaactactgctctttttatggtttctatagttttatcatctccatatagttggaatcatacatttcgtagccttttcagctttgtaacatgttttcaaggttcactctgggtcttttcatggctacgtagctcatttttaaaatacactgaatactattccactgtataggtgtacaacagtttgcttatccattcatctattgaaagatatcttggttgcttccaagtttttggcaattataataatgctgctataaacattcataggctgatttttgtgtggaccagttactttattttttagttccaaaatgtccatttggttcttctttacatctcttattttttcctgagacaacttttcttcattcgtttccagcatgttcataattgcttgctgaagcatttatatgactgctttaaagtccttgccagataattgtaacatccgttccatttcagtgttggcttctcttgtcttttctcaaatcttcctgattctttggattacaatgccttttttaaaaattgagacctagcattgtaagactctggatcttatgttttagcaggcctcctgtgacaatgctccaactaaaaagaagggacattgccttatttctgttagatcaaagtagaagtccagttcctctacttggcatctgttgatatctggaaagggtggtgttcctagatactgctaggcaagaatgggagttcaggctccccactaggcctctgccattaccaccagcctgggaagaatcccagaggtgcctcattacagttccctacgtgtcccccactgacaccatggatgggtggcctttactgctgataggtggtagaagttcaggtctccaccacagcaagaaggagtgcctcttactataaagtaggagtagatggcttggctcctcatgttgtctctgctgacatcacggggttcagggcctccttatcccctggtgaggataaaagtcctagtttcccacttagccttctctgatatcaccctggtgtgggaggagtgggtaggtgtaggcacaagtggggcacaagtgtgtaggtgaggcacaagtggggctccttgttatagtctggcaagcgtggaaagtgtaggctctttacttggcctgagctggcaggaatggggctgtagttttttctgtggtatttgcttggagtggatagttactctcttaaaagttgtctgccttgataggctgctcctttcctggtccttttcttcggtctttcttttgtgcctattgttatttctagttgccagtttttctagcagctgtctgcgacatacggagaaaaagaaacccaggaacaaacatgttgttctttgtgtcttgagatccttagccaatgttccttctcctctccacctttcaaagtcttaaattcttttatacataatgttcagagtttttagctgtacttagcaggaggaataaaaaaaagtaagtctactctatcttcctggaaaaagaaatctcttttaatagcctttattaatagctatattacatgtcaagcatcaggagaacaggaacaatactgaacttgaagttcagagaattgagttcaaatcccggctaacacgggagtttggagaaatcgtagttctgtcacttgttactcaagtgtcataattatttaacctcttagaacttcagcttccacatctataaatggaaacggcatcactttttcgcaagttggggatgattaagtaaaaactgtatacctgaaaacatctgacacaacacttgacacgtagtttgcactcactgactctgactctatgtttatcaaaatggttaagataaaaattgaatgattttagacccataacatttaaatgagctctgaattagtagttatttattctctatcttcttgtttcaaaataggctcccaccccaaattaagtcaggaaaatatgttgtaactaaacgcaacctgtaatttcagtgtcgagatgaatctatcttggtttctcacttcttgttctagctggagagtattctggtagttttcagcttcagaaactggagcccctagaccaaaatcatattctttggtggtaacctagtacaaagaatgggaaataatacagaggcattcagtttaaaacagctctgtgatttcttacatcaatacattttgaaaattgataatattcttagattttttttaaccatttcccaccagctaagaggatttcatcaaactttaccttcttaaaatttataaaactttttctgtgtgttgtccaaatggtactgaacatgcttttcaaagacattccctacactatccttttggtaatcatggttctacagaaatatggatcagtagcaaattaaagagtctacctctaggcttgtgttgtccaaaatagctattagtgagttacgtttgctgttgctactctatacaagaaaaaaggtttgcaattaatatcacaaagagtgaatttcctgaatatagaaataatccctagaaataaaaaagattaaaaaagtactctaatagaaaaattggcaaagaatgtgaacatttacagaaacggctcctaaatattaagatgttcaatctcaacctttagtgacacaaattaaaacactgagatacccccttttaaccatcacatggcaaagatcagtaacatggatatagcgtccttacgtatcaccggtgggagagtaaactgatacaatatttatggagaacaatggtataaaatctatcaacatgacaaatgcacatagcttctgttcaaataatttcatttctagaaatttatactacagctatatatatgtacacttatgcaaaataacaaatgttagagatttttcactttagcatactatacatactattctgcatcacgctattttacttgacaacatatcttagagactgtgtaacttaggaaaacaattttttctttccttgaatcaaggctaccattgtgttaaaaaagaatttgttatgagcatcttagatctttcctcaaaacacagctgctgttctccaaaatcctacctagggaattacagaatcaggatctccccagtcactgaccttatgatgcactctgtgtaacccagcacttagacaggccggcagatttatttcccttttttctcttctctaaacaagacacaactcttcttcattgcaacagttactgccccacctggaacctcaacattagatctcacagaatatttcaaattatgaagcatttaaacccccaggggctggactgaactcctaactaccatttcttacatggtttctgttaaaaatgtattgctagttataaacatgatttagaataacagaatgaaacgactcctcactagagcagtactgttcaatttttactgaatttaagaatcatctgggaatgttgtgtgaatgcagattcttatttacaggctgagatttgacatttctataaagctgcttggagatccctatttggttggtacagagaccacatgttgaatcatgctgtgctgtaatttctgatttatttgaatagcaaggatctatttaagtctaaacccatccaatattcagagtacttctgtaattttgtcccttcctacttctccaaatttacctcctacttgatacctccaagaatccctctatgaaagacaaactatgcaacacttaagggtctcaccctgtcacccaggttggcatgatcacggctcactgcagcctcgaaccccaggcccaagcaatcttctcaccctagcctcccaaatagctgggaacacaggcatgtgccaccacaattggctaattgttttaaattttgtagagtcagggtctccctatgctgccctggctggtctttaactcctgggctcaagagatcctcccgcctaggtctccctgggattacaggcatgagccactgcacccagccaacacattcttaatacatatattcaaaagtattttatcatctgttcaatgagccttgccctcactattttctccatttaacttaagacatttttaaggctcagctggaattccatattctccaggttttctctgtcttctccactgcataatgatcatctcttaattgatatttatatatatagaagaatttatgttctaaatttttctggatgtcttcctcacacatttattagactcttaagaacaagcaatgtccaaaaactctctctatccccattaacctgcacagttatttacgtaataaaaagtgtcaaaaaatttgttgaggttgataatgaagcagtgtgataaagcatacaaaattaaactttcttcctcctctttggtaaaccgaataaagtggggcttttgcaaaattacctatcaggcccagctaggaattaaaaatagcaagagaccacaagtccacctgacaatcctaaccaatcatgctggagttgctatcctccctccaccagctttgggggcaatatcactagaggaaagacacatcagtgtatctgaaattcccatgcctggtctgccagcttccctacctcaggccacataaatatcctcaaccttgctgcaatctcatcattagaatggaacttgtgctcctgtaccgttctcagagaaggcaagtgaaacaatgttccttcttaaaaaaaattattttttcttttttatgctatccctcccctaggcccccaactccctgacaggccctggtatatgatgttcccctccctgtgtccatgagttctcactgtttaactcccacttatgagtaagaacatgctgtgtttggttttctgttcttgtgttagtttgctgagaatgatggtttccagcttcatccatgtccctgcaaaggacatgaactcatccttcttaatggctgcacagtatccatggtgtatatgtgccacattttctttatctagtctatcattggtgggcatttaggttggttccaagtctttactattatgaacagtgctgcaataaacatacatgtgaatatgtctttagagtgacttataatcctttgggtatatacccagtaatgggattgctgtgtcaaatggtatttctgattctagatccctgaggaatcgccacactgtcttccacaaattagttgaatttacactcccaccaacagtgtaaaagcgttcctatttctccacaacttctccagcatctgctgtttcccgactttttaatgatcgccattcaaactggtatgagatggtatctcattgtggttttgatttgcatttctctaatgaccaatgatgagctttttttcatgtttgttcgctgcataaatgtcttcttttgagaagtgtctgttcatatcctttgcccactttttgatggggtcgtctgtttttttcttgtaaatttgtttaagttccttatagattctagatattaaccttttgtcagatgggtagattgcaaatattttctcccattctgtgtttcctgttcactctgatgatagtttcttttgctgtacagaagctctttagtttaattagatccatttgtcaattttggcttttcttgccattgcttttggtgttttagtcatgaagtctttgcccatgcctatgtcctaaatggtattgcctaggttttcttctagagttgttatggtcttatgttttatgtttaagtctttaatacatcttgagttaatttttgtataaggtgtaaggaaggggtctagtttcagttttctgcatatggctagccagttttcccaacatcatttatgaagtagagaatcctttccccattgcttgtttttgtcaggtttgtcaaagatcagatggttgtagatgtgtggcgttgtttctgaggcctctgttctgttccattggtatatatatattggtatatatctgttttggtaccagtaccatgctgttttgattactgtagccttgtagtatagtttgaagtcaggtagcatgatccctccagcttcgttctttttgcttaggattgtcttggctatatggggtcttttttggttccatgtgaaatttaaggaagttttttctaattttgtgaagaaagtagatggggacagcattgaatctataaaatactgtgggcagtatggccattttcacaatattgattcttctgatccatgagcatggaatgtttttccatttgtttgtgtcctctcttatttctttgagcagtggtttgtagttctccttgaagaggtccttcccatcacttgtaagttgtattcctaggtatgttattatttttgtagcaattgtgaatgggaggtcactcatgatttggctgtttgtctattactggtgtataggaatgcttctgatttctgcacattgattttgcatcctgagactttgctgaagttgcttatcagcttaaggagattttgggctaagacagtggggttttctaaatatacaatcatgtcatctgcaaacagagacaatttgactcctctcttcctatttgaataccccttatttctttctcttgcctgattgccctggccagaacttccaatactatattgaataggagtggtgagagagggcatccttgtcttgtgctggttttcaaagggaatgcttccaggttttgtccattcagtatgatattggctacaggtttctcataaatagctcttattattttgagatacattccatcgatacctagtttactgagagtttttagcatgaaggggtgttgaattttatcgaaggccttttctccatctattgagataatcatgtggtttttgtcattggttctgtttatgagatggattatgtttattgatttgcgtatgttgaaccatacaacttcatcccagggatgaagccgacttgatcatggtgaataagctttctgatgtgctgctggatttggtttgccagtattttattgaggattttcacatcgatgttcatcagaaatattggcctgaaattttttgctgttgttgtttccctgccaggttttggtatcaggatgatgctggactcataaaatgagttagggaggattccctcttttttctattgtttggaatagtttcagaaggaatggtaccagctcctctttgtacctctggtagaattcagctatgaatccatctaatcctgggctttttttttggttggtaggctattaattactgcctcaatttcagaacttgttattggtctattcaggaattcaacttcttcctggtttagtcctggaagggtatatacccttccaggaatttgtccatttcttctagattttctagtttatttgtgtagagacgtttatagtattctctgatggtagtttgtatttctgtgggatcagtggtaatatctcctttatcattttttattgtgtctatttgattcttattagtctggctagcggtctattttgtttatctattcaaaaaaccagctcctggattcattgattttttgaagggcttttcgtgtctctatctccttcagttctgctctgatcttagttacttcttatcttctgctagcttttgaatttgtttgctcttgcttctctagttcttttaatcatgatgttagggtgttgattttagatctttcctgctgtctcctgtgggcattcagtgctataaatttccctctacacactgctttagctgtgtcccagagattctggtatgttgtgtctttgttctcattggtttcaaagaacttaattctgccttaatttcgttatgtacccattatcattcaggagcagtttctatacagttgcgtgattttgagtgagtttcttaatcctgagttctaatttgattgcactgtggtctgcgagactgttatcatttccattcttttgcatttgctggggagtgttttacttcaattatgcggtcaattttagaataagtgtgatgtgttgctgagaagaatgtatattctgttgagttggggaagagagttctgtagatgtctgttaggtccggttggtccagtgctaagttcaagtcctgaatatccttgttaattttctgtctagttgatctaatattgccagtggggtgttaaagtctcccactattattctgtaggagtctaagtctctttgtaggtctctaagaacttgctttatgaatgagggtgccctgtattgggtgcatatatatttaggataattagctcttcttgttgcattgatcccttaaccattatgtaatgcccttctttgtcttgttttgatctttgttggtttaaagtctgttttatcagagactagaactgcaacccctgcttttttttgctttccatttgcttggtaaatactcctccatccctttattttgagcctatgtgtgtctttgcatatgagatgggtctcctgaatacaacacaacaatgggtcttgactctttatccaatttgccagtctgtgtcttttagttggggcatttagcccatttacatttaaggttaatattgttatgtttgaatttgatcctgtcattatgatgccagctggttattttgcccattagttgatgcagtttcttcatagtgttgatggtctttacaatttggtatgtttttgcagtggctggtatgtttttcatttccatgtttagtgcttccttcaggagctcttgtaagccaggtctggtggtgacaaaatatctcagcatttgcttatctgtaaaagattttatttctcctttgtttatgaagcttagtttggctggatatgaaattctgggttgaaaattcttttctttaagaatgttgaatactgacccccactctcttctggcttgtagggtttctgcagagagacccaatgttagtctgataggcttccctttgtgggtaacccaacctttctctctgtctgcccttaacattttctctttcatttcagccttggtgaatctgacgattatgtgtcttggggttgctcttctcgaggagtatctttgtggtgttctctgtatttcctgaattggaatgttggcctgccttgcttggttggggaagtcctcctggataatatcctgaggatatttccaacttggttccattctcgtcactttcagagtataccaatcaaaggtaggtctggtcttttcacatagtcccatatttcttggaggctttgtttgtttcttctcatccttttttctctaatcttgtcttcatgctttatttcattaagttgatcttcaatctcatagcctttcttccacttgattgattcagctattgatacttgtgtatgcttcaccaagttctcacgctgtgtttttcagctccaacaggtcatttatgttcttctctaaactggttattctagttagcaattcctctaacctttttaaaggttcttagcttccttgcattgggttagaacatgctcctatagctcagaggagcttgttattacccaccttctgaagcctacttctgtcaatttgtcaaactcattctctgtccagttttgctcctttgctggcgagcagttgtaatcctttagaggagaagaggcgttctggtttttgaaattttcagcctttttgtgctggtttttcctcatcttcatggatttatctgcctttggtgtttgatgttggtgacctgcagatggggtttctggggtttctgtgtggacgtcatttttgttgatattgatgctattccttttgttagttttccttctaacagtcaggcccctctgctgcaggtctgctggagtttgctggaggtccactccagaccctgtttgcctgagtatcaccagcaaacagcagaagctgcagaacagcaaagattgctgcctgtttcttcctctgaaagcttcgtcccagaggggcacccaccagatgccagccagggctctcctatatgagatgtctgttgactcctgctgggagatgtctcccagtcaggaggcatgggggtcagggacccacttgaggcagcagtctgtcccttagcagagcttgggcactctgctgctctcttcggagccagcaggcaggaacattcaagtctgctgaagctgcacccacagccaccccttcccccaggtgctctgtcccagggagataggagttttatctataagcccctgactggggctgctgcctttctttcagagatgccctgcccagagaggaggaatctagagaggcagtctggctacagcagcttagccaagctgtggtgagctccacccagttcgaacttcccaccagctttgtttacactcatttggaaatgcagaaatcacctgccttctgcattcatctcactgggagctgcagacagaatagaacagttcctatttggccatcttgccagccactaaaaaattatttttaatttattctttatttttttcaatgtgaagtctaaaataaggaagaacttttattctcaattaggaagtcacacagcagagtggttaatatcatgtattttggtatcagcctgcctacattcattatcctagttctgccacatcttagctgtgtgatcttgggcgacctggttacttctctgactatagcttcctcatttataaaacagggatgataataagagtatctgcattggctgggtgcagtggctcatgcccataatcccagcactttgggaggctgaggcgggcggatcacctgaggtcaggagtttgagacccacctggccaacatggtgaaaacccatctctactaaaaatacacaaattagctgggtgtggtggcaggcacctataatcccagctactcgagaggctgaggcaggagaatcacttgaacctgagaggtggaggttgcagtgagccaagattgcaccattgcactccagcctgggggacaagagcgagacttcgtaccaaaaaaaaaaaagggtctgcatcatagagttgcgtgaggagtaaatgaattaatatatgttttaactttagcacttagaatagtgcctggcacatgataagcactatatatattatttactattattactaattcctctcactgagtcaacttatttaattggctatcaagtcctactgctcttttcactaaaaattatctcagttacatttcttccatccctactatcactgttttagttcatgctttcagactgtagcagtcacatgtattcactttatatgtaaacttataaatagctagaataagaatgaaccagaaatatgtttctggggataaaaagatgtaaaacaaatagaatcttacaatttcaaccctaaatgaatctaggaaagtccagaacaaataaatcagaaattacaccacagcatgattactgctacatcagagtaatgcacacagatgctaaggtaacactgagaaagaagctacaaaaaaagtatttctgccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccatctcaaaaaaaaaaaaaaaaaaaaaaaaaaaaaaaaaaaaaaaaaaaaaagtatttctgacttctacttcttcaaaaaagacttaggatctactcttcattccaaaagaactatgaacatatcccttctggagcacttaatgcattatattacttttatgggatgtccacagccatggctactttaacgtgtctaaaacagacttcctttttttttttttttttgagacagtcgtgctctgtcacccaggctggagtgcagtggtatgatctcggctcactggaacctccacctcccaggttcaagcaattccctgcctcagcctcccaagtagctgggattacaggcacctgccaccatgcccagctaactttgtatttttagtagagatggggtttcaccatcttggccaggctggtgttaaactcctgacctcatgatccacccgcctcagcctcccaaactgttgggattacaggcgtgagccactgcacccggccaagactctgcctcttaatgtgatcaccttaggggttagaatttcaacctaaaaattttgtgaggacacagaaattcggactgaagccacacattagaggaacagaaagaaaaagctattgggcgaacaaagaagggagtactagatcttgtaagtgaagacaagggccaaatcatgtaaggccttacaaagtttggattttatttttaattgcagtgggaagccattggtgtatttttgagccaggatcatcttattataattttctttttcatttttttttccctctcccttctcccctcccacaggatctcattattttgaagtgattgatatgatatcagtgtggagaataggttgtagggagcaacagtggaagcggaaagatagcagggaatggttgcagtattttaggtgggagatgatggtgacttggaccagggaggtggtaacaaaaatatagagaagtggatggatttaggatatatatttgaaccaacaacatttgctaataaattagaagggatttattgcagtgagccgagatcgtgtcactgcactccagcctgggcaacagagtgagactccatgtcaaaaaaaaaaaaaaaaaggcacagccatgatgagttgcctgtatataataggccccagagagctcccttgccccttctaacatatgaggacagagtctgaaggtaccatctatgaaccaaaaaacctcagacattgattctgctggcaacttggatcttagaattcccagtctccagaactgtaagaattaaatttctgttgcttatatgttatttcattatagcagcctgaatggactaagatatttgccagtaacatttgacttcaggtcctctgctcttgcttttcctctctcaggaacactttctacccagcctttcacatggctatcttctcaccctcagctctttggctgaaatgtcagagggtcttccctgacttcttacctaaagtagcctctctcctagtcactctctcaaataagtgataagctatttgcacttatcactacttgaaattatatcatttgctgacttgtttactatctccccatactagaatataaaattcaagagctctaggcttttgtcttgtctctgttttatccctaatgccttaaaagtgcccagcacaaaggtgaaacgcaataaaacattttcaaaataagaaaatttaatgattcgaacaaagcagtttcaatggtgggtgaaaacaagtctgaaggggactaatgaatgaatagtaaagaaaaagaaatggaaaatgtaaacttcttttaggaagcatgattgtgagaggaagagaggtacaacaaaggtggaagacaaccaaggttgtggaaacgtcattatgggaagagaaaaacttgttccttaattctctttacataaggatcctctttcagaattaaaagtcctgcatcctctcctcagaaaaatgcaaatacacctttacaaacaatttcaggggatttaagactctataaggtccttggactccaggtgaagaagccctacagtacagaaacaatgaagattcctaaggcatgagttaatgttaattgatggagaaagacagctgaggtaataagaggaaacccagataaagatgtattgccccgacacaagaaagacaaaagcaaggacaggtgaagatttagacacttgtaatcccaataatcccaacactttgggaggccaaggccagaggatcacttgagcccaggaatttgagaccagcctggacaacatagtgagttcctgtatctacaaaaattaaaaaataaattagccaggcatagtggcatccacctgtggtcccagctacttgggaggctgagataggagaatcacttgagcccgggaggtcaaggctgcaatgagtcatgatcgcaccactgcactccagcctgagcgacagtgagatcatgtctcaaaaaaaaaaggtaagtgtcatggaaatctgaggaagtttctgtctggttgaattttaatttttcagtgaaacaggagctaagattatataataaaaagtatcatcggtgttgagcaaaatatgaagcacataatatgtattcaacaaattattgattttttgatagaatggaaaatactggagtacttcaatggaattctgaaatctggttccacaaaagcttactacagttgaggtgggtttttctttttaaaaatattgtctccaaaagtgtagacttatagacattgaagtagaaaggaactgcctcactaacagaaggatgtggaaaaccatacaagatttatgaataattctgagagagtattttatataataaaaataagtggataaatattttgggaaacaatcagcaaactaaatactgcgagcaacaataaagattaatcttaaaaaaaatgttgagtaaagaagcaagatgtaaatgaatacttagtacaattccattcgaagttcaaaaacaagccaaactgtaatgtgcatgttcacatacaatgatgtgaaacattaaggaaaatcaaggaagtggctatcttagaagtcaggagagtggctatctctggggagggaaagaaatatgtaatctgaaaaggtgataaatagtaatacctctaactgcctctgtgtatggaggacttcaaaaccaaatcgtcctaaacaaactagtctaagcaactcaaaaagaagacagaaaagatctcccagagaatctctacacctgattatattctgggctacaggcagtgatttttcttcagaaggtaaacagtacgcgagatattgtggaagctgccattaaataatgccaaagtttaggatttaaaattaatatttaattaatgtaccgtcctagttatttcccactaattaagactgaagagtttggctcattaatcaattaaaatacaaacaagaatctgtcttatcctggaagcagattcgaatgcgacatcctacttctataactaacctgtttttttctacttacaaacctattgttattctacttatgtccttacacgtaaacaaagtatacttgaaatgctgaacaccagtacagaaaattttaaacaaggaaatctcctaggatataaggtcctggaatggaagaaggaaaacgttgggacactataatctatgcaaactttcccgaagctgcgaaaaaaaaaaagtgaaaaaaaaccatatttctgtgagtttttaggtatcaagtccatgatcacctagttatccaatttaagtctcaaatagtttttcaacaaaagccagctttccctgcctttactgtgtataatttttactaaaattatctgagattttcatgcaaatgcctatgtaatctcagcctttcaccaccccaagtctagaaagaggctcagaaatgagcgatcgggagtcaggctgaactcccaaatctgtgacttccaaattcctcggctccaccagagcttccagagcgtttctaaactgaacagtctccccaacaaccaagcggagagctgcgggaggacgcgaagcagtgaccataggaactgggctcaaacctaacctcccaagaaacaggggcaactcgtgctgccgagcttccggccggcagctgtgcccgccgctgcccctcacagccgctcccgctgctagcgcccaactccgcccgccacggccccgcacccgccactcctgcccgcttgcagccgccttctcagagaccttccagtccagtagcagcactctccccaccccgcgcacctccgcagcttctacctggagctccgggtccctccccgggctcctcggcccgccgtcctgcccagagctcatccccgcgactgtcagctctcggcctcagcgggggatacaagaaccgcccactctccatcctccgcccctttctcctcccttcccacccccaaatcgtcctggccccgccccggcggatcggaggaaggacggagcccgcgggaaggaggagggggcggttagcgccagccagtgccgccgtggccccgccctcacgctctgtaccggagtggggctcgtcttccacctccccggcgccccagctttgcttccgtcccgctcgcccccaggcccggtgcgcacgcgtacctggctcgaccttccttctcgcggggtctacaagccgtgcgcgcgctcctacgcacggagcgacgcgtacgtctacctgcctgccttacagggcacctaggagggaccccttcctggcccatccgcgccgcgcaggcgcacgcccacgcagcgcctagacgcccgagccgagcgtcccgtctcctagtaaccagccgctagcccccttttccacgactcatttcttaatctctgcctgaggctgccgcacctggatggaacgcgcatgcgcaaggctgtctctcgcagccccgccttccctcagcttgaaacacctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccggtgagcgtgggcagcctggagtcaggggagcctggggaccacggccttggtcagctctgcacgatcagggctgaatcaggaagtggcagatctagcaacaaagtccagattcctgaccgatattccttctccacatgccagtccttttccaaatcccctcaccttaaagtgacaaatgagctttttagtgaaaaagaatgagcgctgcattcttctaccaattttttggagcccagaatgggggggaaaaaagtcttcttaatttttcttaatacctaccatgtcccttcttaaataactcaagagcttctggatgataatggtgactttatctccttttcctgcagatgacatagacactaggtttttacagcaattctctgatgaccttgatatggtagaacgctgtgtatttcaagagtaagctctcgtttgaggagactaacaattcctgttttcgccaggtgagtactcatttttccccccacaagatatcattggcagggataaacaacttttgtgtagaacaaatttagtcataaaaatacatttaatataaatgccatgtttttccaatgtcttttcatcgtgttattacatggtctcatattttgtcgcatttattttcagatatcatatactttgtaagtataattagataccaaaaaaaattaagtgtccctgttattttagattaagaggttagaggacacaaggagcacatatcctcggaaatgtaattttttaaatgcacaaaataacaaactgagaagttatgttagagggaataatgtataatctcatttcctcttcagatactaagattattttgaatacattatctagcattattaaaaacaaataggaaagaatgttctaagtttaaaactatcagctggagttgaagacttcgggggtggggagattattaatataggaagtaggaaagtacttcccttatagaaagaataagaaaagtttaagcacttatgtatgccacctagacggtactgaagattatttggaaagaatataaggaaatgatcattttaaggccaaaagagggtgaaaagattttccttttttttcctatcaagaactgttgactttctcccctaacctgagaaagtaaaaatttccttccctctgtggaaacccaaggggtagtgagtgtcccaccctgccccaactaaaccttttttttttttttttttttttttttgagacagagtctcactctgtcgcccaggctggagtgcagtggcacgatctcggctcactgcaacctccgcctcccgggttcatgccattctcctgcctcagcctcccaagtagctaggactacaggcgcccactactacgcccagctttttttttgtttgttttttgttttttgtatttttagtagagacagggtttcactgtgttagccaggatggtcttgatctcctgacctcatgatccacccgcctcagcctcccaaagtgctgggattacaggtgtgagccactgcgcccagactttttttttttttccttttttttaagacagagtctcactctgttgccctgtacccaggctggagtgcgttggcatgatctcagctcactgcaccctccacctttcaggttgaagcagttctcctgccttagccccttgagtagctgggaccacaggtatgtgccaccatgcccagctaatttttgtatgtttttgtagagatgcggtttcaccatgttgcccaggctggtcttgaactcctggactcaagtgatccacccacctcagcatcccaagtgctgggattatatgcatgagccactgtgcctggcccaggctaagccttatatagtaccctgtgcttgctctctcgtgacagacaccttctaaggtcttggttttctagtcccttaatttttccatcatttcaaaagcttcactacaaaaacctctgttattactattttttgttttgttttcactgtcctcttcctgatcccctcaaaaaaaaatctgggactccaattccatatgtgttaagccacttgatcttgttccacagctcactgatgctgtgttccttttttttgtttgtttttttgagatggagtctcgctttgtctcccaggctggagtgcagtggcgcgatctccgctcactggaagctctgcctcgcggcttcacgccattctcctgcctcagcctcccgagcagctgggactacaggcgcccaccaccacgcccggctaatttttttgtatttttagtagagacggggtttcactgtgttagccaggatgatctcgatctcctgacctcatgacctgcccgcctcggcctcccaaagtgctgggattacaggcatgagccaccgcgcccggcctgtgttccgttttttaaatcagagagtttcctccttatgccgaggcctgaaagttccaggcaatgtccattcatagggctcactttatttcctgtttctcaaggatcactctcccgaactgcctgttgtccaatatctaaaagccattgcttcatgtgttttgtgttttgatgctgaaagcaggcggggcacggtggctcatgcctgtaatccagctactcgggaggctgaggcaggagacttgcttgaacccgggaggcagaggttgcggtaagccgagatcgtgccatcgccctccagcctgggggacaagaacaaaactctgtctcaaaaaaaaaaaaaaaaaaaaaagatgctgaaagcatgaggataagtctggtctctgttactccatcatgactagcagcagaagtctgccattcttcacagttccaggccccatgtcactaactatcctcaagggatgtggtttgcaatgcaaaaattgcttcaggctgggggaactgtaagtgcaaaggtcctgaagcaggagaaggtttggcatagaatatgcttgaggaacagcaatggggtgataggtctggggtcgaataaggcaaagagacaggagagagtgcttgctagtagagttgtttgctacggctgtgcaacaatttaccacacacttggtgtctttaagcaacacaaatttattatcacacggttctggagatttacaagttcaaattgggtctcactgggctaaaatcaagatgtcaggcaggtctacattccttctggaggctctaggggaaaatcccctttcttgcctttccagcttctactggcagcccatgttccttggcttgtgatcccagtctatattcaacgccaaaaatggccagtcaagtcctcctcacattgcatcatggctaacacattctacctccctctttcacttctaaagactcttgtgtggcaggtgcggtgactcacacctataatcccagcattttgggaggccaaggcaggtggatcacttgaggtcaggagttcaagaccagcctgttcaacatggcaaaaccctgtctctccccaaaaatacaaaaattaactgatcgtggtggcaggcacctgtaatcccagctacttgggagctgaggcacgagaatcacttgaacccaggaggcggaggctgcagtcaccctagatcacaccactgcactccaacctgggcaacagagtgagactctgtcccaaaaagaaaaaaaaaaaagacccttgtgattacattagtaccacccaattaatccaggagaattttcccaccctcagagtcagctgattagcaaccttaattcccccttgccacataacataacatagtcccagcttctggggattaggacaaagacatctttgaagactattattctgcctaccacagctggggaccagatatgtagataatttttttctctgatatgggaagcaactagagtgtgttgagcagaggactgctgtgatctgggttttgttataaaaggttcaaaccagtccaggcatggtggcttacgccagtaatcccagcactttgggaagtgggaggattgcttgagtacaggcattcgagaccagcctgggcaacacagtgacaccctgtctctacaaaaaaaatgaattttaaaaattagccagatgtggccaggtacggtggctcatgctgtaatccaagcactttaggaggccaaggagggcagatcacttgaggtcaggaattcgagaccagcctggccaacatggcgaaacatcgtctctactaaaaatacaaaaattagccgggcatggtggcaggtgcctgtaatcccagctactcgggaggcctcagcaggagaatcatgtgaacccagaaaggcggaggttgcaatttctttgcaacttgaatttctctgattcctagttaattatctgtttgggattcctcaatctgtgaattatgtttttatatcctttgcccatttttctattgggttttctttttccttgctaatttctaggtgttctctttttattccagccattaaataccatcagctttggacacagaaaatatctccttccagtctcttatctatctttttgtttatatttttttcattgaatagaaattctcaattatgagtaatcaaactcactgttttcctcccttattgtttaagctttttagtcttgttcaagaaatctttcttcactccaaggtaacagatattttcttctattgcatttacagttctgccattcacatttaggtctttaatgcatttgcactccacttttttttctttttgagacggagtcttgctctgtcgcccaggctggagtgcaatggtatgatctcagctcactgcaacctccaccccctgggttcaagcgattctcctgcctcagcctcctgagtagctggaattacaggcacccgccaccacacctggctaatttttgtatttttagtagagacagagtttcaccatgttgatcaggctggtctcgaactcctgacctcgtgatccgcccacctcagcctcccaaagggctaggattacaggcgtgagccaccgcgcccagcctacttctgtgtttaagatcctgcttatgtccacatagttagccaatgttcacgataccatcatactaaacttagtctgttctatctcctttgtcttatagtgccacctgtgatatatgtgaagttcctgaaatacctaagtccaagttacagctctgtcatattctactgattatttgttcctgtacctgtacaaggttatttttattactttcactttgtggcatatctttttgttttttttaatttttttctgatagggatgaggtctccctatgttgcccaggctggtctcaaactgctggactcaagagatctttccaccttggcctcccaaagtgctggaattacaggcgtgagccattgtgcccagccgcgtagcctatcttaatatctagtaaagaaagccactttgttctttttctccagattgatttatctctttatgtacctttattcttacatatatattccagatttcttcttgaatggcaacctaaatgccagtccaaagaggcccccaatagacttgttcacccttcatgtcctcaactctggggaagttaaggtaagactcacagggccaagtctaccctattatacttggttcctcctcagtccttttattagattgaagtttaatgtgcaaattgataattatatgttaccattcttttacgtttgttgatttcaaatgccatgttttagagttttgtgttttttaaaacgttttttcaattttgtattttgaaaaagttttaaacctacagaaatgtaataataataatatgtagaacaactttttaagctttacctcctagatttaacagttgttagcattttgcatattttactgtctttctgtatctatgtatctatctatctattgctaaacaatttgagggcaagttgcagatacaattcttcacccctaactatttcagtatgtatttcctaagaacaaggacattgacttatataaccacaatacaattatcatattcatggcatttatcacattgatccaatattattatctaatattgtcccatatccaaatgtttcagttatctaagtaatgatctttgtagtacattccatccccttcccaattcaagagcattggttgcatctgaaataatgtatctttagcctcctttaatctgaaacagttcctcagcctctctgtgtctttcataacattgacatttttaggtagaagctatttgtttcatagaagatacttctgtttgggtttatctgattgtttcctcatgtttagattcaagttatgcatttgacaggagtatttcctttctaagaaaaagagaaaccaaatagaataaactcaattttattcatttgaaggcagtattagatattcctttgatgaggaagaaaaattcatcttcaagttccaaatctaaaaatcaaatatacccatatttcagaatttcatcagagatattaaaaaatttagctaagttgtatttgagtcccagaaagccaaatatatactatttacctaattgttatattaatatttgagtaagtactatatttaggctactacagtagacccaggactctgttttgttataaacactgatattcagtcacaaatatggataaacagggtttcaagatgattctttagaaatgttcagtcagtaattacagcttgatgagtatgaaattgtaaactatcaaagataccacagtaggtaaatattaaagacataatacattctaaaaagtgggtgaggctgagcgcagtggctcatgcttgtaatcctagcactttgggagctgaggtgggtggatcacctgaggtcaggggttcaagaccagcctggtcaacatggggaaaccccgtctctactaaaaatacaaacgttagagtttctgtttgggatgattaaaagttctggagatggatgaccatgatgtttgcacaaaaatgtaaatgtactcaatgtcattgaattgtacacttaaaagtgtttaaaatggtaaatgttatatatattttaccacaataaataaaatatagactggaaaaaaaataaataaaaataaaaataaaaatacaaacattagctgggcctggtggcgggcacctgtaatcccagctactcaggaggctgaggcaggaaaatcactttaacctgccgggtggaggtccagtgagccgagatcgcaccacttcactccagcctgggtgaaagggtgaaactccatctcaaaaaaaaaaaaaaaatgggtgagggatttcgatcgaagctgtggaatctgctccagatctcaggttgctactatagcatcttgggtagatcactcttctccagtaagccctgggctttctcaaaccttttctgtacaggaagcctgtcccttctgccatcctggtcaactctgcctaccaaattcctgcccatctttgaaagcgaaaccctaacctaggctcccctcctttgggaaacttcccaaggcctccctccatgctacatgatcatcttttttttttttttttttaagacggagtctcgctctgtcgcccaggctggagtgcagtggcgcgatctcggctcactgcaacctcagcctcccgggttcacaccattcttctgcctcagcctcccgagtagctgggactacaggtgcccgccaccacgcccggctaattcttggtatttttaatacagatggggtttcaccatattagccaggatggtctcgatctcctgacctcgtgatccacccacctcagcctcccaaagtgctgggattacaggtgtgagccactgcgctcggccgatcatctctttttacagactagacatccttaatcacaagtatcttttttttttttttttttttttttaagacagagtctcgctcttgtcgcccaggctggagtgcagtggtgcaatattggctcactgcaacctccgtcttccaggttcaagctattctcttgcctcagcctcctgaatagctgggatttcaggtgcatgccaccacacccagctaatttttgtatttttagcagagatggggtttcaccatgttggccaggctggtctctcaatcctaacctttggtgatccacccgcctcggcccccaaagtgctgggattacaggcgtgggccaccgcacccagccaatcacaagtatctttataggacatctttattttttacagaaaataaagtactagcagagtacttggccttcagtcgttatttctttagcccattagtaatgaataaagaggtttcgctagcaagaatgaaagaaaggactaagagaagctctactattttctgaaaggtgataaaacatacaatcagataaatttccttttaaaaagactttcaaataaatctttagaacctgcaaaccctcccacaaagaaaatgtaaacactgaaaggtaggaggcaattttactttatatttctagtatcaccacagcttttcattcaaacaaacattgccatgaagttagggaaattcctgctgcattcacttgttactttttttttttttttcagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaaagcagatttctctggtattatattatatccttcttaaaaaccagagtttttaagtaacagtatttgaatggcatcaaaacattttcattttaatgtatttctttaacaagtggttaaaaaaagtgtccaagcagccgggcgcagtggctcacacctgtaatcccagcactttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcactgagctgaggtcatgccattgtactccagcctgggcaacaagagcaaaactccgtctcaaaaaaaaaaaaaaaaaaaaaaaagtccaagcaatgtgacatccgtatttcacaatatttctggtgtatcagttttgtatgttacatttccattttgggattctgctttatgatactttactttcttacattttgcatttttgttctgtaaaagatcactgccaataaactgcaaaagaccaataaattgcatatcttcagaaggatttcacattttaaatcgtgcctttaaaactgctttttccccccacatagaatccattttagagttagaaaagtgttctttccaagtgttaatagtttgtcttgcagatggtaccattttatgtcaccaatatttaatatgagaaaaaacaacctgtttaaaaaccttgttttgtatatcagttatgaaaatatctggtagttggaaatctctttaatattcattttaaaagaggaaagggcatcttttccggggggaagctatattttattaatcagaaaaatactaaacaaatgtgtttgtagggaatattgagagtgaaaaacaattgttgaatgggacataagccaaaaagacaatgctttttattatttacagaacgtaattctttagaagagaaaaaaaatacataaatcattcatttgttcacctagcctggcactgtgcttggtgctggagatacagtagtgaataaaatagccagtgccttgtagagttttgtgcctgtctactaggaaagacaggagattatacagtaattatataagatgcaaattgtgatatgccatgaagaaacgtatagcattcagagggacataacacaacacaagacataccacataaaactgattttttttaagatggtctcactctgttgcccaggctggagtgcagtggagcgatcatagctcagtgcagtgtcgaattcctgttcttaagcgatcttcctgcctcagcctcctagtagctaggattacaggcatgtgccaccatacccagcatgtttttgtatttttttagagacagagtcttacaatgttacccagactggtctcaaactcctggcctcaggtgatcctcccactgggccataaacttgattttaacgtgggaaatgggaaagcgtatctcaggacatttttgaaagcaagttgattaagaaagtaaagaaacagaatggctactccatagagcagcctctgaggacatttatagcttttgcagtgacatggttgtctaagtgaatgatggtgatggtcataaaagtggagagaaggggatagagtccaggtgaagtctgacaggatgtagtcatggtttggaagcggaaagtgaggaagaagaaagggcttctggcaaaaaaggctttagcctttatgcatgcaggatccctggggggaaagagtgagttcaggagcatggcttttagacttaccaggtttacaaggcagttgtatctatggaactaaaaaatataaattttgaagttgtatacagaaatggtacttagagccatagaatgaatgaaattgcttaaggaaaatgtagtgtgagataaagatctgaggaactccaacatttagggctgactagatcagggtagctggcaaaggggactgcggagttggcagtgaggctggaggaaaacctggcaaaagggactgaggagttgacagggtaatgtcaaagttgtccacaggaatctccaggttgaggtagtcaaatgaacacttagatgaatactgaaaagtccagtggatctagcaatatgaatgtcacccgtgaccttagcaaaagcacttttgctggaataatggggaaaagccattttggagtacgttgaaacaatgaatgggaagtgagaaagtagatactggatgtatagcagtttttccaagaagcttggctcagaagggtagcagacaggatgacaagtggaaagagaaatgaggtcactggaggattgttaaagagtacagcatgtttgagtgtcacttgaaaggttccagtggagaagctgaagaagtaggtaaaggtaagaataaccaagggacagaagtcctggagcagggaggagggaatgggattctttaaaacctcttcatcaagaaactaggaaaaaaaaccaaagttgtaccatctcagatttcagagaaagggaatttagaaggaagtaatataagcaaagagcaacaatattctgtgactgtttttaataataactaggaaaattcctagtgcagttaactctgaacaaaattcattcccacctgcataatacaagatagacttactcagagtgaccttggtaaaaggtgtgataataaagaaaggaggtgtcattatgtcttcattgtagctttatatgaagccctggtcatttaccgtatcagcatcagcaaactgaacactgaatgattcttactccaagaggcaagtcttagtggtttctattttaactgaaggagagattaatttctgtgcaaggttgaaaaaggtgaccacaaattctttgggcttctttcatcaagaggtgaagtccattaccccacgccttaactctgggctggctttgttgttgttttggccaatagaatatggctgaggcgctgcttccaagattaggcctgaattgagatgccctagcagccaggcagcacctgccagagcatgaataaggctatcttggaccgcccagcgtagccaacctgtgctgaatgaagccacatgaatatgcccaggagaaactagcagaagaatcacccaccttgcccacgttagagatataaaccactatttgaggcagtttgttatgcagcaaaacttagccgaaactattaccttgctaccttgactgctggtgtaatttcccatctcatggagtcacagagttttcttgccaactgcagtgagttggcaaatgggaatgatcagtagcctcagtgtgttttctgatccactccatcctgtattatcatctgcgaataccgtttttcctttaaatgcaatgtgtctttcaaagctgacttgaatttctcacctttcgagttacctgccatttggactcacttatttggaggagatatgtaaagacccagcgtaatacctgtatgctcaataaaaagtatttgctggtactccttcctgcccgtcgtgtgacctgactgctctgggcttctgggggctccccctaaactcgctccacgaaatgacccctccaacctggcacgcccgctctcctaccttcgcccagggctggccgttatctctgtgct

SEQ ID NO: 1912 - DNA, 11768 bp, Homo sapiens
attagtagaaatataaaagtttattgttaaattcatacattataaaagtgatcttttaaaaaaaatccaatattcacttaaagtagacataatacaaattaggctaccacccatcatatattttttgtatgcttcttatgaaaaatgtctactgttgtttcatgacatggtcttaaatcaaaatcacaatatccaagggaaaaacgactctaagaagagaagaaaagagtatcattaaaaatgatacaaaaacagtgctacacatttactcataagattatatcctacctgtggtttcttaaaataatcaagtccccttccaatcttaatcatccatccattgttgaacctgttgaaattagtatatagtattatattcaagacatttaagtcagactattaataaagctgtagtgtattaagtgtcagcaaaatttccccctaacaaagcaaaccacttcctccagtggcatgagttgaatcaaacctggggttcattatgagctgtgtccacaatgaaaacagtcatagaaacaatcagttgatttaattatctgatagtttaatcttgaatttcagcttgttgataaaactttttcgtgttctgctaacaagtggtggcaaagtgtattcagggaaactggtggtgtttcaagagttcccctacctagagatggggaatgtgcaggaggagccctggaccctgacctctgctttaactacagcagctgcattttcatctgttttgcatatttagtttgtgattaagtttttattaaaactgagtgcccttgctataaacataaccactgtgctaaacaaaaggaagatatcactaaaataactgcatattctgttttcttatagactcagcaaattgtcatgcctactagaatatttaataacccctaagaagtaaagccacattaagtaaatattaagttcactagaaaataaattatcctaatatcataacactatatatacagttgagtagacagaaaagtgttctctttttctatatgacacagaacatgtaaatactattccattaggaaatattaaactcacacacaaaacacttggcttactttgtcaaaaagaaagccaagtgttttttttcttctcaaaagtgaaaaagtactaaatggagttttatttgaattttaaatatttataaattattaaatatttataggcaattatataaaacatttacaaaaattttaagtatatatcaactgcataaaaattaaaacattattgtagactaacctaatttctcggtcatgtattgaagaagagtattgaacttccaacagcactccgtgactcctgagtgactcttctatttcttgcaggcctctactttgctgcacttgctcaatgccctgttaatagcaaaaatacgattatctgccgcagttattattactatcttaaattatccctaagctatacaatctatatcacaggtggattaagatggaaatgttctatactagtttcaatgtctattatctcaaaaaaacaaccaatgtgaggtagtttaaagagcaattatttttatcaaaatcatctttttttctaatgtgaacataactccatcctgtctccttaaatgtagtttagaatagttttaatcatccaggtggagctgactgcttttgaaatcaatcgtagaaatcataattatttagaagcattcttattttaagtcaaaaccaagatagagatgcccactaccatatcatatcatgctaccatcccccagatataataattggtaaagaaacaaaattgttcatagtgcagacagtgtgattgcctcctagaatatccaagagactaaactaacaaactatttgaataagtgcatttagcaaagtggccaaatacaaaatcagcatcctaaaatcaataactttttttatgacatgttatgcatactgttagataataagttaattcccaaggaaacaaatctagctgaagcactgcatctgtgttctccttgactggactacatcttgtaactgaataaagttaataagaaagagtaagtgctttcaggtacctacttcatccagagaggtgagaaggtgaatagtttttactttacatggtctcttaataagcatctcacaaaatcgaagaaagttatacagctaaaagacattagaatggattattactaatttagtacattgaatatgatatttcattatattttagtatgttcacatacctgatgagtatgtctaatataaggatcttctatccaaacttctgtaactgtctcattaaggtattcgcgaaaaagtgactcataactgaaacctgttgcattctcttctattttaatttgcttgtgatattttccatctataaaacacaggcttcaacagtaaaaccagtgaccattttttttttacacattttatattttatatagagtgattaatcagcatcagatacatattaatttttttaacttattcagcaaatacttattgaatgcctactaaatatcatatacattgcaggatgttacacgtacaaaggtatttaaggcaaaccactccattagtgatttctgccttcacagaggctaggcaagggggaaaatctagaggtttcctggaacaggtccttgagcaagatcctatagaccaggcagtttgttgaagggagtagtgtatatataaaggtatccaataactccctgtcgccatgggtagcaccacatactgaaactcagtggctatctggtcctcctcttcagacttgtctttttatgtcttgcaatctaataactaaagtgagtattaaacatgaatgcagggcagagcgcggtagctcacgcctgtaatcccagcattttgggaggccaaggtaggtagatcatttgaggtcaggagttcgagaccagcctggccaacatggtgaaaccccagctctactaaaaatataaaaagtagccaggcatgatgtcaggtgcctgtagtcccaactacctggggggctgaggcaggagaatcacttgaacccaggtggatgttgcagtgagctgagatcatgccaccgcactccagcctgggcaacagagcaagactctgccttaaaaaaaaaaaaaaaaattaatgcagtataatatgaagcttcaaagtctttcttggcacgtgtacagttttaaacagaaatttatagtacttcttaataagctaaagactgggatgtcacaggatcaagaggatagatctattgcttttgttcattcaaaatgaatattgaaaaagttatcagaaacctttaaggttttaaaaaaatatgacccctggctgggcatggtggctcacacttgtaatcccagcactttgggaggctgaggcgggaggatcacctgaggtcaggagttagagaccagcctgaccaatatggcaaaacctcaactctactaaaaatacaaaaatgagccaggcttggcggcgggtgcctgtagtcccagctactcgggaggctgggacagaagaattgcttgaacccagcaggcagaggttgcagtaagcagagatcgcgccactgcactccagcctgggcgacacagcgagactccgtctaaaaaaaaaaaaaaaaaccctaatggtagcccctaaattatactttacactttgtttaaaaatcagtagtttggattctgttccaaatatttccacatagataacattggcaactatgccttattttttaagccaagatagccgtatagaggttaatttaattccatgtactcaaaaccacaatgctggaggtactatatttcatcaatgttttggagtaaaatttcattctaaatttcaaatcggggctaaggaaacataactttattcccactgaacaaaggagctcagtggggggtccccagggtatgtactgatacaggatagtaggaagagatggggaaaggggtgtagaaagtatagagaggaagaaaagctggggcctgggggcactggcttttgagggcagcagtacctttggctatagaaagcagcaagtatgcactcaggtaagggtggaaatggccatttacagacatttgtaaactggatgcttaggagtagggaactaataatagggaacaatacctacctgacctctaatcattaggaatgcttaactcctgaggtgttttgattcacaacaaaatctgagagaaatcccaggagtttctttagcttctttcatgattttggtcatttcataaagggaaatataaataaaatacacaatttacattcagtattccctgtagtatttcttaacatagggtccacacataagcttcatagggatttgtgaaccccttaaaaatggcatggaacattctccagtaagtatagctttcatgagatgttcaaaggggtgtctgatattcccacccccaactaaaaacaaaagccaaaacaaacaaacaaacaaaaaattaagaacaactcctgtatgggagtggaaatacagattaaatcctgtaagctcccagggacaactggtccagaccacacagagctccaaagggcaggagccagaaacattgggtgaatggacagtcacagttgtttatggatgcattttctaaaacaacctctttaccttctttttcttggtccaagtacttctttatgttttccgctctgtccatgtatttggaaattttttctctgagattacatctcttagtattatctttggtacctacaaatttaaaaatatatattatcaagtatcaaaatagtttttctatttaatttgggcattattttcagtttctcaagttttctacaaatttcctatcctctagtatggcttgcctcagtcctcaaacacacacaataaactcaaatttggcttgaacatacaagaccttcatatttacacgaagcgtgatgcagcttggtttaggagtgggagctcttgacactatgtctcatctctgggacatcaaatctggtgggatgaaaggtggctcattacatgtcaaactcatgtctgagcactattttatcctaactacccacaagtttgaaatttttgcataattaaaagtagcaaaaaatatttatcttccacaaaaccagctactcttccagacctccccattatagttaatgcacatttttccagctaccacaaaaatgttatttttgaatatacatgatcataaagttttacccaaccacccctcctcccaaatcagtcaacaaatcacttcttgttccttcccttttttcctttcaacatcgcttatattttccataaataatctcattttttgtttgtttgttttgagacggaatctcgctctgtcgcccaggctggagtgcagtggcatgatctcggctctctgcaacctccacctcccgggttcaagcaattctcctgtcttagactcctgagtagctgggactacaggcgcccaccactatgcctggctagtttttgtatttttagtagagactgggtttcaccatgttggtcaggctggtctcgaactcctgacctcaagtgatcctcctgcctcggcctcccaaagtgctgggattacaggcgtgagccaccgtgcccggcccatttttgtatttttagtagagacggcgtttcaccatattggttaggctggtctccgactcctgatctcaggtgatccgcccacctcggcctcccaaagtgctgggattacaggcgtgagccacactgcccagccaataatttcattttaatctctcattttaaaaaacattttgagttaattttttatatttacagaaaagttgcaaaaatggtacagataacctccttcacctagattctcttaatgttaacatatcacaaaccatactacaagtatcagagctaggaaattaacactgaaacaatactatgaacttatctacaaaccttatttgaatttcaccaattttcccactaatgaaagtttgctttctggtccaggatcccatattgcatttagttatgtgtccttagtctcctccaatctgtgttagttccttaatctttctctgccttctatgtccttgacatttaggaataatattggtcagttatttttgcagaatgtctctcattttggacagtctgatgttttctcatcattagacttggtttatgcatttttggcaagaaaatcacagaagtgatgtgccttgctcagtgggtacatgatgttgatgtgtcttactgctgatgatattaactgaccatttggtaaaggtgtagttcagatttctccactgtaaaatcactattttctcttttgtaatttgtaagtaccttatggaaagatatcctgcttcccatcactctttctcccactaattttagcatctgttgatggtccttgcctgcaacaactatgactgtgatgtttgcaaaatggtggttttctatttccgtcattccttctcaatctatttattcaattaaatagtatgggctcagggatatttattttactctatgagttataatccaatactatcattttcctgctcaaattttatcagctttggctttgacatctccttcatgttagttcctgtgtccttttgtcaagcccgcatcgctattatgtccttacattttgattcaggatttttttgtttcattttgtttcgctgagacacagtctggctctgtcgcccaggctggagtgcagtgacatgatctcggctcactgcaacctctgcctcccaggcacaaggaatcctcccacctcagcctcccaagtagctgagactacaggcacacattactatgcctggctagtttttgtatttcttttctattttctgtagagatggggtatcaccatgttgcccaggctagtctcgaactcctgggctcaggcaatccgcctgccttggccttccgaagtgctgggattacaggcatgagccaccatgcacagccacaagatgttttaaaccaaatttgtccaactcttgcatgtggcccaggacagctctgaatgaggcccaacacaaattcataaactttttttttttttttgagacggagtctcgctgtgttgcccaggctggaggcgcaatctcggcttactgcaacctccgcctcccaggttcaagcgattctcctgcctcagcctccggagtagctgggattataggcgcccgccaccacacccggctaattttttgtatttttagtagagacagggtttcgccatgttggtcaggctggtcttgaactcctgacctcaagcaatccacccgcctggggctcccaaagtgctgggattacaggcgtgagccaccacacctggccattcgtaaactttcttaaaacattatgaggggtgtgtgtatgtgtgcgtgtgtgtgtgcgcgtgtgtgtgtgttttagctcatcagctgtcgttagtgttagtgtattttacatgtaacccaagacaattatttttccaatgtggcccagggaagccaaaagatttgttaaaactcatcttgtttattttttgccccagccctgaaatacccttttccaaggagcctcggtcacttttattgaagaatggcattgagaaaccaaattctgggtgccagctgtgttcattgctgctgggggagtcccaccactacttctagaccctctcagtcaatacagctaggaggtatatgtaggcttactaacacatacatctatatatacatacatctatatgtatttgtttctgtccatctatataaatattaaaaaccatgagttcatgctgataactttgattccacagagctcattctagctttcccccatccctctcctgcccaaataaaagcaaaacacaacctttcctcaaccttgctagactttaaattatgtagtagttcagtcttagtcattgtccttgatcagctggcagtgtctcacacatagacccatccttcaatcattacgctacagtttctcaggcttggacccttacagccatctttgattcccattaaccttactcccatatctaatcatgtgccagtgccccctccttatcttaatactggtatcatctccctggttcattcaggcccttatcatgcctcatctttttaaaaaggttttattaattttaattggcacataataattatacatattaatggggtacaatgtgatgttttgatacatgtatacattgtgtaatgatcaaatcagggtaattaggatatctgtcatcttaaatatttattgtttctttgtggtaagaacattgaaaatccttcattctagctatgttgaaacatacaacacattattaactctagtcaccctattgtgtaataagacaccagaatttattcctcttatttaactgtaaatttttttttttaagagagggtttcaccatgttggccaggctggtctcgaactcctgacctcaagtgatccacccacctcagtctcccaaagtactgggattgcaggcgtgagccactgcacctggcatctaactgtaattttgtaccctttgaccaacctctccccattcctcctacccactgcccttcccagcttctggtaaccactattctactctctacttctatgatattaacttttttagattccacatatgagttagatcatgtggtatttgtctttctgtgtctggcttatttcacttaacaatttcctacaagtttgtccatgtcacaaatgacaggatttcattttttatggctgaacagtactctactgtatatatgtgccatattttctttattcatctgctgatagacacttgggttgattccctatcttagctattatgaatagtgctgcagtaagcttgggagtacaaatatctcttcaacataatgatttcatttcctttggatatatacccagtagtgggatcaatggatcatatggtagttctctttttaattttttgaggaatctccatactgttttctataatggctatacacacctcttattttgattccagcaggagctccttaattggtctgcttaacttcagtctctacaggttaatgtctactttacatccttgccatattcagtcctttattcaagaaatatttattgagaactaacaacatgcccagcactgttctaagtgctgtggatacagcagttcgtaaaacagacaaaattctcttctattgttcaagtaggaagagaacaataaaaataaattggcaaaacatgtatattagattgaggtaagtgctattaaataaaataatgaaggaggacagggagtgctgggatggggttataattttacactggaggtctgggaaagcctcacaaagaaggtggtatttgtgtaaaggcctgaaataggagagagagtgtgccatgcaaataaatatctgtgagaaaagagcacattcctgaaagagacaagccctgaaatgcaactccaattatgttactcctttgtaaaaaccttaaatggtttctccttgcctgtggaataagttaaaatctcctggtagtcaaggccatcctcaatgtgatccaagcccctatctacctttaaactttacttctcactcttcctcttcagatacatgctcaaccaaactacttatttcgtaagacagcacaggaatttgaagactcttagatgaatttctgacttctgaaattatttttcctccaaagccccaatcaaactccacctctacctttccaccctcacatgacctttaactgtttaaatcctcattgcgtttatctatagatatctctctcctggcacttattccctgtattagcgctatttgcattttggtcttaacccatctatgtgacatcattgtctctgtaacctctacgggatcagtgaagcaccctagagcagaactgtgattctcctgcttcagattcctagtgcagccaaaacttgagcagtgttccacctgaccaacacagtacaccatctctcttttgggattcagtataccagagtcgttggggccttgggctccgactgtgactctaccacctcctagtggcagaacttgaaagcgaacaatactttttatgctgtaaaacgagaataccatcaactcctacttgatagggcaattggtacggatgaaacgagatcatgcttttaatgttttctgcaatgcctggcactcagcactgaaacgtgatatctatgcttattgctgttgtcactgtcatcattatcatcaaataatgccccaggcaaggtagagtttacagttattttttcttttttttgagacggagtcttgttctattggcagactggagtgcagtggcgcgatctcggctcactgcaacctccgcctcccggattcaagcaattctcctgcctcagcctcccaagtggctgggactacaggtgcgtgccaccatgcccggctaatttttgtattttcagtagagacggggtttcaccatgttggccaggatggtctcgatctcttgacctcatgatccacctgcctcggcctcccaaaaaagtgctgggattacaggagtgagccaccgcgcccggccggtagagtttgtagttctgaccaaagcaccaaaccataaagggctcccctctgctgccccaaagcttctgtaacactttaattataagaagcttaaactagaaagaacagagggagcttagtccagaccgggagtgtcgggggttggggagcaggagctgatcttatcaatttaatacataaatattgagtgtctactgtgagccagggttgtgctgggtgttaaggaatatttgggtatttctcaacattgaataatacgaaaagtctcacttgtctcctccacaaccctgcgcatttctcacaccgaacctcatccgtttaagaaaaacttttcttcttctaccgctacataattttactttggcttgctttaaatgcaaatgtttaaacagaaaattaaaaataatcgtataataaacacccttattacccatcaccgaaatttttaaaattagcatttttgctcaaatagagcttcgatttttaagaaatttttgcttaaggaaaattaactaaagacatcatagcatctctttctaaaacactttggtctgcatctctaaaaattaaggaaagttttggaaaaaaaatcatattgcctaagaaaataattttaatgccccccaatctatattcaaacttttctaatagatccaaaaatgtcttttaaagttcgtacaaacccaggtcctatcaaagcttatatattacattgcgttatatcttatatctcttaagtcttttaaaatctagactagtagcctccccaccttttctaggtaacatcaatctattaaagatctaaaagaaagcggcccagttgtcctatagaatatcccaccttctgtatttaactgcttcttcgtggtgtggaaaaatcatttttaactctttcacttcaccccagacacagcaggaaccagctccttttcctcaggtcctccccgccttggctcattgctcacctttcagaacctgcaggagcagatcaatcccctcttggtaacacaccagagcctgcggataccgcgactccgaatctagttctactgcccgctttagcacagtggctgcagctgtgctctgcgggtcctgcctcagcccggacttcgccataattctggaagttctcctccgcctcaacccaggatgaagttgagcggg

SEQ ID NO: 1913 - DNA, 8197 bp, Homo sapiens
cagcatcgcgcgcaaggcctgccggttgctcggggtcgtatgacgcacttttccagctcgagccctcacgaggccgtgggtacgaccggaagccgcaggtgggtgaagcggaaacgcttcaaaccgggatgttgcgggccgtagcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgagtaagttgtatatcattagagaggggacaaaataatagggtcttggcgaggtcttatgaagaagctgcgcctgcctagaaagatagatgggattgtgctgttttcgctttcagttcagtgatggggagccgtgtttggcagtgcagaggtagcgaagtgtcccaagaacatggaaggtaaggaagtcttccgaggaaaaacttcaaaaaattagtcattaaagggtgagagtagaaagattcaaagtgattttgaaggaacaaaatttaaccagaacttcaaaggcttgacactatcccaacgactgtgaaatatcctgaaataccgtgcattactcagtcggggtctgatccgctactggagcatagaataaaaaaagaggggcacacctgtgccagatgaatccacgccttctctaggggagagagggtatcccggcttaagagcaggggctctcctgagttaaggaagtgtcttccccagagcccattccgtcagacgttcatatcatgtaactcagtccttttctgattatgtattcaccaagcaaacttaagagttggcttgtcaccagacctacagtgaataattgcacaggctcatctgaatatctgatagatggtctatagttctctttgtaaatcaataagctggcagtcagggatttttggacatccctttgttttcactttttctcactctgtgtgattttttcttatctttcggggttcaactgaaatgtcacatcctcactgaggtctgtttattggtttacgtgttcaggtgcttagaacagcttcttgcatcttttctcacatgatgcctttttaatgaggcttagcctaacaaccctatttaaaattgcaatgtaagttttctcacatacacagttacaatcctccctttatcagctctacatttttttttaatagactgaatctcgctctgttgcccagcccatctcggcccactgaaacctccacctcccgggttcaagcgattctcctgcctcagcctcccgagtagctgagattacaggcgcctgccaccacgcccaggtaatttttgtatttttggtagagacggggtttcaccatgttggccaggctggtctcaaactcctgacctcaggtgatctgtccaccttggcctcccaaagtgctgggattacaggtgtgaaccacctcgcccggccatctactttttttaatagccctccttatcacctttattcatttgactcactgatgattcccaagtgctaagaacaatgtctgtcatgtaattgatgaaaactttgttgaattaatacctttgttgtgttttattcacactgtatatacaatacctggatgaagagagatatttttagcactattaaaatacatgcattggctcaatacatgaattggatcaattctggaaccctaacaagatcacatttttgaccaaagtcaatatcttggactatagttaatttatcaaggtaaatgccactttgatgtgtcttggttaggaatctttgttcacttgagggaatacatggtatatgataggaacagtaagcacagaatagagatgggaaagggagaaccctgtcataacagttaacatttcatatttgccaaacatgaatggcttatgcatattaacacatttaattctctcaaccattttatgacgtctgaggccactgaagcagctagaggttaaaccacttccctaaagtcattagtaagtggcagagccaggattaaaaatttaagtccttaactactttgccatcctgccacactctgcacatgcagacaagagtaagagccttaatcttgggaaaagatatttcacaagatctttgacaatttccatatccacagacaccatccagcttattagtgaccaccactcctatttgttactttctcctttaaggctgcccctacctgaactctggatcccagtaccatcactttctcaaggacctcccttctccagtgttgccctctcttgactcccctaccagcatctaaacatgctcagatctattgcatcttaagtcctctcctaactccacattcctttctacctactgccctagcttttccacttcacaactagaataccctcattgtatccaccttgggcctcctatttactcagtacatctggttcttaccaagatcactgataaccttcttgatactgtttaatagatccttttcaaccctcatcttatttgctcaatctttggcatttggcactgttgaccatcttgtctccttgaagcttccataatagcatatttaaaatttttctgccttttcttctatcctcagcttcctttgggagctctccctccttcttctgtatgtccgttaaatgttgctgctcttcagtcttatgtcgcaggcccttaaatcttctcactgaaccaccttcctgtggcctcagttaccatccattgagctctgtgccgttggccgctagttcaacagtcaaaatgaaccaattatcttaaccccatacttcctcttcctataaaatctgtcctaggaaatttcacctctttgccaggccagaaatcagggcataatattaataaaatagttagcacatattgtgtactttcttcagtgccaggcactcttctaaccactttatatgtattagctcatcagactcagcctgataatatgagatgagtcctgtcattatccacatattagataacaaatctgagacatagaaaagtaatctgccttaggtcattcaactgataaaggatagagttgggatttgaatgagggcactctggtttgagcttgtaatcattatatcataaaggacatgatgcttgacttctctttctctcaccctaattcaacctattgccaagtattgtacattctccatgcttaaaatctctaggcggtgtccctgaagtataaatccaaagccttcatgcctgtaatccgagtgctttaggaggccaaggcaggaggactgcttgagcccaggagtttgagaccagcctggacaacaaagtgagattcatctctacaaaaaaaaaaaaaaaaaaaaaatagccaggcgtggtggcacatgctggctaaagggggaggattgcttgagcccaggaggtcggggctgcagtgagccgtgatcacaccactgcactccatcctgggcaataaagttcaagcatttcacttggatttaaggttctttataatctaacatctacttctcttgccttcttattaactccccattcttgtattcctaataaccagccagtagaattaaattatttgcatgggtcctatctccttttccactaagctgttgcacattgttagaattcttttctttatcccttttatgtctcagcttcaatgtcacatccactaattagagcattagatggcgctctactgtacttaacacctatcacagcatttaggacactgtattttaattattgccttacttgttttttagtatctcccactagattgtggaggtacttgtttcttgaaggcaaggacaggttcaccttcttttctttttttttcttttagacggagtcttgctctgtcgcccaggctggagtgtagtggcacgatctcggctcactgcaagctccgcctcccgggttcacaccactcttctgcctcagcctccagagctgctgggactacaggcgcccgccaccatgcccggctaattttttgtatttttagtagagacggggtttcactgtgttagccaggatggtctcaatctcctgacctcgtgatccgcctgcctcggcctcccagagctgctggtactacaggcacctgccaccatgcccggctaattttttgtatttttagtagagacggggtttcactgtgttagccaggatggtctcgatctcctgacctcgtgatccgcctgcctcggcctcccagagtcctgggattacaggcatgagccactgcgcccggccagttcaccttcttaatgtcactcatatccatccccttctctctctctctctctcctaccgtactttaggccctcattatctctagcatggacaactgccttagtccattaactgttccccctgtccctagtccatcctttatttaatccatactcaaccctgcagaggcagattcgtataacagctgagttaacacttcctgcttaacacttcagtggatcttagctgccttttaaaaagtccaaatattttggttcattacatgaatttatctcctcccattttctatctccttattaccttgtacctagtaggaactccataaatacttgttgaatgaatatggtactgtgtcaaagtcagtcaagcagaaccaagaacaaagaggttaaccaaagtaatgcagtctcggttgcgaggcttcctaggacagtatagccataggcttaagtggaagtcgaagactagtagtgtaactctttctcttaggagggaatccccaaacataccttactattagatgactctttgtctttgcatatgcctggaatatgctcctcgacctggcaaacttatcagatttggtgactcagttcaagtattccttcctctattaaacctctccacacctttctagacagaatgtaaactgattcaactttttgtaggttagtttataaactacaacaagagtgatgaaaatatgaagactctttaatctagaattgtacttctaagatattacttaactaaatgatttggggccaggtgtagtggcccatgcctataatcccagcactttgggaggctgaggcaggaggatcactgaagcccaggagttcaagatcaacctaggcaacgtagggagacccccatctctacaaaaaatttaaaaattagccaggcatggtggcgcatacctgtagtcccagctgcttcagaggctgagatgtggagattgcttgagcccaggaggtcgaggctgcagtgagacaattacagagtgataccctgtcttaaaaataaaaaataaaaaagcctagctacctagttatgaactttctttatttagaaccaaactcttaacctcaagttatacactttaataatccattctattcccagttcttcaacctgaaggaaaattatattctaagaaatagaattggaatagaatgatttaagaccataagtaatcaaaatacttcattttcatagctagtattttcaaccttttgctgcctaatatttcattagcaatggtaacatgaataatgtggaaagcatccaaacatagtgaatttattcttagcctttgtatataaacctgcatactcccagttgcctctctctctgacctcaagggttcatcctaagttaatattgatctaaataaaagttatgctgccagtaaatcatatatcccaaagtcaaacaggaaattatttttaaagtgttataaagacataatgaaagctttccacggaaatgttcatgaacacatcgttgataaccagaaaaactagaagccacctaaaattacagactaagagactgagtaaacttgttaacaatggaatattaaacagtcattaaagctgatgcaaaatagatttaatgggccaacgcggtggctcatgcctgtaatcccagcactttgggaggctgaggcgggcagatcacctgaggtcaggagttccaagaccagcatggccaacatggtgaaaccccatgcctactaaaaatacaaaatttagccacacgtggtggcaggcgtctgttatcccagtgaggtaggagaatcgcctgaacctgggaggcggaggttgcggtgagccaagatcacgccacagcattccagcctgggtgacagggcgagactccgtctcaaaaaaaaaaaaaaaaaaaaaaaaaaaaaaaaaaaaaaaaatatatatatatatatatatatatatatatatatatatatatatatagattgaatgtcgaatgaaataatagtatggggagggaaatgtgtgtgcgtatacatgcttagaaataaaatgggtttacaccaaaatgttaattgtgattaggactatcaatgcttttatttttttcttcttgcttgtctgtattttctcatttttctcgatgaacatttgttacttgtgaattcaacataatttggctttaagatataggtaatgtggctgagtgcagtggctcatgcctgtaatcccagcactttgggaggccaaggtgggaggactgcttgagcccaggagtttgagaccagcctgggcaacatggtgaaatcctgtctgtaagagaaaaaaaaaagatatattacataatgtatttgcagcagacttattgtttgaaaactgtgaaattatttcaactgaaattatttgaaatttgtcttcatttatttcttttgaatacttggttatagcattgctaaagactaattgtaaagctaaaagccaaaagcaactgcactggatactttaagtttggattaaataaccgataattgatagttagaaaatagaatttaatgttccttttctcgatgaattaatttgtttgtcttccatttttaaaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaa

SEQ ID NO: 1914 - DNA, 8197 bp, Homo sapiens; identical to SEQ ID NO: 1913

SEQ ID NO: 1915 - DNA, 8197 bp, Homo sapiens; identical to SEQ ID NO: 1913

SEQ ID NO: 1916 - DNA, 8078 bp, Homo sapiens
caaaccgggatgttgcgggccgtagcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgagtaagttgtatatcattagagaggggacaaaataatagggtcttggcgaggtcttatgaagaagctgcgcctgcctagaaagatagatgggattgtgctgttttcgctttcagttcagtgatggggagccgtgtttggcagtgcagaggtagcgaagtgtcccaagaacatggaaggtaaggaagtcttccgaggaaaaacttcaaaaaattagtcattaaagggtgagagtagaaagattcaaagtgattttgaaggaacaaaatttaaccagaacttcaaaggcttgacactatcccaacgactgtgaaatatcctgaaataccgtgcattactcagtcggggtctgatccgctactggagcatagaataaaaaaagaggggcacacctgtgccagatgaatccacgccttctctaggggagagagggtatcccggcttaagagcaggggctctcctgagttaaggaagtgtcttccccagagcccattccgtcagacgttcatatcatgtaactcagtccttttctgattatgtattcaccaagcaaacttaagagttggcttgtcaccagacctacagtgaataattgcacaggctcatctgaatatctgatagatggtctatagttctctttgtaaatcaataagctggcagtcagggatttttggacatccctttgttttcactttttctcactctgtgtgattttttcttatctttcggggttcaactgaaatgtcacatcctcactgaggtctgtttattggtttacgtgttcaggtgcttagaacagcttcttgcatcttttctcacatgatgcctttttaatgaggcttagcctaacaaccctatttaaaattgcaatgtaagttttctcacatacacagttacaatcctccctttatcagctctacatttttttttaatagactgaatctcgctctgttgcccagcccatctcggcccactgaaacctccacctcccgggttcaagcgattctcctgcctcagcctcccgagtagctgagattacaggcgcctgccaccacgcccaggtaatttttgtatttttggtagagacggggtttcaccatgttggccaggctggtctcaaactcctgacctcaggtgatctgtccaccttggcctcccaaagtgctgggattacaggtgtgaaccacctcgcccggccatctactttttttaatagccctccttatcacctttattcatttgactcactgatgattcccaagtgctaagaacaatgtctgtcatgtaattgatgaaaactttgttgaattaatacctttgttgtgttttattcacactgtatatacaatacctggatgaagagagatatttttagcactattaaaatacatgcattggctcaatacatgaattggatcaattctggaaccctaacaagatcacatttttgaccaaagtcaatatcttggactatagttaatttatcaaggtaaatgccactttgatgtgtcttggttaggaatctttgttcacttgagggaatacatggtatatgataggaacagtaagcacagaatagagatgggaaagggagaaccctgtcataacagttaacatttcatatttgccaaacatgaatggcttatgcatattaacacatttaattctctcaaccattttatgacgtctgaggccactgaagcagctagaggttaaaccacttccctaaagtcattagtaagtggcagagccaggattaaaaatttaagtccttaactactttgccatcctgccacactctgcacatgcagacaagagtaagagccttaatcttgggaaaagatatttcacaagatctttgacaatttccatatccacagacaccatccagcttattagtgaccaccactcctatttgttactttctcctttaaggctgcccctacctgaactctggatcccagtaccatcactttctcaaggacctcccttctccagtgttgccctctcttgactcccctaccagcatctaaacatgctcagatctattgcatcttaagtcctctcctaactccacattcctttctacctactgccctagcttttccacttcacaactagaataccctcattgtatccaccttgggcctcctatttactcagtacatctggttcttaccaagatcactgataaccttcttgatactgtttaatagatccttttcaaccctcatcttatttgctcaatctttggcatttggcactgttgaccatcttgtctccttgaagcttccataatagcatatttaaaatttttctgccttttcttctatcctcagcttcctttgggagctctccctccttcttctgtatgtccgttaaatgttgctgctcttcagtcttatgtcgcaggcccttaaatcttctcactgaaccaccttcctgtggcctcagttaccatccattgagctctgtgccgttggccgctagttcaacagtcaaaatgaaccaattatcttaaccccatacttcctcttcctataaaatctgtcctaggaaatttcacctctttgccaggccagaaatcagggcataatattaataaaatagttagcacatattgtgtactttcttcagtgccaggcactcttctaaccactttatatgtattagctcatcagactcagcctgataatatgagatgagtcctgtcattatccacatattagataacaaatctgagacatagaaaagtaatctgccttaggtcattcaactgataaaggatagagttgggatttgaatgagggcactctggtttgagcttgtaatcattatatcataaaggacatgatgcttgacttctctttctctcaccctaattcaacctattgccaagtattgtacattctccatgcttaaaatctctaggcggtgtccctgaagtataaatccaaagccttcatgcctgtaatccgagtgctttaggaggccaaggcaggaggactgcttgagcccaggagtttgagaccagcctggacaacaaagtgagattcatctctacaaaaaaaaaaaaaaaaaaaaaatagccaggcgtggtggcacatgctggctaaagggggaggattgcttgagcccaggaggtcggggctgcagtgagccgtgatcacaccactgcactccatcctgggcaataaagttcaagcatttcacttggatttaaggttctttataatctaacatctacttctcttgccttcttattaactccccattcttgtattcctaataaccagccagtagaattaaattatttgcatgggtcctatctccttttccactaagctgttgcacattgttagaattcttttctttatcccttttatgtctcagcttcaatgtcacatccactaattagagcattagatggcgctctactgtacttaacacctatcacagcatttaggacactgtattttaattattgccttacttgttttttagtatctcccactagattgtggaggtacttgtttcttgaaggcaaggacaggttcaccttcttttctttttttttcttttagacggagtcttgctctgtcgcccaggctggagtgtagtggcacgatctcggctcactgcaagctccgcctcccgggttcacaccactcttctgcctcagcctccagagctgctgggactacaggcgcccgccaccatgcccggctaattttttgtatttttagtagagacggggtttcactgtgttagccaggatggtctcaatctcctgacctcgtgatccgcctgcctcggcctcccagagctgctggtactacaggcacctgccaccatgcccggctaattttttgtatttttagtagagacggggtttcactgtgttagccaggatggtctcgatctcctgacctcgtgatccgcctgcctcggcctcccagagtcctgggattacaggcatgagccactgcgcccggccagttcaccttcttaatgtcactcatatccatccccttctctctctctctctctcctaccgtactttaggccctcattatctctagcatggacaactgccttagtccattaactgttccccctgtccctagtccatcctttatttaatccatactcaaccctgcagaggcagattcgtataacagctgagttaacacttcctgcttaacacttcagtggatcttagctgccttttaaaaagtccaaatattttggttcattacatgaatttatctcctcccattttctatctccttattaccttgtacctagtaggaactccataaatacttgttgaatgaatatggtactgtgtcaaagtcagtcaagcagaaccaagaacaaagaggttaaccaaagtaatgcagtctcggttgcgaggcttcctaggacagtatagccataggcttaagtggaagtcgaagactagtagtgtaactctttctcttaggagggaatccccaaacataccttactattagatgactctttgtctttgcatatgcctggaatatgctcctcgacctggcaaacttatcagatttggtgactcagttcaagtattccttcctctattaaacctctccacacctttctagacagaatgtaaactgattcaactttttgtaggttagtttataaactacaacaagagtgatgaaaatatgaagactctttaatctagaattgtacttctaagatattacttaactaaatgatttggggccaggtgtagtggcccatgcctataatcccagcactttgggaggctgaggcaggaggatcactgaagcccaggagttcaagatcaacctaggcaacgtagggagacccccatctctacaaaaaatttaaaaattagccaggcatggtggcgcatacctgtagtcccagctgcttcagaggctgagatgtggagattgcttgagcccaggaggtcgaggctgcagtgagacaattacagagtgataccctgtcttaaaaataaaaaataaaaaagcctagctacctagttatgaactttctttatttagaaccaaactcttaacctcaagttatacactttaataatccattctattcccagttcttcaacctgaaggaaaattatattctaagaaatagaattggaatagaatgatttaagaccataagtaatcaaaatacttcattttcatagctagtattttcaaccttttgctgcctaatatttcattagcaatggtaacatgaataatgtggaaagcatccaaacatagtgaatttattcttagcctttgtatataaacctgcatactcccagttgcctctctctctgacctcaagggttcatcctaagttaatattgatctaaataaaagttatgctgccagtaaatcatatatcccaaagtcaaacaggaaattatttttaaagtgttataaagacataatgaaagctttccacggaaatgttcatgaacacatcgttgataaccagaaaaactagaagccacctaaaattacagactaagagactgagtaaacttgttaacaatggaatattaaacagtcattaaagctgatgcaaaatagatttaatgggccaacgcggtggctcatgcctgtaatcccagcactttgggaggctgaggcgggcagatcacctgaggtcaggagttccaagaccagcatggccaacatggtgaaaccccatgcctactaaaaatacaaaatttagccacacgtggtggcaggcgtctgttatcccagtgaggtaggagaatcgcctgaacctgggaggcggaggttgcggtgagccaagatcacgccacagcattccagcctgggtgacagggcgagactccgtctcaaaaaaaaaaaaaaaaaaaaaaaaaaaaaaaaaaaaaaaaatatatatatatatatatatatatatatatatatatatatatatatagattgaatgtcgaatgaaataatagtatggggagggaaatgtgtgtgcgtatacatgcttagaaataaaatgggtttacaccaaaatgttaattgtgattaggactatcaatgcttttatttttttcttcttgcttgtctgtattttctcatttttctcgatgaacatttgttacttgtgaattcaacataatttggctttaagatataggtaatgtggctgagtgcagtggctcatgcctgtaatcccagcactttgggaggccaaggtgggaggactgcttgagcccaggagtttgagaccagcctgggcaacatggtgaaatcctgtctgtaagagaaaaaaaaaagatatattacataatgtatttgcagcagacttattgtttgaaaactgtgaaattatttcaactgaaattatttgaaatttgtcttcatttatttcttttgaatacttggttatagcattgctaaagactaattgtaaagctaaaagccaaaagcaactgcactggatactttaagtttggattaaataaccgataattgatagttagaaaatagaatttaatgttccttttctcgatgaattaatttgtttgtcttccatttttaaaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaa

SEQ ID NO: 1917 - DNA, 18480 bp, Homo sapiens
tctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccggtgagtggggaatgagtggcggagagtgcggcattcttcgcaaggtgtatccgggaaccctctgcagatcctaattgattttccctattgcgtactgaattggccggttacggcaacctaaatgggtctgcccctgatcccgtcacattggctcccgtaaggccattggcctgcaggatccccccgtttcccaatttgcaggatccagggccacgcggctttttgtgcccagactcttggagctcaagaacggagccgccgaggctggacagcttgggaaagggaacccaagcagcattttctgtgctgctgctttattcataacttagggttgccactgggtattaaggttgcttttttttttttttaatgaagacagaaaattgcctttatctttgtattgcttcattttataatgcaaacatccaagagttggcagttagaatatttgccattttattaaaactgtgatttgttaccattttgatcgagacctaccaaaagctgtttgttctgccctttttgccaagaggcagtaatgagggctgcctactgcttgttaggcactaggagttcagagaagagacacgcttccagctttcagagatctctggtatctctgcaagagtgattccatgttttgcatttcagaagtgtttttccccctttaataattgtatacattgtcggtttagaaaaagaaatcgatttttaacattcctgttgcatgcatgctcattgtaaaaagacaaaagaactatcggtcgctgggggggagaagggggaggaaaaacgccttttttcatacccccaggggtatgttaacgtttttctgacaaccttccagagtttttctgtgattacacacgttcacagacatttaaaaaaatagaaatgggatcatacttctcctgtgatgcctgatattttcctgttttacagaagacagcgtaattgtttcagggtccaggagttacgtgcctaattattaacagtaacttttactttattaaaacgtattccttgccgggcgtggtggctcacgcctgtaatctcagcactttcggaggccgaggcgggaggatcacgaggtcaggagatcgagaccatcctggctaacacggtgaaaccccgtctctactaaaaatacaaaaaattagccgggcgtccgggcgggcgcctgtagtcccagctactggggaggccgaggcaggagaatggcgtgaacccgggaggcggagcttgcagtgaacccagatcgtgccactgcactccagcctgggcgacagagcgagactccgtctcaaaaaaataaataagataaaataaacgtattctttgagtcaaacgtggtgacacacacctagctccaattactgggaaaattgaggattgcttgaggctgagttcaataccagaaacatagcgagactctgtctctaaaaacttgtaacttttgactatcacaccttcagaagtctgtaaatatttaaacttcagttattctgcaaaaatatattatatgtctgctatagggcagataccgctttacacagatgtttgggatacttctatgaatataacagacccaaaacaacaaaatctaaaaacccttttcctatggaattagcgtgctattgaatgtacatgcactaaacaacaaaacctaacagataattaagttacgttagaagataagcacgatagaaagcagtgaagaggaattgggagtgttgacagttggggtatgggtgaaaatgttaaatgatgtgatctgggttgacctcattgaaaaggtgagatttgacccaaaaattgaaaaagataaggaaattagccatgtaaatatcaggatcattccaggagagggaatggtcagtcaaagggagcatgcctgcttgactagttctagatcaaacaaggggggcagcatgtctggtgattgagcaagagagtaattggagatggagtcctggaggtggggaaggttggtagtgctgtactacaaagacatgagagggtgagggttaagaattagagttgggggtggtggcccatgcttgtaaccccagcactttgggagcccaggcgggcggatcacctgaggtcaggagttcaagagcagcctagccaacatggtgaaaccccgtctccactaaaaatacaaaaattagctggacgtggtggcaggtgcctctgatcccagctactcagcaggctgaggcaggataatcggttgaacccaggaggcggaggttgcagtgagccaagattgggccactgcactccagcctgggtgacaaagcgagactctgtctcaaaaaaaaaaaaaaaattgattttcactgtgatcaaaatggacaagcattggaggttttaattttttcataaataaactttatttttgaatagttttagattttcaaagaagttgtgaagatggtatggagtttctgtatatgctacactgtttccccctttcatgtttggtatacctgtgtacagttgatgaaccaatattgatacgttattaaagtccatactttatttagatttacttagtttttgccaaatgtccttttgctattccaggatcccatccaggataccacattacatttaatggtcatgacttcttccttaggctcctcttaactgtgacagtttctcagactttccttgtttttgatatcattgacagttttgaggcagttaggtgtttgggaagatactggaagagagtacctacataaattatttggaattcttctgaatgggatatttgttctttctcattaacttattcacctatttatattagtatgaatttagggttatttatttatttattttggtttggattataagccagtaatactttgttacttattttgttgctgaaattgttccagctttgggtacagttgactgcagtgtcactttgacataccccatcgttatgttttttccagtagttcctttctagcattacaaagtgctccagacataatcagccatttctcaaaggagcactggttccttttattaaagaatgcagccaagatctgggcactgggtgtgctccttgccactgagtgctagtgctttaagtcctctcagctaacagagctagcccatgtatatatgcatatctgtaattacttctatatccctcaatagctatattaagctaaacatgagttccatttccaatctagtatataaggatcattgtagccttcccctcttgcttatatgtaacctcccacttcaacagtgagaatcctggctctctggaagatttttgagcagagtgacatgatctaagatttaatgagatgatttattgctgatatacaaaaaagatattaggggaattggaatggaagcagaagtccagttaggattttgttgagatctaagtgatcagaaagattttttaaagtgtgaagctaagtatgttggattaagtacctaaccttgatacgaggaagtctggtaaaataatttagcattagataggttcagttgctgaggaatgtttctgaggtctggctgtcttcaggagatgtcttgcgttgattctcacagttccgttgctttatccacatcacaggaaagacttgcagaacttgaatgagctagaatctgcgggacactgaattacaacacttagcctattttagtgtgttagagcagaggtctccaaaccccaggccttagacccagaccatttgctggcccattaggaaccagatggcacagcaggaggtgagctgtggttgagtgagcattaccacctgagctccaccacctgtcagagcagtccaacattagattctcataggagcgtgaacgctactgtgaactgtgcatgcaagggatctagattgcatgctccttataagaatctaatgcctgatgatctgaggtgaacagtttcatccggaaaccttcccttccacccctccctatctgtggaaaaattgtcttccatgaaactggtccagtgtcagaaaggttggggactgcagttttaagagtattcttattagctttgtagtaatttaataataataaaagctactatttattgagggcttcccacatgccaggtactgttttaggtgctttgtagaataactcatttgcaagacaggtattttctttcttttctgggggaaaaattgtaacgcacgaattaagtaacctgtccgagatatacatgtagttcatgaacttaatctttctgctatcagtataagtcagtatagtaggctacagttgttttgtgtgtaattaaataaatatgacctttttaggttatagaagcaatgcgtgtgcattgagaatagtttaaaaagtacaaacaagcaaaaaaaattctactttttaacagaaaggtgttatgatttagtgaaaatgcacttgcctaggaattaggagaatggggttccagaccacaaactttattgatagctggatgcacttggataagttattgaactttctggaattcatgatcctcattcataaagtaaggatgtgggcagtcagttctaattataggagttggaatttcttcagtcccttctagctctttaattttctgtgattctatggcaaagcattctttatctgccttcattgttgaagaagacactttaaatgatagtaattttgtggaatcaatctaggactgactcatttgatgaaagtgggatgtggctaatgtgtataattactacctgtggttgaataaaacatttataaattaattcgtgcccttattatattaaaataaccaataattttactgttaagtttacaattaatttgctgcttagttttttaatactagagaaggggaaacctgttcatttccaagacatagttgactgatgggtctacttcctacttcccacagcctctaaagagagcaatcactacacttatggctgggattttgcgcttagtagttcaatggcccccaggcagactacaggtaagtgtttcttttcaagaatttgtcttttctaccccttatgaattttttttttaatcattacaaggcaagctaagttcttttttttatttttttgagacgaagtctctctctgtcacccaggctggagtgcagtggcacaatctgggctcactgtagtctctgcctccctgattcaagcaattctcctgcctcagcctcctgagtagctgggactacaggtgtctgccactatgcctggctaatttttgtatttttcatatagtcgggggtttcaccatattggccaggctggtctccaactcctgaccttgtgatccacctgccccggccacccaaaattaagttatttcaccagttccttttcgaaatggtttagatattgagagttaatcttgtttatgtatggtttttctgctgttttatccctaaagatctagaatcaaaaaagatctttttctggaaaacatgccaataaaaaatggctgtcattgattccccttggtctgtcttaatcttaaagttttaggttgtttttccccttagattatggaaggagtgcattttcaataataaaatattagaaaaatatagaaaatcagaaggaagagaaataatctgtaagagaccctcagtgttagtattttcatgtgtctccttctaggcttgcttttagaaagtgcagtggtgctgcctaatctgctcataagggccagagcctagatgagcctattgacctgctcctggctgcagaggacaacaatgtaaggggctttgtatatattaccttaacctcagattaatcctgtgaggtcaatatgagttcctttttagagctgaggaaactgaccctctgagagagtaagtgtctcatgtctcacagctggtaggcagcagaactcagcccagtgcctgtcttctagtggtttatgccatctctgcaatgcaggaaatgctgggagggaatgatgggaatgactgttgcccattcccacagcagtatcctggtatgaaaggttggcagtgaatcctttttcttcagcagcctgagagaaatgggattggaggaatgtagagcaggaacaagaggtaggaactaggagtgatgacattgttagaactaggagggaaactagaaactcattttggatttcttttgtattgtcttgttaaatgtgagttattgcacattgtctagagcaagagttgataaactatggcctttaggccaaattcagcctcccacctatttttgtaaataacagttttattgaaaaatatccacacccggctgggcgcggtggctcacgcttgtaatcccagcacgttgggaggccaaggtggacggatcacgaggtcaggagatcgagaccatcctggctaacacggtgaaaccctatctctactaaaaatacaaaaaaaaattagctggacgtggtggtgggcgcctgtagtcccagctattcagaaggctgaggcaagagaatggcgtgaacccaggaggcagaggttgcagtgagccgagattgcgccagtgcagtccagcctgggtgacagagcgagactccgtctcaaaaaaaaaaaaagaaaagtttgcatattgtctgactgcttttaccctgtgatggccaagctgagttttggcaatggagactacatagctctagagctggaaatgtttactatctggtcctttacagaaaacggttaccaatccgtggtctaaaagtatatttatatgcttttagctttatattatgttagtgcttagatgggatgcgttcactcagctagggagctaagatatacctttaataattatagggtaggttggaacagacttctgttacctaaagattggtgggtatggatttctctactgacagaattctaaaaaacaaatgatttatatcatattttagactgtgacaaaaggtgtggagtctcttatttgtacagattggattcgtcacaaattcaccagatcaagaattccagaaaaagtaagaacaaagtttgatttttttaatgttagtgttgttttaaaaaatgttttaagtggtacccgtttttgtaatattggaagattttatgttaaattatatgtggatgtaggtgatggtacagagtttaaagcatagtgggatttatgtgaatggtgatcataaaaataaaactgttctgtcacttgtgtcactggccttcacagtaatgggtttttattatttcagtctacttattcctgcttgtggtttgtacatgtgtgttggtatcaccattgtcctgagaaagcagtgggtcttcctactcaggctctcactgtgtcactcttcattttcactttccgtatcgatcattgttactttggatctttcagctttttctatttcatttctgtgtacctatcattcttttagataatattgactaagcccgccattgatttttgtttaaaatttttttttaaagagagttttgctttgttgcccaggctggagtgcagtggtgcaatctcatctcactgcaacctccgtctcccgggttcaaacagtttttgtgcctcagcctccagagtatctgggaccacaggcccgtgccaccacacccggctaatttttgtatttttagtagagatggggtttcatcatgttgcccaggctggtcttgcactactgatctcaagtgatccacccgccttggcctcccaaagtgctgggattacaggcgcctggcctgtttttatttgttttttaattaatagtctttatttcttaaagcagttttaggtttgcagaaacattgattgggaagtatggagagttcctatgtgctccctccgcccagcatatacagtgtcccccacaactgatgaaccaacgggacacagtattattaactaaataccatagtttacactagtgttcagtcttcatgttgtgaagttctatgggttttgacaaatgcataatgtcatgtatccactattacagtattatacagaatagtttcactgccctaagtatcacctgtggttcacctatttatccttcccaactcctaacccctggcaagcactgatctttttattatctccatagttttgccttttctagaatgtaatatagctgaaatcatatggtatgtagccctttcaaactggcttctttctcttagcaatatacctgtaaggttcctccatgtctttttgtggcttgcttgcttattttttattgctgaataatatcccattgcatagacatacacagtttatgtgtgcattcatctatggaaaaacatcttggttgcttctagttttggacagtaatgaacaaagctgctataaacattcatgtatagatttttgtgtggacataaatttccaactcatgagttaaatacctggagcataattgctggattgtatggtaaagactacatttagctttgtaaagcctgggttttttgtttatttgttttgggtggggggttcctaatattttttattgtggtaaaatacacatataacatttaccatcttaaccacttttaagtgtgctattcaatggcattaagtacattgacactgttgtgcaactattacaaccatccatctccagaactcttttcatcttgcaaaactgaaactctatatccactaaataataactgccaacctaggcaacataaggagacccagtctctaccaaaaaaaaaaaaaaaattagatgggtgttgtggtacacacctgtagtcctagctactcaggaggctgagcggggaggattgctcaatctcaagaggttaaggctgcagtgacctataattgtgccactgcactccagcctggacaacagagcaagatcctgtctcaaaaattaataataatagtaactccccattttcccctctccctagcttctggtgactaccattctccattgattttcttaaaagataaaacagtattaccattgactactttgatacctttaatgtgcttggtgttcttttatcagaaatctcatccaggtacaatggttcacacctgtattcctagcattttgggaggctgaggcaggaggatcttttgagtccaggaattcaagaccagcctgggcaacatagtgagactctgtatctacaaaaaatttaaaaattagctaggtgtggtggtgcatgcctgcaggcccaactgctcaggaggctgagatgagaggatcactttagcaagaggtcaagggtgtagtgagccatgatcggatcagtgcactccagcctgggcaacagagtgagaccttgtctcaaaacaaaataaagaaatcttttttatttttcaagtcattgtctttccactgctattctttccacaactatattgtcttatatctttccatgtttcttactctgtatttctggaaggatagatacaaatgttggcattcatttaaaatatgcaaggctaggcacaggcaggagaataacacacactggggcctgtagggggcgagtggagggagaccaccaggaaaaatagctaatgcatactgggcttcatacctaggtgatgggttgataagtgtagcaaatagtgcagcagattgccatggcacatgtttacctatgtaacaaacctgcacatcctatatttgtgccctggaactttaaataaaataaatgtgcaaggcagtggttttgatcatcaactgtgataaatatgaaaacctttaaacctcatgaaaatagcccctgactatctttttttttttttttggagacggagtctcgctctgtctccaggctggagtgtggtggcgtggtctcggctcactgcaacctccatctcccgggttcaagcaattctcctgcctcagcctcccaagtagctgggattacaggcatgtgccaccacacccagctaatttttgtatttttagtagagacagggtttcaccatgctggccaggatggtcttgatctcctgacctcgtgatccaccccccttggcctcccaaagtgctggaattacaggcgtgagcaaccacgcctggcccctgcctatcgtctgaacttattcctgtattctcctgtattctcaactggtttctagacattgctacttggataacttataggtatttcaagttcatatccaaaattcaactcatcttactttccctccaaacaaccaaataaaaaagagggtgcgtctcttgtattagttatgtcagttaatgctaccatcctctatctaatttcccagactaaagacatctgaatcaagctcagcctccctcttcttcacccaacacaaatccatctatattactgcccagagttcccatatcagtcctttttctgttacagctactgtagttcaggctcttaaaccatggtcataagtgcctcctaactgggtttccttgtatcagtctctatccccagttggttttattcttaggtaagagttttctttgcaaatctcatagaaacatggtcctattggttctaaccttcattaactctgtatccccagcggtaatttctaaaggctcaacatagtcgcgcatagtttaacttcatcctctgcattacttttcgtgcttttttctatattagccaccctgaaccacttgcctttccaaaatattttgtgctccttcatactgttcctttaaatattctcacctttctttagtgcacctaccccttcctctgatctccaccatccttctcatcctaatctcttcaaaatctctagaaaaatataaacaagcaaaactcaccaaaaaatactcttaatcttacccaccccgagataactgctgccaactccttccacatccttctttgttgtatgttttatttttttcttttagactagtcaagtgcagtaatgaggaggaaagagtagaatacggagttcaatctgtgttgtgtgttttaagatgtgattcatctcatatgaatcaatgcttctctagctgctctctctgtttagtaatataatatgaacctctcactgtatacatttttttttaagttccggtatacacgtgcagatttgtcacataggtatatatgtgccatggtggtttgctgcacctatcaacccgtcatctaggttttaagccctacatgcattaggtgtttgtcctaatggtctccctttgcccccgactccccgtgtgttctcattgctcaactcccacttatgagtgagaacatgcggtatttggttttctgttcctgtattagtttgctgaggatgatggcatccagcttcatccatgtccctgcaaaggacatgacatcattcctttttatggctgcatagtattccatggtgtatatgtaccacattttctttatccagtctatcattgatgggcatttgggttggttccatgtctttgctattgtaagtactgcttcaataaacatacatgtgcatgtgtctttatagtagaatgatttatattcctttgggtatatacccagtaatgggattgctgagtccaatggtatttctggttctagatccttgaggaatcaccacactgtcttccacaatggttgaactaatttacattcccaccaatagtgcaaaaccataaaaacctcagaagaaaacctaggcaataccattcaggacataggcatgggcaaagccttcatgactaaaacaccaaaagcaattgcaacaaaagccaaaattgacaaatgggatctaattaaactaaagagcttctgcacagcaaaagaaactcgcatcagagtgagcaggcaacctacagaatgggagaaaaattttgcaatctacccatctgacaaaggtctaatatccagaatctacaaggaacttaaatttacaagaaaaaaacaaacaatcccatcaaaaagtgggcaaaggaaatgaacagacacttctcaaaagaagatatttatgtggccaagaaacatatgaaaaaaagctcatcatcactgatcattagagaaatgcaaatcaaaaccacaatgagatactacctcatgccagtcagagtgacgattattaaaaagtcaagaaacaatagatgctggcaaggctgtggagaaataagaacgcttttacactgtttacatttctacaaaactgtttttaatcatgaatgatattcttttttattaaaataccatctttttgggggtcaattttttttctaaatctgcttccccagagctatgactcttgatctaatgtctttgagacctttatatatattttatatgagtcttagaaacagtatttatagaatatatcacatatgcacactcatgtatttggtacagatgatgcacataacagcttacaacacataattgtgtggacatttctttttggtttttggctcaagaatatattatggccatcattcaatgtgaagacctgcaaagatagtaaacctcattcattttaatggtagtattgtatcctataggatacatcagaatttgtgtatttgcgccaggcgtggtggttcacacctgtaatcctagcactttgggaggccaaggcgggcggatcacaaggtcaggagttcgagaccagcctggccaacatggtgagacccccatctctaccaaaaatagaaaaattagctgggcacggtggtgtgcgcctgtaatcccagctactcgtgaggctgaagcaagagaatcgcttgaaccttgggggcagaggttgcagtgagccaagatcgtgccattgcactccagcctgggcgatagagcaagactccatctcaaaaaaaaaaaaaaagaatttgtgtatttgtatcattttacttagttttattattaatcattttatttagaatggatgcatcataatgtagttatcatggtgaggaacacgggttgcctttaaacttttcagtgttacacatagtgttagaatacacatccttattcggtatattttgtatacttagaggagtgtttctgtgggatagtttcttagaaccttttgattcttagataattaattcaagtattagctctgtggagctgtttctgatcgctcataggcagagttcattagtcatttgcctgtattctcataatactttgtagattctttttataatacttatgttttattttcatttttaatttacatgtttgttttcccacttgatagtcagctcttcacctgagaatagggagggaagaggatgcagcccagtgcccagctcatagcagtgcttacagattctcctgacatttaaattatttagtgttgtctggttgctcctgctttgttctacaggttaaactccatctatctgcataatcagattgatagaaatgttcaatctgaggttgaggattacatgatgattaaggatgaggtaattatgtagttgtgtatgtgtgtgtgtcttttaagaaaaaatgggaggtacacagaaactgtgtaagttggaaatttaccatttataattctttcctttctaggtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagtatgcaattattttaatcatctttagtgttgtttacattgctttaaattttatacttttaaaactttgcggtatacatttattatttattttgtattacttagggtaatttatttataaatttggcttagaatgaaccttcaatttaacattttactgaaacatggaactatctgcttttcagattgataacgttgctttgttgttgttgttcacaggcacatacccctcaagttcacaagaatatcccttcagtgaatgcaaaattgaaagtagttaagcatttgataaggtttgttgtttcttctcagctctttttaaaatgtattgcctagtgtaattctaaatgcatttttcttttttcgttaatgttctgaaaaaaactttttaaaaaactaaaattttattttgtttttttttaattgacacataataattgtacatatttatggggtacatagtgacgtttcaatatatataaagtatagtgatccgatcagggtaattggcatatccatcatctcagacatttaccatttcttcatgttgggaacattcaacatcctcctcctagctatttgaaactatgtgttattgttaactgtagttatcctgcggggatatagaacgctagaacgtattcctcctatctaaacgcattttcttgtgtcacagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcagcctcgacctcccaggctcaagtgatcctcccacctcagcctccagagtagctaggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctattttagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttttctcataagaatgctagctagtatgcctattatctaactggcacagtttcaccaaggacagtttggaactacacaggccattttagggagattttgacatgaacaagattgcttctttgggaggtaccttaaaatgaaaagcaaagaaacttccatgcggagattgtcttgtttttctcaaaatgggataattttgcttaacataagtagtatcccttccttcctttccatactttgagaattaataaggactagctttttgatcacacagcttgataaaattttcaagggtccaaattactgtctaaaccatttgccactctttgtgtatatttgtcaaaatctgcttttctatatcaaaacttttctctcaagacctgagggaattaattaataaggaatccttggaacactggaaattctaaaataagagtcagatacaaaacactggtcactaaaattcttacctttatgtattagaatggcaatcaatgaacaaactgaaaatgtctttggatattatttctgtttattttttgcctcaaaattattaaatgacatgaaataagtgctcaagaagaaaaataaacaattcttcatttcc

SEQ ID NO: 1918 - DNA, 8197 bp, Homo sapiens; identical to SEQ ID NO: 1913

SEQ ID NO: 1919 - DNA, 9745 bp, Homo sapiens
ccttccctcagcttgaaacacctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccggtgagcgtgggcagcctggagtcaggggagcctggggaccacggccttggtcagctctgcacgatcagggctgaatcaggaagtggcagatctagcaacaaagtccagattcctgaccgatattccttctccacatgccagtccttttccaaatcccctcaccttaaagtgacaaatgagctttttagtgaaaaagaatgagcgctgcattcttctaccaattttttggagcccagaatgggggggaaaaaagtcttcttaatttttcttaatacctaccatgtcccttcttaaataactcaagagcttctggatgataatggtgactttatctccttttcctgcagatgacatagacactaggtttttacagcaattctctgatgaccttgatatggtagaacgctgtgtatttcaagagtaagctctcgtttgaggagactaacaattcctgttttcgccaggtgagtactcatttttccccccacaagatatcattggcagggataaacaacttttgtgtagaacaaatttagtcataaaaatacatttaatataaatgccatgtttttccaatgtcttttcatcgtgttattacatggtctcatattttgtcgcatttattttcagatatcatatactttgtaagtataattagataccaaaaaaaattaagtgtccctgttattttagattaagaggttagaggacacaaggagcacatatcctcggaaatgtaattttttaaatgcacaaaataacaaactgagaagttatgttagagggaataatgtataatctcatttcctcttcagatactaagattattttgaatacattatctagcattattaaaaacaaataggaaagaatgttctaagtttaaaactatcagctggagttgaagacttcgggggtggggagattattaatataggaagtaggaaagtacttcccttatagaaagaataagaaaagtttaagcacttatgtatgccacctagacggtactgaagattatttggaaagaatataaggaaatgatcattttaaggccaaaagagggtgaaaagattttccttttttttcctatcaagaactgttgactttctcccctaacctgagaaagtaaaaatttccttccctctgtggaaacccaaggggtagtgagtgtcccaccctgccccaactaaaccttttttttttttttttttttttttttgagacagagtctcactctgtcgcccaggctggagtgcagtggcacgatctcggctcactgcaacctccgcctcccgggttcatgccattctcctgcctcagcctcccaagtagctaggactacaggcgcccactactacgcccagctttttttttgtttgttttttgttttttgtatttttagtagagacagggtttcactgtgttagccaggatggtcttgatctcctgacctcatgatccacccgcctcagcctcccaaagtgctgggattacaggtgtgagccactgcgcccagactttttttttttttccttttttttaagacagagtctcactctgttgccctgtacccaggctggagtgcgttggcatgatctcagctcactgcaccctccacctttcaggttgaagcagttctcctgccttagccccttgagtagctgggaccacaggtatgtgccaccatgcccagctaatttttgtatgtttttgtagagatgcggtttcaccatgttgcccaggctggtcttgaactcctggactcaagtgatccacccacctcagcatcccaagtgctgggattatatgcatgagccactgtgcctggcccaggctaagccttatatagtaccctgtgcttgctctctcgtgacagacaccttctaaggtcttggttttctagtcccttaatttttccatcatttcaaaagcttcactacaaaaacctctgttattactattttttgttttgttttcactgtcctcttcctgatcccctcaaaaaaaaatctgggactccaattccatatgtgttaagccacttgatcttgttccacagctcactgatgctgtgttccttttttttgtttgtttttttgagatggagtctcgctttgtctcccaggctggagtgcagtggcgcgatctccgctcactggaagctctgcctcgcggcttcacgccattctcctgcctcagcctcccgagcagctgggactacaggcgcccaccaccacgcccggctaatttttttgtatttttagtagagacggggtttcactgtgttagccaggatgatctcgatctcctgacctcatgacctgcccgcctcggcctcccaaagtgctgggattacaggcatgagccaccgcgcccggcctgtgttccgttttttaaatcagagagtttcctccttatgccgaggcctgaaagttccaggcaatgtccattcatagggctcactttatttcctgtttctcaaggatcactctcccgaactgcctgttgtccaatatctaaaagccattgcttcatgtgttttgtgttttgatgctgaaagcaggcggggcacggtggctcatgcctgtaatccagctactcgggaggctgaggcaggagacttgcttgaacccgggaggcagaggttgcggtaagccgagatcgtgccatcgccctccagcctgggggacaagaacaaaactctgtctcaaaaaaaaaaaaaaaaaaaaaagatgctgaaagcatgaggataagtctggtctctgttactccatcatgactagcagcagaagtctgccattcttcacagttccaggccccatgtcactaactatcctcaagggatgtggtttgcaatgcaaaaattgcttcaggctgggggaactgtaagtgcaaaggtcctgaagcaggagaaggtttggcatagaatatgcttgaggaacagcaatggggtgataggtctggggtcgaataaggcaaagagacaggagagagtgcttgctagtagagttgtttgctacggctgtgcaacaatttaccacacacttggtgtctttaagcaacacaaatttattatcacacggttctggagatttacaagttcaaattgggtctcactgggctaaaatcaagatgtcaggcaggtctacattccttctggaggctctaggggaaaatcccctttcttgcctttccagcttctactggcagcccatgttccttggcttgtgatcccagtctatattcaacgccaaaaatggccagtcaagtcctcctcacattgcatcatggctaacacattctacctccctctttcacttctaaagactcttgtgtggcaggtgcggtgactcacacctataatcccagcattttgggaggccaaggcaggtggatcacttgaggtcaggagttcaagaccagcctgttcaacatggcaaaaccctgtctctccccaaaaatacaaaaattaactgatcgtggtggcaggcacctgtaatcccagctacttgggagctgaggcacgagaatcacttgaacccaggaggcggaggctgcagtcaccctagatcacaccactgcactccaacctgggcaacagagtgagactctgtcccaaaaagaaaaaaaaaaaagacccttgtgattacattagtaccacccaattaatccaggagaattttcccaccctcagagtcagctgattagcaaccttaattcccccttgccacataacataacatagtcccagcttctggggattaggacaaagacatctttgaagactattattctgcctaccacagctggggaccagatatgtagataatttttttctctgatatgggaagcaactagagtgtgttgagcagaggactgctgtgatctgggttttgttataaaaggttcaaaccagtccaggcatggtggcttacgccagtaatcccagcactttgggaagtgggaggattgcttgagtacaggcattcgagaccagcctgggcaacacagtgacaccctgtctctacaaaaaaaatgaattttaaaaattagccagatgtggccaggtacggtggctcatgctgtaatccaagcactttaggaggccaaggagggcagatcacttgaggtcaggaattcgagaccagcctggccaacatggcgaaacatcgtctctactaaaaatacaaaaattagccgggcatggtggcaggtgcctgtaatcccagctactcgggaggcctcagcaggagaatcatgtgaacccagaaaggcggaggttgcaatttctttgcaacttgaatttctctgattcctagttaattatctgtttgggattcctcaatctgtgaattatgtttttatatcctttgcccatttttctattgggttttctttttccttgctaatttctaggtgttctctttttattccagccattaaataccatcagctttggacacagaaaatatctccttccagtctcttatctatctttttgtttatatttttttcattgaatagaaattctcaattatgagtaatcaaactcactgttttcctcccttattgtttaagctttttagtcttgttcaagaaatctttcttcactccaaggtaacagatattttcttctattgcatttacagttctgccattcacatttaggtctttaatgcatttgcactccacttttttttctttttgagacggagtcttgctctgtcgcccaggctggagtgcaatggtatgatctcagctcactgcaacctccaccccctgggttcaagcgattctcctgcctcagcctcctgagtagctggaattacaggcacccgccaccacacctggctaatttttgtatttttagtagagacagagtttcaccatgttgatcaggctggtctcgaactcctgacctcgtgatccgcccacctcagcctcccaaagggctaggattacaggcgtgagccaccgcgcccagcctacttctgtgtttaagatcctgcttatgtccacatagttagccaatgttcacgataccatcatactaaacttagtctgttctatctcctttgtcttatagtgccacctgtgatatatgtgaagttcctgaaatacctaagtccaagttacagctctgtcatattctactgattatttgttcctgtacctgtacaaggttatttttattactttcactttgtggcatatctttttgttttttttaatttttttctgatagggatgaggtctccctatgttgcccaggctggtctcaaactgctggactcaagagatctttccaccttggcctcccaaagtgctggaattacaggcgtgagccattgtgcccagccgcgtagcctatcttaatatctagtaaagaaagccactttgttctttttctccagattgatttatctctttatgtacctttattcttacatatatattccagatttcttcttgaatggcaacctaaatgccagtccaaagaggcccccaatagacttgttcacccttcatgtcctcaactctggggaagttaaggtaagactcacagggccaagtctaccctattatacttggttcctcctcagtccttttattagattgaagtttaatgtgcaaattgataattatatgttaccattcttttacgtttgttgatttcaaatgccatgttttagagttttgtgttttttaaaacgttttttcaattttgtattttgaaaaagttttaaacctacagaaatgtaataataataatatgtagaacaactttttaagctttacctcctagatttaacagttgttagcattttgcatattttactgtctttctgtatctatgtatctatctatctattgctaaacaatttgagggcaagttgcagatacaattcttcacccctaactatttcagtatgtatttcctaagaacaaggacattgacttatataaccacaatacaattatcatattcatggcatttatcacattgatccaatattattatctaatattgtcccatatccaaatgtttcagttatctaagtaatgatctttgtagtacattccatccccttcccaattcaagagcattggttgcatctgaaataatgtatctttagcctcctttaatctgaaacagttcctcagcctctctgtgtctttcataacattgacatttttaggtagaagctatttgtttcatagaagatacttctgtttgggtttatctgattgtttcctcatgtttagattcaagttatgcatttgacaggagtatttcctttctaagaaaaagagaaaccaaatagaataaactcaattttattcatttgaaggcagtattagatattcctttgatgaggaagaaaaattcatcttcaagttccaaatctaaaaatcaaatatacccatatttcagaatttcatcagagatattaaaaaatttagctaagttgtatttgagtcccagaaagccaaatatatactatttacctaattgttatattaatatttgagtaagtactatatttaggctactacagtagacccaggactctgttttgttataaacactgatattcagtcacaaatatggataaacagggtttcaagatgattctttagaaatgttcagtcagtaattacagcttgatgagtatgaaattgtaaactatcaaagataccacagtaggtaaatattaaagacataatacattctaaaaagtgggtgaggctgagcgcagtggctcatgcttgtaatcctagcactttgggagctgaggtgggtggatcacctgaggtcaggggttcaagaccagcctggtcaacatggggaaaccccgtctctactaaaaatacaaacgttagagtttctgtttgggatgattaaaagttctggagatggatgaccatgatgtttgcacaaaaatgtaaatgtactcaatgtcattgaattgtacacttaaaagtgtttaaaatggtaaatgttatatatattttaccacaataaataaaatatagactggaaaaaaaataaataaaaataaaaataaaaatacaaacattagctgggcctggtggcgggcacctgtaatcccagctactcaggaggctgaggcaggaaaatcactttaacctgccgggtggaggtccagtgagccgagatcgcaccacttcactccagcctgggtgaaagggtgaaactccatctcaaaaaaaaaaaaaaaatgggtgagggatttcgatcgaagctgtggaatctgctccagatctcaggttgctactatagcatcttgggtagatcactcttctccagtaagccctgggctttctcaaaccttttctgtacaggaagcctgtcccttctgccatcctggtcaactctgcctaccaaattcctgcccatctttgaaagcgaaaccctaacctaggctcccctcctttgggaaacttcccaaggcctccctccatgctacatgatcatcttttttttttttttttttaagacggagtctcgctctgtcgcccaggctggagtgcagtggcgcgatctcggctcactgcaacctcagcctcccgggttcacaccattcttctgcctcagcctcccgagtagctgggactacaggtgcccgccaccacgcccggctaattcttggtatttttaatacagatggggtttcaccatattagccaggatggtctcgatctcctgacctcgtgatccacccacctcagcctcccaaagtgctgggattacaggtgtgagccactgcgctcggccgatcatctctttttacagactagacatccttaatcacaagtatcttttttttttttttttttttttttaagacagagtctcgctcttgtcgcccaggctggagtgcagtggtgcaatattggctcactgcaacctccgtcttccaggttcaagctattctcttgcctcagcctcctgaatagctgggatttcaggtgcatgccaccacacccagctaatttttgtatttttagcagagatggggtttcaccatgttggccaggctggtctctcaatcctaacctttggtgatccacccgcctcggcccccaaagtgctgggattacaggcgtgggccaccgcacccagccaatcacaagtatctttataggacatctttattttttacagaaaataaagtactagcagagtacttggccttcagtcgttatttctttagcccattagtaatgaataaagaggtttcgctagcaagaatgaaagaaaggactaagagaagctctactattttctgaaaggtgataaaacatacaatcagataaatttccttttaaaaagactttcaaataaatctttagaacctgcaaaccctcccacaaagaaaatgtaaacactgaaaggtaggaggcaattttactttatatttctagtatcaccacagcttttcattcaaacaaacattgccatgaagttagggaaattcctgctgcattcacttgttactttttttttttttttcagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaaagcagatttctctggtattatattatatccttcttaaaaaccagagtttttaagtaacagtatttgaatggcatcaaaacattttcattttaatgtatttctttaacaagtggttaaaaaaagtgtccaagcagccgggcgcagtggctcacacctgtaatcccagcactttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcactgagctgaggtcatgccattgtactccagcctgggcaacaagagcaaaactccgtctcaa

SEQ ID NO: 1920 - DNA, 18480 bp, Homo sapiens; identical to SEQ ID NO: 1917

SEQ ID NO: 1921 - DNA, 8078 bp, Homo sapiens; identical to SEQ ID NO: 1916

SEQ ID NO: 1922 - DNA, 8197 bp, Homo sapiens; identical to SEQ ID NO: 1913

SEQ ID NO: 1923 - DNA, 30063 bp, Homo sapiens
atgcactcagtgtaacttttattgaaaaatatccatagacaattggacatgcacaattcaaacttgtgttgttcaatggtcaactgtgctacaaaatcaaaaagtggggcatagttactaagccaatagtagaaataaaaaaaattacttaaaaccacaatatcagttcaaaacaaggcaggaaaagtgaaaaaatcctaagtaaacagtaatatataacatgttaatagattgaaaaattcaatattgttaagataattttcttgcattaagctgcagaacaagcaaaataccaattaaaatctcagcaggacttttgtagaaattggcaagctgattataaaatttccatgtaatacaaacaattttaaatagcaagagtgattttaaaaattaagggcaacgttgaagaacttacactactagatttcaagacttatcatacactgcagtaatagatggagtggggtattggcataaggacacatatttagattaaaagaataacataatctggaaatgtttacaagcatatatagtcagttgttttttttaatcaaatttgccagtgtaatttaataggaaaagaatggtgctggaacaatagaatatcaacgtacaaccactgacagcgattataaccgtaaaatttaggtgttttgtggttgagggcatgatgggacatctacaaaataaaggacaaaatatttcttactgcactgcaataagatggaagtacaacatttggtagtcctttttggatacaggaggcagcatagttcacatctgaggatgctgtaccagaccatgtattaggtaatacaaatgtttgcattcattagtgcacactaactatggtagaagtgctgaagcactaaaaaacttagttggcaatgatttgtccagttgatagcaacccatgtttgtcggggttctctagatggacagaactaataggatagtgtctatatgaaggggaatttattaggagaaatgactcacaggatcacaaggtgaagtcccaccattggttgtcttcaagctgaggagccaggaagccagtccgagtcccaaaacctcaaaagtagggaagctgatagtgcagccttcagtctgtggtggaaggcccaagagcccctggcaaatcactggtgtgagtccaagaatccaaaagctgaagaacttggagtctgatgttcaagggcagaaagcatccagcatggaagaaagatggaggccagaaggcttagccagtctggtctttccacgtgtttctgtctgcttttattctggccatgctggcagctgattagattgtccccacccggattgattgtggatctggctttctcagtccacggactcaaatgttaatctcctttggcaataccctcacagacacacctaggaacgatgctttgcatccttcaatccaatcaagttgacactcaatattaaccatcacgcaacccaagtgtgagcatgaggtgcatgtagacatggtaaccatggtgatgtaaggaagactatgcataaattcagtagcatgggttccctgtctccaacacaaatttatctcctgttactgcatgatgtccatacatacaagacaatcactgagtccccctaatagcaccattctgcgtggagaccaattagctgctgggtggtgcgtagtggaacaatggcatgttaagttaaagatttcagtgggatgcctagctcagacatgagaccatacaaagatgggatgtcactttttaggatgtgtattctaaatcaacaaccataatatgattttttccgagtaggtaaaatacatgagtctaaaatcagggacttaaaatataaataacttacttaacatcatcaccagtttctcatttacagagtttgtgctttccagacccacaagtttggactgtatgatggagaagttctggtcgacaaaggtagaatacatcgactctgggacactgcaaaaatttcaatgaacttaagttatggcttcttccagtgtacttcaggggacttttcccaagtgacttgaagagaagtcactatcctgatagggataattgatctgaacttcggaaaaaggtagagctcttgtagaacgtaaagcaggaggaatatttttaacagtaactaatcttaatccactttggtgtcttttgatattctcttgtacaactttgagaatcaatgtaataatacagcagccaggacctgagaaggcatagcgactgtgactatagaactgtcacagatgaaggtctgagtcttccaaagttaggccacctgaccagcagaggtgctgtttaagggcgaagagggtgaaaatgcgtaactaagaagtatcttagctcaggcctctgtaaaaaatactgtgggtgggttagacaacaaaactttatttctcacagttctggaggatggaaagatcaaggttgaggtgctggcagtcagttcctagtgagggccctcttcctggttatcagatagctgccttcttgctgtgtcctcccatggtggggagagagtgagagctttggtctttcacttcttataaggagagcaattccaccatggggcccccacctctatgatcttatctaaacttaactatgccccaaaggctcgtcctctaaatgccatcacaggggaagttaggggttcaacatatgaattttgagggatatgacattcagtttacaacaaggatggtaatgttgaatatcagttacagcccaagatctactgcagagttggaagctgtgtggtttcttcatttaataagtctccactagagaaagaaaaaaatacacacatactagaatcatggagaagctgctcccaacatatatgtacacatggattcgagcagcatggattaactgaagtggacactgtgcttcactacccatttcctaagctgcttattatataaactgttggagtgctgctgcctaatagaactgccttcctggaagtccttcatcttttcatcttttactgaagcatctcacatccaatactggtggatacaggagtaaaaagttctggtccggttgcaataaatcagagaaatgctaaaaagttatcccagttccagaactctaaaagaagcttttgttgtgaatgaatcaaaatccaactttttttttttttttgagacggagtctcatcttgtagcccaggctgtagtgcagtggcatgatctcggctcactgcgaccttcgcctccggggttcaagtgattctcgtgcctgagcctcctgagtagttgggactacaggtgtgcaccaccacacccagataatttttgtatttttagtagagacagggtttcgccatgttggccagggtggtctctatcaaagtcaaacttctttgtctttcaattctgcttcctttcctttccttcctggtgttaattccaagaacactacccaatcaacctactgtgctatgttttacctatagtctgcttcccagggagcataacttgcaacattaaaaacttgagaacaaacatgtaaaagtgaaaaatcaacaaagcaacgaattctttgaaatgatgaatcaaagtaataaactcctaggaagactgatcaacaaacacagaaagcacaaatttaaaatatgcagaataaaagaggatatcactatagaccctaaagatgttaaaatataacaagaggatattataaacaatattatcccaataaaattttcaacttatataataagaatatatttcttgaagaacagaatttaccaaaacagacattagaataaacagaaccgtgaaaaactttgctaaaaattttgaaaagagaaaaataattaacaaatacatagataaatataacttaccaaaatttataaagaatggctttaagtaatcataaaataatttaaagaaaacaccaggctcaattcttgtatggtgaagtctgccaaaattaaaaaaaaaattaaattctatggacaaattcggaggataaaaaataaatataggtcagaaactcagatctacaaacagaaaggaagagcatttttaaaaagtgaagctaaaagaaagacttatttttcttattcttaagtgatctaagaaataatgattagttcaaaatattaatcacaataatgtactttattatgtatgtgtatatgtgcatgtgtgcacatatatataagtgaaatgaatgacagtgatgataaaagagatgagagagaggaattgggatatttaaaaattattattataaggtacttgcactaaccatgaagtagtatagtgttatttcaaagtggacttgtaaatgtatatttcaaactctagggcaacctccaacaaacacgaataaaagaagtaaaactaatgctaagaaaggagagaaatggaattatataaaatgttcagttaaaaccacagaagtcagtaaaaaagtggaagacattagactaaaaataaagggagagagaaagacatgctatgatctcactaataaaaaagcaggaatagctatattaattttagactgagcagacttcagaacaaacagaggtatgagaagtaaattagtacaaccattatggaaaacagtatgactagtctgttaaaaaaaaaaaaaaaaaacctaggccgggcgcggtggctcacacctgtaatcccagcactttgggtggccgaggcgggcggatcacgaggtcacgagattgagaccatcctggctaacacggtgaaacccctctctattaaaaatacaaaaaattagccaggcgtggtgatgggcacctgtagtcccagctacttgggaggctgaggcaggagaacggcgtgaacccaggaggcagagcttgcagtgagcggagttcatgccactgcactccagcctgggcgacagagtgagactccgtctcaaaaaaaaaaagaaaaaaaaacccccaaaaatgtaactagcatatgattcagcaatctcacttatgaatgtatatccaaaagaaatgaagtcagtatgtcaaagggttatctgcgctttcatgtttattgcaacattatttgctaagacatagattcaacctcaatgtccaccaatggatgaatggataaagaaagtgtggtacatatacacaatggaatactattcagccttataaaaaagaaaaaatatctgaaacaacatagatgagattgaaggaagttatgataaatgaaataagccagacacagaaagacaaatatggcatgatctcacttatacttggaatctaaaatagctgaaatcatggaagtagagactacaataataggtaccagaggctgggtgggtgacggggatagagaaaatgggaagattttaggcaaaaggtacaatgtttcagctaggaggaatgtgttgatatttattgcacagcagtgtgactatggtcaataatgtattttgtatttcgaaataactaagagagtatatttcaaatgtctcaccagaaaaatgatggataaagtaggtgatgtgtatattaattagcttgatttaattatttcacatggtacacacatatcaaaacatcacattgtaccctataaatgtacaattatgatttgtctgttaaaaataatattaacttaaaaggaggagcattgcatagtggtaaaggggttcattcttccagaagtcataacaacctgtaatgtatatgtgcctaaaaacaaagtatcaaagtatggaaggcaaaaactgatggaactgctaggtgcaattgatgaatccactgttttagttgaaggcctcatccttctatcacaaatggacacatccaacaagcagaaaataaatttaaggacacagttgaactcaatagcatcatcaatcaactgaatataattgacatctatagacctactttatccaacaacagcagaatacatttcttctcaagctcacatggtaccttaactaagatagaacacatgctgggccataaaacacaccttaagaaaaattttaaaaaagaatgatgaattgtctgctctcaagccacaatgtaattaaactagaaaacaataacagacagataactggaaaaatctcagaataacacatttcaagataacatataaataaaaaaaagttaagaaaaacaaaaaaagggaataaatgaaaatgaaaacactataacatttgtgagatatagtaaaatcaggtcttagaatttatagcattgaatacatattttagaaaagtgaggtggctcacacctgtaatgccagcactttgggaggccgaggcaggcagatctcttgaggtcaggagttccagaccagcctggtcaacatcgtgaaaccttgtctctactaaaaatacaaaaactagctgggcgtggtggcacgtgtctgtaatcccagctacccaggaggctaaggcaggagaattgcttgaacccaggaggcagagattgcagtgagtcgagatcgcaccactgcacttcagcctaggcgacagagcaagactccatcaaaaaagaaagaagaagaagaagaagaagaagaagaagaagaagaagaagaagaagaggaagaggaagaggaagaggaagaggaagaggaagaggaagaggaagaagaagaggaagaggaagaggaagaagaagaagaagaagaagaggaagaggaagaagaagaagaagaaggatctaaaatcaataatttaagcttctaccattggaaattagtaaaataagataaaatttaattcaaaataagcagaagaaaagaaataatgaaaactagagcaaaaaatcaataaatttgaaagtaagatatcaatgaatttgaaagtaagatatcaataaataaaatcaatgtaaccagaagctgattttttgcaaggtaaataaaatagataaaatagataaacctctaccaggccaactaaaaaaaaaggacaaaggacacaaatttttaatatcagagatggaagagggaatatcactacaactccattgacaacaaaaagatagtaaaggcatactatgaacaactgcatgcccataagtttgataacctagatgaaatgcatcaatttcttaagtaacaaaatctgccaaaactcacacaaaaaggaatacaaaatccaaatagccctatatccatgaaagaaatggactcaataattaataaccttccacaacagatagcatcaggcccaaagatgttcactggtgaattctaacaaagactgaaggaagaaattataccaattctctactatttatttcagaaaatagaagtagaaggagtacttctcaactctttctatgaggccaacatcatcctgatatcaaaaccagacagactttataagaaaagaaaactgcagattaatatctcttatgagtacagatgcaaaaaaaaaaaaacttcaacaaagtatttgcaaatttaatccaacaatatataaaaagatttatacatcagaaccaagtgggatttatctcagatatgcaatgctggttcaatatcaaaaatcaattaatgcaatccattgcatcaagaggcttaaaaagtcgtgaaattgtatcaatagatgcggaaaaggtatttgagaaaatccaacactgacatatgacaaaaactctcagtaaactgggaagagaagaaatcttcctcaaattgaaatggaatatctacgaaaagcctacagcttaacatcatctttaatgatgaggacctggaagctgtcccaccaaaatagaaagaggcaagaatatttcctgtcactactgcttttcaccattgtactcaaagtcctagttaatgacataaaacagaaaaagaaataaaaggtatacagattggaaaggaaaaaataaaactttgttcacagatgacgtaatcatttatgtagaaaagcctaaagaattgaccaaaaaaccctcctagagctaataagcaattatagcaaggttgtgggacaaaaggttaaaatacaaaagtcaatcactttcctatataccagcaataaaaatttgaatttgaaattaaaaacacaatatcatttatattagaacctacaaaaataaaaacttaggtgtaaatccaagaaaatatatacaagacctgtacaaggaatactacaaagctatgatgaaaggaatccaagaactagagtgacaatccacgtccatggacaggaaaactcaatattgccaagatgtcagttcttccaaacttgatctgtaaattcaatgcaatcctcatcaaaatctcactagtcattttgtagatattgacaaactgattctaaaatttatatgcaaaaggaaaagaaccagaatagccacgacaatattgaaagactagaacaaaattggaggattggtagtattgacatcaagacttactttaaatctacagtaattgaggtagcctaatatttgcaaaaggataaacagatcagaggaacagaagagagcatgcagaaataaagctacatgaatgtactcaactaatcttaaacaaaggatcaaaaacatactatggagaagatagtcccttcaacaaatggtgctggaatacctggatatgtacatgcaaaacactaaatctaaatgctaaccttatacccatcacaaaaatcgattcaaaaaggttcaaaaacctaagtgtaaatgcaaagctataaaactcctaaaagaaaacataggagacattgcagatgagcctggatttgctgataactttttatatataacagcaagggcataattcatgaaagaaagaattggcaagctgaacttaatgaaaattaaaaatgtccactctgtaaaagatattgttaagataatgaaaagacaaatcatagactgaaaatattcgcaaaagacatatgtcatgaaggattgttattcaacatatacgaagaactcttaaaacataacaataagaaaacaatttttaaaatgggcaaaagacctgacaccttagcaaatatgatacacaaatagcaataagcatatgaaaatatgctccacatcctatatcatgagggaaatgcaaattaaaataaagaaattccactaaatgtctattacagtaaccaaaatccagaacattgacaagcaccaaatgctgatgaagatgtggagcaacaggtaccttcattcattctggggggaatgcaaaatggtatagccactttgaatgacagtttagcagtttcttacaaaactaaacatactcttatcctacaattcagcagttatgctccttaatattaacccaaaggagctataaacatgtccaagcaaaaatctgcatatggatgtttaaagcagcttcatttattattgccaaaacatggaagcaaccaagttgtctttcagtaggtaaatgaataagtaaactgtggtatatccagacaatataatattatttattgctaaaaagaaatgagctctcaatccacgaaaagacatggaagaaacgtaaatgcatactactaaaaaaaaagccaatttgaaaaggtacatactgtatcatttcaactatatgacactctggaaatggcaaaagtattgagacagtcaaacagtacagtggtttctaggtgttgaggggagggatggatgaataggtgaaatacagagcaaattcagggcagtgaaaatcttctgtctgatactataaagatggacacatgtcattacaaatttgtacaaacctatggaatgtataacaccaacagtgaacaataatgtaaattttggactctgggtgataataatgtgtctgtgtaggttcatcagtcataagaaatgtaccacattggtgggggatgttgataatgagaaacgctatgcatgtgtggagacaggaggtaggtacattgatgctgtgacccttcctctcacttttgctgtgaatataaaactgttctaaaaaaaatactttaaaaaatccatggtgaagaaaattataaagacaggctattgtttcttgtttgttttacaaccctgtgctttgtgcaagagaaaaagttgttcccaatgagccctaggtcctagtcagggccacaaaactgtcacatcccccatggggtgggccaataaaggctgacaatagtgttggaacaagtgaggcaatgcaggcctttatgtatactcatggtttttgatttttattaacttttattacctttttcgatttggttcaacaaatgaaatttacagatattttacataagtgtatattgcagagcccatttcttcttttgcatcaggctcagacatggcttgtcatggcactgaggaagagatttattcttcttgactctggggtttcctagtcctttctatctccatgatgatggcccaaatgaactgaacttccctagcactgtctctgcacaataacctcatgggtcttcattccctaatctgacttttaaaggcctgctgagtaaagaaataagatcctagggaattctgaagtaggcgaagatgtttctgtagtacttcaatttccaactttacatcattttcctttcaaagtatgcccccattttcactcactaacattcatagtattttacctttttatcatctcaaaacatttgagaaatttgtggaataaattaactcattctgaggtaaaaaaaatttaaatcagctgagtgggctctacacactgcacagaaatagtgtctgttttacaaaaattaaaattttgctagctaaaataaaacactagctgttaaatgtcaagtattaactcatgggtgaagaagtgaaacctttcaatagccctttaaaattttaacaattacttcttaaactacgcataaaaaccagttttaatatatatataacacaaaaaaaacacagaacaactttttcaaaaaggtcaacagttttagttacaaaacaatgtctctggatgtggacattaaaaagactacttccaagaaaattaaatttttgaagtcttaattaaatccaaaataggcaatgtgtgccaacactacaaaagacatcaaaagtctcatctgccaaatgttgcccaatttgagtacagatttcatttcctatgtgaatgccatgtcctattccctgaaacctgaatgactaacattgaaaaatataagaaacataaagtgataggtattatgtgcagattttattaatagcacaacaaataatctttagtgaacaaaatggacagtttccatgactgaatctcaagaattagaattagaatgactggatttataatttagatacactggctttttacttggtgacttatttaggtagttacaataattgatattttctaagcacttaacatgttccaggcatgataataggctgctaatatagtttatttgtttacttttcacaagagtcctatttaatctcctttcgcatatttttcatatgagaaaactaagtatattctaagattatggaacttgcccaagtttacacagggatgtggttcaggacgtgctatccaaaatacagcaccttgacacaatgagtattttaagctgaaggaattgatcaaaccacagaaacaggaagatgtctctgaagcaggatatagaaacagttaataaaagtaattcaccttgaccttgtctcctgaagcagaccataaaacctagctgagcttcccctgaaaataggtcataagactcttatttcaggggatttttgaaatatacccagaagaaaggaatgtcacacaggaacaccaagaaaaatctgaaggggagaaaatataaatattttttctgagtcctcacaaggtctttgctaggatacctgtgtaaaaaaaaaaaaaaaaaaagacaaatgaacaggaacaaaaaggtatacaaattttactaacatgtatatagatataggagccatgcactgagtatgagactcaaaggaagtgccagatagctgaagtttttgtaccatcttgaggttacagaaggaataggggaaagataggatatgggagggagagaggaggaaaggcatggtgagcaaaagcagacttgttattgcagaaatctcacagatagcaactctcagaaagaatacatggtggcctgcagtaacatttttctgtcaaaacttctttgaaggtataagattttagtctctttttctgtgagttaatctttcctggatccggataagaggaccctcagaaaaagtctgtttgcgttgctgtatttttttactaatgcagattttctctataatgcaaatctcccacacaaaagggcaattttttcaggggtatttctgtgggttgcagcccttcagaatagccatatagaaatacaccaaaaaagtatattttgtggtgaaatattctggtttctgtcagaacaaacaggtcttgctaaattttctcccagtttatagctattagatcatatcttcctttttcccaatcatgttcctccacaactgtctacttcttcatcatgcttagcataaaatatacacagttttccctgtttctttgggaaacacagttttcccctccgaatatacacagttttcacctctgaaatttccatattacgtaaaatttatattaaatacgttgtatggttttctcttgtaatctgtcttttgttacaggagtcacagtcatgaacctagcgatgggcgaggaaaagaaatagctttttctcctctacagtttcacagatagcacatgcagaaaagccggtgagacacacatattcagctggagaaaagacttgacacatcactttttatttatttattttgagaaaggatctcactctgtcacccaggttgaagtgcagtggcacaatctcgtctctggtagagacagggtttcaccatgttgtctaggctgatctcgaactactgagtccattggatccacccaccttggcctcccaaggttctgagattacaggcatgagcaactgtgtccagctcataccacattcttaacatatgctactacattctttactcaccagcttatagttcactactatttttcctctccctttctcatttgttaatttattaattttccatgacttgggaggcaaaacttttatgtaacataatagcaatctgtatccctttaaaaacattggctgtttttacacgccatgtaaacctcagtaaaatgagtaccttagagaattatatagattcctcagcaattccaagagatccaatatcctttccctgttgcagaccagaactttatcaggctacttaggtatgaagtaaaactaccagttcctgttttccattaagcagagcaaacaataggcaacaaacaaacaaacaaacaaacaaaccagaattcaagcttgttgaagcaacaatagcaacggaacaaataataatatgaaatttcaatacagaattctgtcaaagtttttccttctactgttcacaaaaatgttcaccaaaacatcaggcttactgacataggacaaactgcataatgcaatatgttaaataacaagcattgtccattataatgaaaggaaacaagagtcaaaggcacgatattcataaaacacttggaatctataacccactaaaattcaggctaccagccaaatattataacatcttcaaacatcaggtaacttaaggtgtatgatttgaaactgataacacataatttccaaagagctctgtataggtaaacagtggtgatgcagtgagctatttgtgtcgagtatttatttctttgctgtctaattgctccaactccctagacgttaggagtctatcacctgctgttcctcagctgctaagatcagagaatataacacagatggagtgagctatgttctcacggctgctgcttcacagagataaggctgcaggttggagaagtgctcagctctgccttcctctgaaagagcctgaacagctatcaataattcccagttactcctctaccgttatgttaaacaacactgccttgcatacacaggtgcaattagataaaagagagttgtttaaatcacttgaaatgcctgtagctttattattgcagatctttgtgttgtctctcgtcttttctttttttaaaaaacctctttttcctgcccactccctcccccaggtctactgccaaactgcaatgatttaagaacctggttaaaatattgggtcacatttcttcaccagttgccttgagcgtgtttggggagctattctttagccacccttgtcattctgctgtcattcacagcattatatttctaggtatgagaacattgcaaaaatcagttatgctcattcaggaacatgtattatgtctggatatgatctcacaattaaaataaaccaatttccagcagccagggtatggtagctgcaatcccttgtatcactgaaatttatacagttcttaattttatcaaaggacaaagatcattttacctccaactcctaaatatgcaaatacaaactctccacaccctctcctgacactggagagtggtagaaagggtcggactgtgctactaaatcgggcttcatataattcaccattttgatcagttatcataattgacatcagcttttgcttcctgtgaagcaacacatggaatgcacttagtacagggcctcctagcctattttcaaatatcaactactgctgattaccaatgtattttcggccctttccctcctgatatgtccttgagtatcaagttcagtggctgttttcccccactcagcctagatactctgggattctttgaaaataagctgatatgactttcattagtgtctccacactttaaaaatttatcacgaacactggtacaagtgttctttattatatagaaacaatgataagggattcattgtcacaagatttttaagcagtgaactgattaaatactcattgcttgggttaattttacatatttaaaatgctttttttttttttttttgagacagagtctcactctgtcgccaggctggagtgcagtggcacaatctctgctcactgcaacctcctcctcccgggttcaagagattcttctaccccagcctcccgagtagctggaagtacaggtgtgtgcccccacgcccggctaattttttttttttttgtacttttagtagatttgggttttcaccatgttggccagaatggtctcgatctcttgacctcgtgatctgcctgcctcagcctcccaaagtgctgggattacaggcgtgagccaatgcacccagccaatgcatatgttttttaataagtgtttctcatacttttccttaatctcctttatcgtactagcatcttattatttactgttgatacaacattctgatttcccctctaagcccaaggtaagctgcttcttactaaaaaccaatcattttagaaacaattaaacatgaccaagcaaagactgagctttatggtcacactctgttatgtaaatgaggtaatttaaaacaaacttagtgtttttttcttttatatttaagcttatattgttttacctagatgtttaagcaactctgccaaatgtacagttcacactgtatcataaatactattacaaatttattaaaattattttctgacatttatgtagtatatatgcatatatattttaaactttagtttaattaaaaggtgttaaataattagtaaaccttagaagtaaattattttccggattaatgaatttctaattttatataaaattcaattggaaaatagcactacagtattctcttagcagaccacatcttctgtttgctacctaagagataatctacaacctcaagtctctatggttgtgtacaattcatctgagctcatcaggcttactggagagtcaggtttccctctgtgatgcaatatttcatagactaagcatctttaccatttcccccggatgttcatggtttcacaccttggaatagtagaggccaccaggctcctctagcccatagtgtgtttccacattgacatcctcccagtggataccccagtcaacaaacaccagcagcaccggttatggcagcagtttattttagtctcctcgatgacccagaatttcttctttccttcagtaactggtacttctaggaaaaatacctctgagaaaacctccttatctcttatgatctcttggtagctacacaactcattattactttcttgactccatgttaaaaattcatgttaggcatgattttacaagcatttggtgtcctgtacaatgtcattaaagaaggagtatctgtaaggggaaacgtgagatattttctgtgaagttggaagacacggtactcaagaccatcctcactttgaataccagttgtatgtttgggggtttcccaagatcactctcagatttaacaagtcactagaaagacccagggaactcactgaaagccgtgatatattcatggttatggtttattacagagaaagaatatagaataaaatctgccaagggaagagatgcacagggtggagttcaatgaagtgggggtgtgggtgtttcaaatgtgaggcttctattattttcaggatgcattaccctcctgacatcaatgtgtgacaatatgcatagaatattgccaaccgaggaggctcctcagaactttagtttccagagattttactggaactctatgtttgactgcccacatggctgacctctagtctatggactgttggaggctgaatggataccatgtggcccaaagacgtcatcataattcacatgaacagcagcactatttcaatttatgacatgtaatatgtatggatcagtggagcttgtggttttcattgttctgtgtgtgtgagggtgatgatagaaaccatgaattattttgcctaatgacagtattttaatgcatatcttttgaatttagcaggccagtagattttttgttgattctcagatcagctgaggtctccctagcacctccgatttgagtttcagaatcctatatagataatattctagggaagtccattgactcagattttattggtttatagaaacatgattgtattgtatttatttggatttgaatataagtaaaatattttccatggtaactctttttttctaggaatatgtgatatctctctaattattcaggtcttgttttacatttttaagtagagatttattactttcttcataacagtcttgcagattaatgttgtttaacccttcttttatttgtattgtgggaaagatacttgtattcgtctgttttcctgctgctaataaaggcaaacctgaaactgggtaatttatacaggaaagaggtttaattgacccacagttccacgtggctaggaagcctcacgatcatggcagaaagcaaaggggaagcaagacatgtcttacatggcagcaagcaagagagcgtgtgcagggaaactgcccttttataaaatcatcacatctcatgagacttattcactatcatgacaacagcacgggaaaaacctgcccccatgaatcaattaactcccactgggtcccttccacaatatgcgggaattatgggaattacaattcaagatgagatttgggtgaggacacaacaaaaccatatcaacacttttacattacttttaaaaaatctgtttatttctgatattatagaactacagtatagagcagggatatggcataaggtataatatatcttgtcttgaatgttactgtattctctcataaatttgaatataatgttaatgtacctatatttctatgtattattaataataaaagctatcattattaacattccactactaagatgactaaattcttcaattttctactatatttcttaaaataataatataaataatagttgttcaattgggcatcatttctttgttctctgttaataaggggttttctattgattcatgatattcttcaatagggtaaatatcttgtgtcctattcttagtttgtcacatgattgttttttaaaaattaaaaatgcatactgatttcaaattattttttcatatcttaaaatatatttgtagttttcttttttaatctaataatatgtatttttattatttcctactttctcataacatttaagacttaatttttgtagaaaaattttagctgcattgtgtaatatttttatatgttgtattctcagttttgttcaattctagtttattacatactttgatttcctgtttatttgaataaatatttggaaatgtaaaacatttgatctttattccatttcttccttccctcctttcttcttttcttctcctttcaattttctaataccactttccaaaactgaacaatttgtgctaaatatttttgtgtttggctttataatgttgttggatttttaaaatccaaaacattgttatactggcaaacactatggtttgcttagttaataggtgttctccaattttgcataccaacaaaactccttgttttgactccaaagttcccagttgcagaggattcattatcattggttttggtcatagaaaccaatcttattctccttgataaatccttgctttcatgactgtcctggctgctagagctgggcatgtgacctagttctgtccaatgagttgtaactggagatatcctgaggaagcaattggaaaaagaatatcctcttagataataaggggataacagatggagatagctcctgcttcttctgcctcctgcccttgaataaaacctaactctgcagtggctgaagctgtgacaatcctttggtctcccagggaaaaacaagaaaattataatagaaacagcttaacgtctatatatgtaccaacttttcttgatgttagttgcagtcaggtcattaagttctgacgaaagatatgcaacttttgatatttttcctctttctagtttatcctgttgcatacagctctagctaaagcaattttttttaccttaaggtgaattgaaaatggaattccaaataaaaatgatgtaacaacaaaagaaaatgttagatatccaattctgtagggcatctttcagccatggttcatgtatctgaacttttacacagtaaataattaaatttccatatttttagccagtttttattttgaattttctgtcccttaaatccaaaactaatcttaactaatactggtgttgactcagaatcctgatttttgtgagatgagtaaggaaaagcgtgactgcttaactttaggttcttgttaagtgaaatattttcttacttcatggttggtttttctgttgcttataggaaaagtgttcactataaaaaataaagacttcacagatatagccatagatttgataattatccttatttgttatattaatttctctacgtgaggagaaaaggaactgccaataacctacagaattgatacttctggggtacattttgaagcatcatatttgaaaacaaacctactgacctctgttgctgattttcataggcagagcttttaaagaaagtaatctcccttataatatagcatttacatttccatatttcatagctataatatagttttatagcatgatagtacaatttctatttaatttgatacctgacttaatatatgtgtatgtgtatttatctatgtgtttaaattctaatattcaaaattgttccaaaaacacaattctgccctttgtgatatgataaagcccagatagaaagctcttaatttttgtcattcaaacatctacactttaatgcttaaataaaagctgtcatccaaatataaagcattctctggagatattacatattttaaagatcatggctagtggactgagtttagtaaattaatacgtaaaaagttaattctaagttaatttcataaagaatgtccaggggacaataagtagcttgaagaagacattgttcagaaaagtagaaagttgttgctttttccagctggttgatatttcagggtcattttgtattttaaaattgccagtctttctaccacttgaatatcttggagctgtgtatatgaacatagtcaactctttcattgccttgagcattgctggaggatattcaagctatttgctgatctctagctatgttttaaccaaactttattttataaagagtccctaggtgcaactatgaggcatttttatgcctcctttgattgattcttccagccatagccctcggtgatttggtaatactttaaatccttgcctaagttgtttcactattagataaccagtgtgtagacctgccagaatatttgtattcctttctctgtggccaagaactgacttaatgttccctgagagaatttcattgtttgatggccctcctcattctgttttctacggtctgtggttttacacaaaacttattatctttgaagttaggcctcatcttcttatccttctaatcctatcacctccagttttttttttcttagagatggaattaaaaggcagtcatacctgattttgaaactaagccccactagtgtttgactaaggctaagaaactgacctctttaccacaagttccataaactgcacattgtaaaaaataaagttgtgatgtaatagtgccagtcacatggtaactacttaataaacttcagtttatctctttcccttttactcatattgcaattataatttgttcttttgtattgaagaactaatggactttttaataataaatatagtcttcagtcaacatttattgcatatgtataatcagatttaatcaataattttttttattgtttttgttcttgagttaactggttgctaatttgtaactcagaacttttctgattaataggacaactatgcattttttaaataagaaatacatggttgaaatagagcaataccaatttgttactacatttggatgagtgtgcacatttttgaatttattgaataatagtaatttttatgattaaaccattcattagtactttagaatatattaacctggagttttcaaatttatattcaaggcgattgtatgttaaaatgcaaatattttatattcaggttttgtaaaaaatattgttttgcctctcttaagctttaaacattgatttaaataaggtctaagtaatcaatttattaagtgatcaatctttgtattcaacatgacttttatgttcccaaaactatcttaatctcacctagaattttatacttacacttcaggattcttagttccatagcaatattgttctagttttacatacaggagaattttgcttttaacttgtggtgtaaaaccatgatattttcttagcagttaaccatgtttgtttgttattttagctactgtaaattggatttatgcctgggatttagtaagcccaggacatagaaactgtgtgtgtgtgtgtgtgtgtgtgtgtttgtgtgtgtatatacatatacatatatatatatactatatatatatatatatagagagagagagagagagagagagtttttttttttttttttttgagatggagtctcgctctgtcacccagggtggagtgcaatggcgtgatcttggctcaccacaacctctgcctcctcggttcaagtgattctcctgcctcagcctcccgagtagctgagattataggtgcccgccaccacacccagctaattttttatatttttagtaaagatggggtttcaccatgttggccactctggtcttgaactcctgacctcaggtgatccacccgcctcggcctcccaaagtgttgagattactgtgtgagccaccatgcctggctgaaactgtctatttttctgagaaattccaatatcatgggcatcccaatatttttagaaaaattaaaagcttttattcctaaataagcttatagaaataaaaaaattgcaattttttaaaaaaattcaaaacatttttcattaatcattttacaaagatactactgggagaattagtccattaaaaataatgggtgatatcttcttcttccacttagaacatagagttgcaagaggattgtctcttcaatcctaaccacgcgaaacttaaagtcatagtttcttaagctcattagagatgggagcatgcaaagaaacctactaaattataacccacacagtgatttgcttagaatagaagtgatccacaaatgctttaatctgtggccaaacagctgaataatgaagaagccaccaaagctatgagcaagaagaaaacagttatactttcaatgagttgttaaagactaataacagactggtatgacagaatccctaggagacatagatgaaaaatatctgcaactatccgccaactctttcccacaagccttattgagctctcatgagaaagattgtgggcagcacaggagagctgagacagattccatgggaggttcaggtgtgtagggcctgctgaagtctgaggggaagaagtaggactgagagaaacctctggacacttcagatactcatcatgtggtaatgtgatgagcctgctaaaatgtgagggcagagcagtataactgcgagaaagcccttaggccatggtgccttatacttaatagggaaaagcacctctctgtgcctagagaacaggtgagaatgacttctaaaggtgcaaaggtacagagattactgaggtctgaggacaatgagaaaaaaaaaatggagggcatccctatatgcactctgggtctgacaataagcatgcagcagatgccatttgtagctgggtgtggggaaagaaagatgaaataaaactatcccaagtgcatgagcatgagatctgatgacatgaaaataaatggctcagacactcagatcccaagtttattaaaataaaggttctaaaactaccctcaaataatttgaaacctgtagggaactaaatctaactgaagcaacaacagagtttagacctaggtcaactataggctaggttgactcagaaggagcatgcccttttatagccaaaaatatttacgtcagcatctattttttttcacaaattgtccagaacgtaagcaaaatttattagacaaatgaagaggaaagaaaatgcttcaggagagaagcagtcaagagatgtgagaattatcaaacagggacttaaaaataactgtaataaaaatgttaaacggtcttaaggataggccagctattttaaagtaactatgtgaaatatgttaaatgaccttgggcaaaaagcagatgacaacaagcaggaacagatgggaactactagcacagcatatattataaagaataaggtcaacggaaaatgctagaaattaaaaatatggcaacagaaatgaataattattctgatcagctagcttattggaagactgcacagcagaggaaagaatcagtgagtcagtgaccaacaggcaagtaagtagaaactgttcaaattgaaacaccaaaagtaaaagagtgtattactccattctgtcattgctataaagaactacttgagactgggtaatttataaagaaaagagtcttaattgaattaaagttccacagactgtacaggaagcatggctagggaggcctcaggagacttacaatcatggcagaaggtgaaggaggagctggcacatcctacatggatggagcagaaggaagagtgagcagtgggagttgatacacacttttaaacaaccagctctcatgagaactcactcactaccatgagaacagcacaggagaaatccatccccataatccaatcacttcccaccaggctcctcatccaacactggggatcacaattctacatgagatttgagtggggacacaaatccaaaccatatcaaagagtaaataaaagaaaatggagcttgcaagattaaagggatgctataaaatacaaatattgaatataaaattaaatcataatatgaaacatagtcattgaagctcaagaagttgaagtaaaattgcacagaagaaactatttaaagatagaatagcaaatgttttttcaaaattggtattacatcaattcacaggttaagcacaatgtgtatgctgaaactgtacgtggacatatcatggtggaactgctgaaaaacaaaggaaaagaggaaacagtaaaaactggtggaggaaaaaagacattacattctttaaggtggaataacattgagacaattgctgatttcttaccagaaatgattgaaaccaaaaaaaattagaatgaaatatttatactgttggaaaaaaattatgcataaaaatttctatattcaaagaaataatcttgtaaaataaaggtaaaataaaggtatgtttaaataaaagctcaaagaatttgcagcaatgcatttcaagaaagactaaaataagttcttcaggctatagaaagtgaatatctataaatctaatacacataaacctagaacatcagaaagatgtaaatatatagaacatatttacaaaaaattttgaaatatctacatctatgttcataactttatatcaatatttgtatctatctctttaaatgtctttaagatactatggactgtttaaagcaatataacaatgaactgtgatatcctgtaacatttgtgtaattaaatatatgatgagaacacaaaaatcaggaaggtaataattcaaattatatttttgtaaaattcttattgtttataaagtagtacattattttagaagctagattgttatagattaaagatacataagagaaacgacaaaataaataacacaaagaaacacgactaaaaatgaaaagaagagataaaatggaatactaaaaatatcaattcactctagagatgaaaaacaaataccattttagtagacttaaactcaaacatagtaattattacattaaaagtaaatgtcatttggttcttctagaaagtttactcacacagagtagaagttcaagatattttctcacggtaacacctgtgaataacaaacacgagggtcattaggaatagcaggaaagcatttctattgccaatgtattaatactggtaaaactagaaagagaaggaaaacagattgcataaaaagagctttagattgtaaagtatctttttcatcaacttgtagtaaggatatatgctaacagcgtgacttattgttgatgatattaactttgattacctgaccaaagtagtgttgaacagctttttcaactgtaaaggcattctcctctcttccacactgtagtttttgaaagcaagtcactatttgctacaacccacactcaagagacagtgtcttagtctatttgggctactataacaaaatatcatgaactgagtggcttaaaaataacagaaatttattccttacagttgtggagtcttggaactcttaagttcaaggtattggcagatttaatgtctggttagggtccactttctgtttcatagagggcgccttcttgctgtgttcttagatgatagaatggggtgaggcagctatctcactgcaacctccacctccgggttcaagcgattcttctacctcaacctcctgagtagctgggattacaggcatctgccaccacatctggctagtattttgtatttttagtagagatgtggcttcaccatgttaggcaggtttgtcttgaactcctgacctcacatgatccatccacctcagcctcccaaagtgctgggattacagggtgagtcactgcgcccggcctagcaaaatttcaagtatacaatacagtattgtgttaactctagtctccatgctgtacaccagatcttcagaacttattcatcttataactgaaagtttgtgcacgttcatcaacatgcatccatttcccctaaccgccaggccattgtccattagcaaccagtattctactctcagtttccatgagttggatttttatgaattccacatatcagtgagattgcacagtatttatctttctgtgtctggctttttcacttagcataatccatccagatttattcatgttgttgcaaaagacagtatttcttcttttttatggctgattagtattccattgtgtatatgtactacattttctttatttattcatctgttgatagcattcaagttgttttcataccttggctattataaataatgctgcaatgagcaagagagtgcagatatttctttgagctaatgattttatttacttcgaatatatacccagaaatgatcgttctatttttaattttttgaggattctgcaaactgttctttgtagtagttgtaccaattcacattcccatcagcagtgtactggggttctctttctccacatcctcaccaagagtcgttatttctcatctttttgagagtagctgtactctaggctcatcttgtgtattccctgctcatctttggattaggccatttctccaaggaatcttgatttattttattggagaacagttttagaaacaaagacctggtagttgagtgtgtcagttttactgtagtgttgctacttctaggtcttcaactgatagaactagagaatatatatatgtgtactaactcatgtttacacaaatatatataatcatttacctacttatatatttgtatctgtattacgctagacataagttcacacagctgtccctaactctaatccattaccacgtggttcattctagtttcccctgtccttgcctatctgaaactgctctcccaatagaaataaacctgcctcacagcatccaccatgtatttacatattcgttcgaccctactctacatatacagctttttcagaattgttaacccaggtggctgtgaaaaacaactatagtgtttatgtacagttccttttgtttctagtcttagagtttccaatcaaagcaccgttttccaaaattacttgtcagctagttttctgcccacccttttcagtgaggattttccataaatttgtgatacagctagaatcttttcgtcactatgttcattgcatacaatacagtcttctggttaattcctttaatttgtataaattaaggtttactcattttgttgtacatcttttttttgttgttgttgttgttttgcgatggagtcttgctctgtcatccaggctgaagtgcaatggcgtggtcttggctcactgcaacctccacctcccaggttcaagcaattctcctgcctcagcctgtggagtagctgggattacagcggtctgccatcatgcctggctaatttttgtatttttagtagatatggggtttcaccatgttggccacactggtctcaaactgctgatctcgtgatccgcccgcctcggtccccagagtgctgggattacaggtgtgagccactgcgcccggcctttttgtggtacatctttatgggtttcaacaaacgcatagcattttatatccaccactacactacaatatggattaattccattgaactgaaacatcttagtgcctctcctagtcaaatactctcccttccacaatcatttgaatatcctgatctgtctttcagtccaacagttttcccttctccaaaatgtcatacgaatggacttcaacatagactttcagcctgacttcttatgtatagcaacatccacttaaagttcatctaagtagctccatgagttaatagcttatttatttttattactgagtaatattccattatatggatgtaccactgtttattgatccattaatccaactacaggatattatttcaacattgcttgaaatttttggtgattatgaataaaactgctaaaaacattcatctgcatgtatttcttagacatatattttcaaatcaattgtgtaaatattcaggaacacgcttgctaccttgtatgataaatctaagttatatttagtaagatactgccaaactacattgcaaagtgcctttttgtatccccagcagcgatgaatgagaggtcctgctgctctgagtccttgccaggtttgggaattgtcagtgaagagtctatttagatcttttgccttgttattaattaagtacaagctctttatcagatatattatttgtaaatattttctcccagtttatgacttgtcttttcattcttgcaactgcatccttcacagagcaaaatattttaaaattttatttaaagtttaatttttcattatgttctttcatgagttatactgttaatgctgtactttaaaacacacagtcaagccctaggtaatgtagattgttgtcctatgttttcttctagatgcagaatttctttttcactctttttgctgtaagtttttatgtgttttgaccctatttgtgtaagtatatttttggaatctctattgtgttccagtgatcggtatttctatctttttgttaatagcaaacagttgtaattactgaagcttaataacatgctttaaaatcaggtaataggagtcttgcaaattttttttttgaaaaattgttctgattattttagtagctttacctttccacataaatattgaaccatcttatgaacagaacatctacaaaaagcttgctgagatttttatttatttatttatttttgagatagagtctagctctgtcacccacgctggagtgcagtgatgcgatctcggctcactgcaacctccgcctcccaggttcaagtgattctcctgcctcagcctcctgagtagctgggattacaggcacccaccaccatgcccagctgatttttatatttttagtagagatggggtttcattgtgtcggccagactgatctggaactcctgacctcacgatccgcccacctcagcctctcatcttgctgggatttttattgagattctgttaaattaatagatggaattgggaaaaattaacatctaaacattatggaatgttcaattctttctttttttcattgctgaatataaaaaaaaaatttaaacttaaaaaatactaattatagtagcataaacattgaagcacatagacataaatatagcaaaatatgttaacataagttttaaggaacagaaatcaacagagtatgttctctgaccatgtgggaattaaaatagaaatcaataacagaaagataattttgacaaacaccaaatttgtgaaaattactcaacatactctaaattgccatgagtcaaaaaaaaaaaaaaaaagaaatcagtattaggaaatacttagaaatgaatattagtaacaacatgaattttcaaaatgtgtgagatgaagctaaagtgtatactacaaggtaatttagtaactatgtttacaaatcaaaaatacatggaatttataatatatgtctcaaatttataaagttagaaaaaagaaactaaagataacagtggaagtcattaaaaatgaaaatgaacaaaaagtaaagaatgtcaacaaagtaaaaaggcaatacttgaaaagactagtaaaatttgtaatcctctggaaagagaaaagctacaaattaccaaaataagaaatgaaataatggatgtcatttctcagtactacattactaagaaaatgcaacaaataattcggtgtgaataagtttgacaacgtgaatggagtagaaaaaaattgttttgaattttttgaaagacgtaattggcacaagacatagaaaaatctcaacagtattattaatatttaaaaaaataaaattttaatgatggaatcttcttgcaaagataactctaggactgttttgcttcactagtggattctaggcatttaagaaaatgacaatatactaattatattagaaaacagaagaaaaagaagtatttaaaacttattttattaggcaagtatgtctttgattccaaaaccagacaaggatactcaaacagagaagtattgcagacaaatacctctcatgaataagaggcaaatatttcttttaaaaatatcagcaaattgaatgctacatataaaacatattacaagaaaatatggtttaccgcacctggctcggagggtcctacgcccacggagtctccctgattgct

SEQ ID NO: 1924 - DNA, 111 bp, Homo sapiens
acccccacagtgaaggtgttactaggttggtgcaaaagtaatcacggtttttgccactgagagtaatggcaaaaacagtgattacttttgcaccaacctaatagtttaggc
